United States Patent 10,724,096 (METHODS AND COMPOSITIONS FOR INHIBITING AND TREATING NEUROLOGICAL CONDITIONS) - sequence listing, part 47

SEQ ID NO: 995 - DNA, 78084 bp, Homo sapiens
gcaggccgcggcgggcagagcggggggaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcggtaaggccgcgggctgcgggcgcacggcaggccggggatggcggcggcctacgctccccggcggcctcggggacaagccgggcggccttggcccggccctcggcggccctgtccccggttggggtgaggccccaggcgggcgccctgggcggccgccgggtcgtgggggcgcccggggcctcgggcctggctctgcgggggtcccgtcggtccctggctgccccaggccggcagtccctgccctcctccaggagccggggcgggggtgccggggaggacctggccgcccaacgccgctcggtggtcgcctcattcctctgatggggccgggggttcggggagcacctggcggggtcgcagagagctcccccgggctcccttaacgttaaccttctccggaaaaaaagtggtcagcgttgagcaagacaaaagaaacgagcaagcaccgcttgggcttggttctgttttgttttggttttcgggggtagaggtgggagaggcatggtctcgctgtggggcgtccctggcgagggagccgccgaccagcccccgggttgctggcttttgctttcttgggcctggaggccgaactcagctgaaccttatgtattgatctgaaataggagtttggagggtccagtcgagtttgctttcgacagcttccaagctcaccgagcccagagaccatctgtttcctttcttgtctagttctcttcctggacactcttcgtttatcctgcaattgtactctcctttgagggttttagacaccagcatagagacagtattcaagtatcctagtagactaataagtgaaaagaaactaaaaagaaaatgccttgtcactgttctagtaagaatgctagttgcttcacttgtttactttattctgggagaactgcccaaattgaaaaatgcattctgtgcagaaacaattactttgctaatttttaacatgacattctcttcctatgttcatattatgtgataggacactttaaaatgtacactttaaaaatgtcagatacaacaatgattttttatgggcaggcaaaaatggagtttttgccttcagtaataaaaacaaactttagtacaattgttatttaagtgatacatgagaagcgttaaaaaatttagctctagggcaagctcttgggaaaatgtatcaaacaggaaaaacagggtttcataaatgtagagcagtattacacggagggaaatgacagtggtagacttcaagacaacttttagtttttacttgcttatacacactctacttttgttgaaagaatttaactgcagtttattaaaacatttaaattttgttttctttaaaaataccaagaatcatttaattttatttatttatttatttatttattttttgagaccgaatctcattctgtcacccaggttggagtgcaggggtgtgatctcaggtcactgcaacctccgcctcccggattcaagcgattctcctgcctcagcctccctagtagctgggattacaggcacccgccaccacacacggctaatttttttttttttttttagtagagatggggtttcaccatgttagccaggctgctctcgaactcctgacctcaagtgatcgcccgccttggcctcccaaagtgctgggattacaggtgtgagccaccacacccggcccgaatcattttaaccttgaatatatgaaatacttgggaacacttaatgagatacttggtaatcaaaatttactatattgcagtcagctgtcttatccgtaggctctgcacctgtgatttaaccaaactcaagtaaaaaaatatttgagggggaaaaaaattctgcagagttccaaaaagcaaaacttgaatttgccatattcaagtactgccttgaatccatgtgaatgaagtgatgtgtaggcattgtattaggtattagaagcaatctagagatgatttaaagaatacaggtatgcataggttatatgaaaatatgccattttataacagggacttgaacatcctcagatcttaggggtaggaagagatgtcctggaactagtcccctacagataccaactatatttatatcctttacccatcaggctagtatttacagaaataagtacttagaaaaagaaagacggctttcctgctctcctagtaaaggctcatttttatccggaggcctgtgttttcttgtcctcgttatctttttataattgtatatattagcatctgccaaattatctggctcctgctctgtaatatccttagcctactttgctgaggttagtgagaaaaagttagagtggcttgtgttcacctagtcctgaaattaatgcattgcatttagaagtgtaatgttttcatttgcttagacctaatgttttcatttgtggcaccacccatcttatcttgataggaggttaaatctcatgaaaaatgtttgatgttctatactaacctttttttccccccttttaacattctctcttgggaatgaactcatgtgcaatgatgaataagccatccttgtgtatttggatagttttttcgtagcccaaggttagtttccagttattcagttctgtttattaatttgcttgatattttcctctatgaaccaatcttaccattcctcagttcatttcattagctcttctgtgtgttcctgttcatgtgtacgtccaattagcatttcctgatgcagtattccaattaacatagttatcaggattatacagagacagaaaatacctggatgctgacatgagcttttttcattattttgttggatcagtctgtggagtaatgcttttccaaccattttggtatgattactttccaggtttccttatttaattgataagccttcaaatgggtttttaatttttaattaactatttacttatttttcgagacagggtctctgtcacccaggctagagtgcagtgacatgatcatggctcactgcagcctcaacctccagggctcaaacgattctcctgcctcagcctcctgagtagctgagactataggccagcaccaccacactcaatttttaaaaaaattttttgtagacactgggcctcacaatgtagacactgtgcccaggttggtctcacatttttgggcttgagtgagcctcccacctccatctcctaaagtgccaggattatagggatggagccatcatacctggcccaaatagtttttttagtgttgactggatgtattcatttaagtgaggcttaaacatagagtttatcttactgtttaattaatggtttctcctcactccctggcaactacttataacgtgaaaaatatgactaagatattttccaaaattaatatttgaaaatgtgttgttaagctgatagactgcattttgagtatggaagataagttcacaccttcttgattaaaaacaagaactgtaatgtaactcctgcctccctttttagaaatgacagtcttctctcagtacagaaatgattggccagtaagagtcttatgaaatgaatctgttagccagttgccgcatgtcacaagtctgaattcaggcctttcttgtagttagttccggggttagattggattgttttaacacaacttcttcaaaagatagataaaacactttccatgtagtacaatttggtatttgttgagagcctagtcctcactagggaatgtgccaagggcatgttcctcttaaattccaaccagttccacccttgcgggcagatttattccagagaggataaaggacagtgtcagggaagagttttatcattttagctaattcctttaatggaagtcatctttcagaatgtaagtgcaatgttttcttttcaaattatagttaagagttcatgatgattgttgagactagcaattccttaaaaatctcctgtgccctggaaattcaaaccacaaatcaaatgtatctcatgttttctcaggcatattcttttccaacaagtgatctctaggttcagtccttcactcattcagcacatgtcttctgagtcaccacgaaagcctggctccaagtgagggaaacaaggtggacttggtgtgcttgtgtccttggtcacaatgcttacagtctcatatgggaaacaaaacaaatatacaagttagattacagaataaggaatgcctaagaatgtgttctagcccatagagccagacagaatcatgttccattcctgcctctgtcccttccttctacacttggacaagttacttgatatgtatacatttccatttcttcattataaagggaaataattaaacctatcatagaattgttgtgaagattaaaatgagataatgtacatgaagtgcttagtgcagtgcctggcacataaaaagtgctcagtaaaagtcaaccattattgtcatttggatgattggtttagccagtgaactctataggagaagggagcaagcatttaggattggagttgttatagaaggctctctggaaggaagtgagcaagactttagagaggcagagaagatggggaaggtcactaggaaagccaggggcagaaagaagcatttaaaaaatctgggagtggcatcaggcacagtggctcacacctgtaatgccagcactttgggaggccgaggcggacggatcacctgaggtcaggagttcgagaccagcctgaccaatatgatgaaaccccatctttactaaaaatacaaaaattagccagatgcggtagcatgcgcctgtaatcccagctacttgggaggctgagacaggagaatcgcttgaatccgggaggcagaggttgcaatgagccgagatcacgccattgcactccagccagggcaacaagagcaaaactctgtctcaaaaatcaaataaaatctgggagtggaatgttgatgatacatgagacacagtaaaagcagaggtggcttttagaacactagttttcatctgaattatccatctagatacttttgtgtgatgggtatattggacacagtcaagactcccagttgaaggcagtgtttccttgggtaagtcagttaaccaattttgagtcttcagagtttgagcaaaataggtttatcacaagagtttaagatcatacagtatgtgcaaaatttgcagtattacacctggcacataactactcattaaaaggcagtgacttctgtgttatttatgcatttatatatattatcaaatacttaactctgtgtcatgcctgagttggaaaccagagattgagtgatgaaaaagatgatacagttccagccctcatagagctgacaatctagtggaagagatgaataattaaacaatgacaaaagtgggatatgggataaaagagagcaagccagctggtaaagagtatcaaggcataggccgggcccggtggctcacgcctgtaatcccagcactttgggaggccaaggcgggcggatcatgaggtcaggagatcgagaccatcctggctaacacggtgaaaccctgtctctactaaaaatacaaaaaattagctgggcgtggtagcaggcgcctgtagtcccagctactcgggaggctgaggcaggagaatggtgtgaacccgggaggcggagcttgcagtgagccgagatcacgccactgcactccagcctgggtgacagagcgagactccatctcaaaaaaaaaaaaaaaaaaagagtatcaaggcatatatagggactccatcctaggcaggaagagcctggtcaagctttgcagagaaagcgaagtctagttaagggtttcatgtcaacttggggttgagatagtcattgcatgaattttttaaaatttaattctctgtgttgtaaaaaattaaattggaatctcttgatactgattcacacttttttttttttaactcagagcatcaatatttttatgcagtgataaaacaggtaatttgcatgttagaattagtaatgaaagtttaccagaaagttttacataaataaggacatttattcatgtttgaacaagattattactaatctaagttattagcaattgagaactgtttaactctctagttaaataggtttcttatttaaatctaactcctggagggaggtattcacaaagtaacaccattctgctttgaatttgactgtaacctacaacaagggtcctgacacaaatgcactaagacttctctgtctggtgaccagagaatacagtttcaattcccttgaaatacagttaaatcccactcctgaaataatctggaaaaaggatactgtaactcctcatatacccaggaggttgccttggaaaaatttaacaaatcatagcatttacacttaagaaattaggtacagttcctgaaacaacaaatttcatttgggtttgtcccactcgtgaatgcacttaactgtataaaggtagtctatagaagtcaggtccaaaaaaattaggaagaggttttattattttgagaacattctaaaaacaagtggctgattaaaacttttttttatctaaacattttaggaagatgatactgttttcccaagttaatactttgattcttaattttcttccttattttttccctcaatctcccgtaagtttttttctccccatgttctccttgaagttaaagtactcccaaagattttaactcctttcttgcagtcttttttatttttattttcttgaaaataaggtgaatattttattctcttaacacagtacgatttacagtggaagatactgataattgttgaaatattttcaggtctattttattccataaatacatttcatcttcttgattgaaacacttaaggtgtttatgaccaatatttctaatttggacaatagttcggaaattgtttcgacagggttgccagctctgaggtggatgctcaggacaccaagaaatcaaaatggtaccagtagaagtgcaagaataacatgacctcttttaggtcatctgtttagaggaagtctatgaaaatggactctggagaagtaaagaaacaaaagaatgggtactccataggcagggcagccccaagagctactagttggctatttttctagttattaattgatcatatgctaaacaagggatggcttattcatgaactttctggggaaaggggtgggccattctcggccttgagggttcctcccctttttagactatatagggatggcttattcatgaactttctggggaaaggggtgggccattctcagccttgagggttcctcccctttttagactatataaggatggcatctttcagacattgccatggcatttgaaggctgtcatggcactagtgggagtggctcttagcatgctaatgcattacaattagtgtataatgagcagtaaagataactggaggtcacttttgtgaccatcttggttttggtgagttttggccagcttctttaccgaatgctgtttatcagcagggtctttatgacctgtatcttgtgatatcggacctgtgacctccagtctcatcgtgtgactaagaatgcctaacctcctgggaatgcagcccagcaggtcttagcctcattttacccagctcctgttcaagatggagttgctgtggttcaaaggcctctgacaacactaggactaggggagctctcactctctttcactctttaaggaaaagaaatgtagaaagtgtatgcaaatctttttctatccatttaacacacacttgaaatacttgtaggtttgctataagatggctgaggggatataattttgggcataaaacttctgaagtaagttttagagctaaaatgttgagcatttttgactttgtggaatttaaattgttagtatcttgttcaagtagttattttgctaaaaatatgcactgcctaatccaagcttaaaaaagaaaagatttacatttgtatgtcactgaatgtagggtacagttttaatctgattacgaagttgactttggtatatgttttagtagtgatgatgtggaactaattacatagcagctttttactgttttgcatttcaaagtcctaggtacaaagattcctggctattagtaatttcatttactgatatgtcagtaatagaatattgtttcgttttcatttaatatacctctgaaacctacttttttttttttttttttttgagatagaatctcgttctgtcatccaggctggagtgcagtggcgcaatcttggctcactgaaacctccacctcccaggttcaagcgattctcctgtctcagcctccccagaagctgggactacaggcgcacggcaccacgcctggctaatttttgtatttttagtagagatggggtttcaccacgttgcccggctggtcttgaactcctgacctcaagtgattcacctacctcagcctcccagagtgctgggattaggggtgtgagccactgcccccagcctgaaacctacttttaaaaaagtgtcaggggaggaaaaaaaagcttgatactgtagtttaataataatgttgataaatatgtttttcctcttcttgataactcatttttactttcttggatttgacttattttgtttctctttaatatctgacatataaaaacaaagttcaccccttatttttatgctacctttgcattgtaatagataaatacagagttataagttatgggaaattttcaatgccattttcttaattgttgtggtcttttgtttgtgtagcttgcaccttctcttcctttacaagaagattttgtttatcactggaaggcaattacccattactacatagagacttcaggtaaggaacaatgctgatattaactgaaaatttgtgaaagttaaacagaaaatttgtgaaatactaaaatatttttaagtaagtctccaaagttattttatatttaagtttatagacaatcttatctttgtctttaagattcagtcactcatttaaaaatatacctgttgagcacctactactgtgtgtcaggcattgttgaggcactgggggatagaacagtcagtcaaacagacaacactgctgtcctcacagagtttatgtattgattgggaggaggcagacagtatatagacaaatatgtatagtgtgtcagatgataagcgtcaagggaaaatgaagcaggctaaagagtacgttggggtggtgggagtggacagttggctattttaggttagagaaaacctcattgcccaatatgacttgtgagctgaaatctaaaggataaaggaaccaagcctgctagatatctgggggaaggatgtctcgggaatgagacctaattcacaaaccctcaggccagagcatgtggcacgcttggcacatcccaggaactttaaggaagccagtgtggatagagcttgaacattcattctttcttggagcgtttgtgtatataaaggctacaattatggggaaaacacatttttaaaaagtaaattacaagtaagcttacaaatcgtcttttactagtgctaggctactcattttagaatatgaaatgagacataacatttcttgaattctttgtgctaaggactgagctttattatttcattgaattcatataacagtactcactagtgtttattagttccattttatagttgttggtgactgatgcttacatagtttgcaccagttcatccagctgaaagtgacagagccaagatttgaatccaagttgtctaactccagggcccatgcttttaacaactgtcccataccatatcaaacttgatacatatgtcctcctgaaaacaaaggtgacccttctctatccattgttttctccataaggcttagtgttatggttttctgtgttagtatacatacagacaaagcagcatatcagtacatagcataccagaattgtgttgttcaaactatagaagtacaaagtaaatgaaaatagagacataagtaaagaatttggcacttcctaatgtattttgtatttaaatgttctataaaacttcacatttttaagagtaatttaaccttagtataataaggatgggttgataaaaccatgggatgtttgagtctaactgtgatatgttaaaaaatatcactaaatttttattttattataagaaatcaataatatttaataaaaattctcctgagaagcaactttgaaaaacagattttggaaaacagctatacgttaatgagagatgtcagtaattttaatagagggttttccttttggcttctcattgtaatagaagaaaatgaattaaggacattaagtgacagatttcccaatcctacaaagtaacgtagtagcaatccaaaacagaatctgtcctcttcatatatcccaggttatttgccttcatgttcaaggccaacctatttctatttaaagagacttaaagttcagatcttctgaactggctaagtgaaaaaaaaatattttaattataaatacacatagaacatttttgatgtgacatgtatttttcctggtcatgttcccatttcccacataaatagctcttatttctgaattactgtggatagatgaatgttagcttatggaatatatttgagatttttttttttttttttttgagatggtgtccctctctgtcgcccaggctgacgttcagtggtgcgatctctgctcactgcagcctccacctcccaggttcaagagattctcctgcctcagcctcctgagtggctggaatcacaggcgcctgccaccacacacggctaatttttttgtatttttagtagagaggaggtttcactgtgttgaacaggctggtcttggattcctgacctcaggtgatccacctgcctcggcctcccaaagtgctggaattacaggtgtgagccaccgtgcctagccatatttcagaatattgattcagttttagggtaagaatatgacaaaatgcatcatctaaattctagcagagataatcatactgtgtttataaacctcacttaagtgtgtagttcagatttttctcagtttgaataggaaaagggaaatacagagtattttaggtgcaaatatgcagtttaaaaatgtttaaatatttgatgaatgttttttattgtttagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgatgtaagttcctgatccacaccatgttcttgggcattagtacatgcattaatgtcttacgaataaagaagctgccaaatacttgattataaaggtacatattgaacatggcaggattcaagttaagattgtagaaaaaagaaaattgtgtagcctatacaaatatgtccatagagatagaaagattccaaacactctagacaacaacttgtacttggctgcttagaattccaatgtaaacatttatgaaaataaactcaagtacgtgagctcagaataaaaaaaagagatagaaggaagtcagttaaaataggattgaaaaataggaattatttgtcatagtcctggaagagaatgtcactgatgattttgacactaactaaactgttaagtggagccaatttatattttttaggcctgatgaattttgaaaaatctttacaaagctgaaattgtgatatcaataatattttatattccaaaaccttcaaattacttatagagacaagttttccagccgtgtggccgagtaagggaacgggagagccttgggttcagattagggggccaggcttccagtcctgacatcattattcacacactgtgaccattgtaagtctctttggttaatcttcctcctctttaaaatccaggaagtgtttgctaaggggcctccccagccctaaaagtctatatagttctgtgaatttctatgatatatgtgaaaaaaattaggctaaaacaaaagaaacctgtagacacatttttatgacagagagatatgaatagtagcatgcaagatgatttccttttgtctgtctgtaatactctaatttacttttaagttaaattcactcaatttatgttttttaggcaacacacctgctctctaatattctgcaactcattctcctcctcctttttcctgtcctttggagagaaggattgttaataataaattgattaattgatttttgagcagaagttagtaattgtacgtctagtaaatttattttaatacaggtgattgtaaatataatttagtggtttatctaaataatgtaaagtatttgctagcttaaaaatattgtgcataagattatagtttatactatttccagataacatgtctatgatgatgctttggaaatacttattttgtaactgtatttgaaatgtgaagcagtataagcagcttaattaaggaagttaaccttgttaattcatactctcttaatctgcagtgtgagtgatcattgggtttacctacttttcagcaaatacttaaaacaactggcatgttacaaaaactaatttattaaacattctttgcctattataatcataatgtaaataatttgatttatattatgattataataggcaaagaatatttacagttgacccttgaacaacatgggtttgaactgtgtaggtccacatataggcagaatttttgcaaccaaacatggatgaaaaatatagtatttccaggatgcaaaacctgtctatgcaaagggctgaattttcacatatgtgggttccacagggctgactaccagaactgagtgagtgcagatttgggtataatcgtgtataccgaggcacagctctaatttaaaatgatgttaggataaaatcacaacagtttacaccataggtttccttttatttacatgtgtgttaggaggctttatttactcctacatatatatgatggaaagttgatgacatgtctgtcattagtgtaagtaacaagattttgcctttgttccagcggggtgttaactattacagtttcatgttaccccagcatttagaatataaacaggttgacattgactgcaccaagctctaatctcaacaacatattattaccgtgctgtttgtaactacatgagcctgtggtctcacatgctgtgttatggtctcagatatacaatattatttctagaatacctgtcattaatatttgattgaaaattttattctgacagttattaactggccagttgcattgtcttttcaaggtggaatacattcatatacattgtctctccaattttttaagcttttcagtaaatgtgtttgcattgtctgttgttttcctgttggcttccttttttcctatacccagtgtcctccgggaatgaaacagcaggttttggttttctatacgaaacttctgggaagaatccggcagccactacttccacacattaacgtgcacaggccagtgcaggtattttgttccccctacataaaatcattttgtttgatttcttttaatgttgaaataattttatattatttttctgagagtaaaaataatgaaattattccaaaattaacatgcaagttagcaaatacttgagctttctttatgcatcacatagcattaagtgtatttacagtgtacttacagtctttctgattctctttaaaattttatacatgaattttccttggattttacttccatgacatctgaaggagaatttattatataactcgttaattatttatggtaatgaacttgaaaattttaccactagtaagtttattttgatatagataattataaatatcattagtgttctgattaatgcaggatatttgcattatatgaaaaatttaaatatccttaaggtaaatgaatggttattttacaaatttgtaaaaagtagcctaagtttaaaaagttaaaaacaattgttttcacagaaattaattagactctgtggtgaagtcctagcaacaccaacagaaaatgaagagattcagtttctttgcattgtgtgtgcgaagctgaaacaggacccctacctggttaactttttcctagaggtatgatacactttttatcaactttcaaactgtagttatattaagatcattatgaaaattgaattatgtgaataatattagaaggagctctgttttgcaggttattagcttgttttacttcccagaattatttttcctttaatatcactattttattctcctgggagaaaagaatttcaaagaatgcagttgagccagatatatgaggtggtacagggactggacagatacaaagtcatggcttaaaagaggacagcttgaaggttgaatcagagatagacaagtcacagaagttgatatgctatcatattttcagccaagcttgccctagtatgtaacatgggaaatctggcctgggataaggatggcatgtgcagatttggacaagatggaaaaaagcacgagttatctctccatcctcatagcagttgggattgctgtagtattttgtactgttttgatagccatagtcaccaaatcatagtttatttaaatcaagtgatattttggattttactcctagatttaaagtaaaaaatatatttttgtactttttgccttcattcacttctttttttcagcagtgaagtcattttggaatattttagaaaaaatgattatgttgtttttgtccttgtttgtaatttatttttatttttatttttacttttttgaggcagggtcttgctttgtagcccaggctggagtatgggggcgtgaccattggtcactgcagccttaacctctctggttcaagtgatcctcttaccttagcctaccaagtagctgggactacaggtgtgcaccaccacacctggctaattttttaagtttttttgtagagacagtgtctccctgtgttgtccgggctggtctggaactcctgagctcaagtgatcctcctgcctcggcctcccaaagttctggtattataggtgtgagccaccacacctggccttcttttgttttttaaaaaatatttttctggccaggcgcgatggctcacacctgtaatcccagcattttgggaggctggtgcaggtggatcagttgaggtcaggagttcgagatcagcctgaccaacatcgtgaaaccccgtctctgctaaaaatacaaaccttagctgggtgtggtagtgcacgcctggaatcccacttatttgagaggctgaggcaggagaatcccttgaacccgggaggtggaggttgcagtgagccaagattgcaacactgcactccagcctgggcaacagtgtgagactccgtctcaaataatacaaaatacataaataaatttttctttttctttttttggattaagatataagttacatacaatagaattcactcgtttcagtctgcattctgtgagcttgatgaacacagttgtgttaccaccacaatcaagatgtgcaacagctctgtcacactaccccatgatcctctgtagtcatcccttctccacccctacgccctagcagtcactgatctattttccatcccaatagttttctctttcccaaaaagtcatagcaatgtaattagccttttgattctggcttttaaaattagcttattgcatttgagattcatccatgattttgttcctttatgttgttgagtactataccattgtatggatgtaccacagttgtttatccatacaccagtgagggacttctgggttgtttctagttttttacaattgttaatgaaaccactaagaacatcacacacagatttttgcgtggatttaggttttcatgtcacttggataaatacctagggtaggatcaccagatcatatggtaagtgtgtatttattttcataagaaaccgccaaactgtttcccaagtggctttgtcattttgcatcccatcaacagtgtacgtgagctcctgttgctccgtgttgtcgtcagcactggatgttgttaggtctttgtttgttttgttatttttaaatgttaaccactccaatagatgggtttgttttctattttacattactaagtaaattaggattctattctggactcttaactcgaattaggtaagcagttaagctgtaaaatttcatgaatttaaatttctaggtggtggtaaggactacgcatgcccttaacactcatcatgcgcatcgtgtgttgttcgtgatgtgcgttatattttgtatcatcttttgcaaatttgcttcaaaagggctggaacagtcttatgattttggatttctaaagatttataatgatattagaattttttttttagttgtttgtgtacttatgagaaatatctcagttttgctgagatttttcttctcaaggttcatttttgctaaagctttcttagataaccttagtgtacttggaatgcatgtatttttttccccaaacttaagcctggagaatttctttctcaaaaatttctgaaacttgttttctaagtgcatagcatagatcagaagcagacgaaatatgtaggcttatgtatgttcatggtgaggtacactgtatgtacctgtcttcggaaaaacatttacatttaaacctcactacagagaacacccctcagaattagtgacacatctgctttgtgcagtgtttttatgacatatttctccaaagcctgaggtggtaggtgtctgcatttttttaacgaataggactattcatatgtgtttaatgtcagttactacagtcccccagcactggttatttaagtgcattttattttctcctgctagtcagtatgttccttgaggacaaggattctgtctcattaatcttgggtccccacagcttctctagaatctagcataatgcataggaactgctcagttaacactaaatgaatgaatctttagggagacgcagcgttttgtttttgtttttcctttttttttgagatagtctgactgtgtcacccaggccgtagtgcagtggtgcaatctcggctcactgcagcctctgcctcccagttcaaacgattctcatgcttcagcctcccaagtagctgggattacaggtgcgcaccaccacgcccggctaatttttgtatttttagtagagatggggtttcaccatgttggccaggctggtctcaaactcccaacctcaggtgatccacccacctcagcctcccaaagtgccaggattataggcattagccaccatggccagccagaaatgcagttttattacttataagtatagataagaacaaaagtgctttgcagttctcaagcatgtattccctgaaatgtcatctttctctattcattactgtcagccaatatttgcatctactattggttaaatatatatggtagatgagttagaaacagtctttgccggccgggcgcggtggctcatgcctgtaatcccagcactttggtaggctgaggcgggcagatcataaggtcaggagatcaatcaagatcatcctggctaacacagtgaaaccccttctctactaaaaatacaaaaaatcagtcgggcttggtggcccatgcctatagtcccagctactcaggaggctgaggcaggagaattgcttgaacccaggaggcagaggtagcagtaagccaagatcacgccactgcacttcagcctgggcgacagagcgagactctgtctcaaaaaaaaaaaaaaaaaaaagaaaagaaacagtctttgtcctaaaggagtttacagtctggtgaagacagtaaatgaatgttcagatactgtaatctaaagtagagtaaggtgagaatcaaaggaaagatacaaagtaaattccttaagtacttacaggatggagagattcatcagctctaggtcatcaagaaagtcttcctggaagaggtcatctttgaaatgaggctgggcgcggtgattcacacctgtaatcctagcactttgggaggctgaggcaagcagattgcttgagcccaggagttcgagatcagcctgagcaacatagcaagacctcatctctataaaaaataaataaatacagacaaatgagccttgacatgtttagagtgggtgaacataaggaatgaagatgtaaaagtttgtggtgtgttcaggaaacagtataattaagatgtgtggcaagaagcacctgaacagatagactaagtattgtcaaaggctttgaatgacaaggtgaagagtttattcttacttgtagatactggggagccattaactatttttgagcagggatgttattatgtgatggtatctgtgccttaagttaaattggcagcagccttttatatggcagattctttgagaggagagataaaatcagggaaactaatttggaaactgatggagtaacccaggcaagaagtaacaaggactacgaccaagttggaagcagtgggttggaatgaaatgcgtaacttcagactagaggtaggctctatatggccttgtaactgctcagatgcagaagctgggaaaggatgatttgaatgctggaattcctgaaccaataaggctgctgctagtagaaaaacaggggccccaagggagctgattttgaggggaagatgataattttggttccggatgctttgagtcatcatgatttcctgatggagataattagcaggtattcggtattgcaaatctttgatttgggagggaagtttaagtttaagagatttagaagctatgtgtgtgactatgttgtgggtactgatgagatccctaaaacagaaggggaacagttttagtaggaaccaaagtgttaaagccacagttcctcatcacctaggaaatttttctaaaatgcacattccttggctccacctccagatattcaacaggtccggatgggacccaggaatctgcatttttatcaagccccacagaagaccaggataccaacaatcttgagtcttactttgagaaacattgattgaaggacagagtgctatactaacatccttcctcttgctgttcttatttgagacgcctctcccaacaatattactagtattttaaattgaatgaaatgttttactttcataaagagtatgatatgccattggttttttttttttttttttgaggtggagtcttgctctgttgcccaggctggagtgcagtggcatgatctcggctcactgcaacctctgcctcccagattcaagtgattattctgcctcagcctccctggtagctgggattgcaggcacatgccaccacgcccagctaatttttgtatttttagtagagacagggtttaccatgttggccaggctggtctcgaactcctgacctcaagtgatccgcctgcctcagcctctcaaagtgctgggatgtgagccactgcacccggccaatatgccattgattttgttggaaattggcaaattgtttggagtattcattgagtcccatagagttgtttgcttttaataaatatgttctgtgaactcaatttctcaagaagattggtctaacctatacttttaacagcaataaaagtgatttataattagtataatataactttggaagtagaaccctgaattcattcagcctttaatatgtttctatgatgataggccctgggagaagttagtttatggtgaattttaacctacttgtgtaatctgatttctgctcttatgttcaaatggaaagcaagatacttttgccttgaagctaacaatttgctaatttgcttcagttaagagtctttttgtgttttggtatgtggattgggggagggagcaccagcatttcaagcaaatcttatttctatcctaaagacactggtaaaaatgtcccctgagtagtttcttgggttctctttttttaaatttttttgagacagggtcttgctctgtgcccaggctggagtgcagtggcatgatcacagctcaccacagcttcaacctcccaggctcaagcaatattcctgcctcactcagcctcccaaggcctaggaccataggtgcaagccaccacacccagcttattttattttatttttttagtagagacatgatctcactatgttgccccatctagtctcgaattcctgggctcaagtgatcctcctgccccggcctcccaaagtgctggtattacaggcatgggtcactgtgcccagcttcttgcgttcttatagagtagaggtttaaggaaaaacttagaaaagatgcttatatatttgagagaatttgggggcttttgtggaaaccttcagtctaatgctggtaacttttgaactttaaaatatttttatttgtaagtttgtacttccttccctgcaaaccaccccccccaccctatgatcttataagaattaacattgagactatgtagttacagtagtccagtgatgagaaaaaagttaactgcaattgaaacctcctgaaacttttttcctcactaacattagttgttttaagcagtagtcaaattatcagtaatactgttcattgcttatggtcagtgtaaaacattttgtagttagtatgaggagtgtgataaactcctatgcaatggtaaaatcattctaaaacacagtttgttaaaagtcagaatattttcatgtgacataacatctattgctactttggctaggcatgtggaatgttatagaaaaatccattaaaatattatttttggcttaaaaagttattgatgtgaattttataaaacatatattccttttcagaataagatgaaatcattggcttccaaaggagtaccaaatgtaatttcagaagatacattaaaaggtcaggattccttgtcaacagatacaggacagtcccgtcaaccagaggaactatctggtgctactggaatggagcaaacagaattggaagatgagcctcctcatcagatggatcacctgtccacaagcttggataacctcagtgtcacctcactgccagaggcctcggttgtttgtccaaatcaggattacaatttagtgaattctttgttaaatcttactagaagtcctgtgagttatggtccttactttttcccccctaacattatttcaataatgtgtatttatttatttttttaattttaatttttaatttatttttttttttgagatggagtcttgctgtgttgtccaggctggagtacagtggtgcgatcttggctcactgcaacctccgcctctgggttcaagcgattctcctgcctcagcctccctagtagctgggattacaggtgcacgccaccacgccagctaatttttgtatttttagtagagatggggtttcaccatgttgaccaggctggtctcaaactcctgacctcagctgatccacccgccttggcctcccaaaatgctgggattacaggtgtgaagctccacagttggccaataatatgcatttaaaatagacaaaaatctatttttcttttagtgtgaaacattaaatccttttatgttgaatgttttcaaacaacctgatgtatatacaattcaagaattgaagggggatttttttttcctttaggatggcagaatagctgtgaaggcatgtgaaggcttgatgctgttagtaagtttgccagagcctgcggctgcaaagtgccttacacagagcacttgcttgtgtgaactactgacagacagacttgcctccctgtacaaggccctacctcagtcagtggatccgttagatattgaaaccgtggaagcaattaactgggggtaagcaccgttacttgtattttcccataaaggtgacttcttaacacctacattttaaaatccatttctattttgcaatggtagaagtctttgaaaaattgaacaccactagtgatcattaaatgggaatattttcttgaagcttgtattaatcagtggtaatgaattggtgtgggaacaatccagctgttacatagttaagatatttttattttgtccattttactgatcaatttttaagggcttacattaaaatcaataattttaactgattattaaaaacaaaaaaccctcaaagaaggaatctccttttaaaataatttccacagcctctagagcagtctaatctgtctcctggcctgtttgtacagaatctcttctacctcattctttcacctcttcttcctaccttttagactccccaacttgattatcatagggaaatatgattattgcagaacgtttataaattattaaaaagtataaagcagcataaacaagttgcccatagtcccaccacctgtaagcagcctaaggttttgacataatcaccttttattgtatttctctgtatttttaacgtgtctttcttttttccactctattttctgtcaacatctatagggcagacccacttgttaacattatgactgtattgcattttagggcaggaagagaagtagtccactcgctatttctgtttgtagatccccatttaccgttcttttcttccatcccagcagctgagaacctccatcttttcgttgatgttacttggtaacatttagggcaggagtatgaggagctatcccagtgttttttctcctgcagctccactgtttttttgtttgtttgttttttctttgagacggagtcttgctccgtcgcccaggctggagtgcagtgaagcaatcttggcttaccgcaacctccgtctcccaggttcaagtgattcccgtgcctcagcttcccaagtagctgggattacaggcatgagccaccatgcccagctaatttttttttttttttttgtatttttagtagagagagagagagagtttcatcatattggccaggctggtctcgaactcctgacctcaagtgatccacccacccacgcacgttggcctcccaaagtgctggtattacaggcatgagccaccacacctggcctcctgcagttccattctgctttaacctctcttctcctacttaatacgtgaaaattatttacagctcttatttaaaagattttctcttatctttggtttcttttacagaatcctcttctcactgtcctccagcatttcctgtgtgaatgtaccatactatctgagtgtgttcatgtgccttcatttttccatacattctgaatagggtccatgcttttggataactttggacttagcaattcttccttgtcttacagcttggactcatatagtcataaagaagatgcttcagcatttccaggaaaacgagccttaatttcatttctttcctggtttgattattgtgatcagctcattaaggaagcccaaaaggtttgtaattttttattgttttttgatcattttaagatataaatatctattaagtgaaattggaatccctaatttatatcccaaatacattttaattgtcttagaataccatggttagtaaaataagtaaacaaaaaagtgtatatgtgtttgtatgtgtgtattacaattccagaataaatcaaagttcaagttctgcccttttatatttccttaaatattatggtacagtactttacaaagtaacactgatttcccttcagtcctgctctttggtgagatgttaatactatatggacattggaataatttttcatcctattcctcttattcttggaaatttagaaaaaagtgtaaatgacccagtagccaacatctaatctagatttatatgccaccaataagagggtcattaggcaagttttgtctttccacattaattcagttgggagtccaaactgatttattgatgttacaaattagtctttcttttatattaaaaaaaaaaatgatgttcctactatattctagactgctgctgttgctcttgccaaagctgttcatgaaagatttttcattggtgttatggaacctcaattaatgcaaacgtgagtagcctgttttcttttgaaaaaaaccgcatcactgtgtcatgttatttttgcccactgactacctgttcattgtgctcagttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgaggtaagctacgtaatgatttagaattggacttagattctttgaaatacggttttaatgtattatacttcagatattttcaatacaacctcttttattggctttagaaattgaaagcatgactcacaagatggtaagaagagtaacttatgtaaagacatttttcagttagcttttatcaattttggtttcagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtgtaagtttccatccaactccgtgagttcagcatttcatgtagagatagaactttctctctcctcttatctacctcccttatcctcaaaagaaatacctcttacagtttaaaagttcttaaaagtaaaattagatgcattgatactaccatccttttacattacaaataatattgtgtattcattagacccaataacaaaatagtatagaatgttaatttgcctagaaaatatacataattccttaatcctttatattagcaaaattatgtaacattttctaagaacatagcagagaatcttttggtttagaaaatgtcataataaaatagtgctttttatgtgtcattaaatttaacttagagatctggaagaagatccattatttactgacatttcaccagaaaacactttgccaaaccaagagtggcttagttcttcacctcctgctactccagaccaccccaaaaatgatggaaaaactgaagttcataaaattgtaaataggtgagttgctatataaaatttgacttccatctctcttgttttttgtttttgtttattagtattattattttttgagatggagtcttgctctgttgcccacgctggagtgcagtggcacgatctctgctcactgcaacctccgcctcctgggtttaagcgattctcctgccccagcctcccaagtagctgggattacaggctcctgccacgtcacccagctaatttttgtattttcagtagagacagggtctcaccatgttggttaggctggtctcaaactcctgacctcaagtgatcggcccgcctcggcctcccaaagtgtataacatgtaagagctctgctcttaggtggttacagaaatctcttatgaacttgatcttctttaaagattatgtcagttttttggtcttgcttatgtaacaagtgccaggctgcgggcaacacttgatactaagagaaaagctctacttaatattaactgtggttaaatgaaccctcaaagttccctcccccaccttttttttttttttgagacagagtctcactgtgtcgcccaggctggagtgcagtggcatgatccctgctcactgcaacttccgtctcccgggttcaagcgattctcctgcctcaggctcctgagtagctgggattacagtcgcatggctactacgacttgacctcccagagtgctgggattacaggcatgagccaccatgctgagtcatcccatttttaaaaaatataaatggtttaattttaagtaattcccaattgtaacaacattgagaattgctggtttgataagatgtacttattaaacatgtgtgctaagtgttgggctattcctttttgttagttcgtggttttatgtttttttaaaagtgcccttttctgtggcaattttttttctctcttttgcttcccttgcagtgttgtcactgatatacctggttctggcaggtgattttagagaaaaattgcatgtggctcaagatgcaaaattagggtacataaaaatctcaagttcaattacttaaaaccagtttcctgagattaacaaatatcatggcagtctgtcattatacagcaatctgaagaggaaaaaaatgtctttcttaggcttacttctattttaagtggaattagtcatttttaaaacctttaaaataatgagaatatttaatcaatgaattgtaaaacttatcaggaattaacaacatataatttcatttctcgggtttccatttgtattaatacttagctgaacttacgatatcactagatgctttagtacttataaagttattattgaattatgagagtattgattatggtctttttcacttctactttttccttttttttttcatgcaaatggacatcttgcataattgtggccgttttcatttaagttttctctgtctggtaccggatgacgcaaaatcctcctaccatgttgagggcacaggatatgacacttacctccgagacgctcataggcaggtaggtgaagtcactaaatgttggaaatgaaatctaagaatagacacatgcacaccccttgtcacactgcccaccaccactgctccaaggaaatgacttcattcttattaaaaatgagacctgggccgggtgcagtgtctcacacctgtaatcccagcactttgggaggccgaagcggatggatcacttgaggtcaggagttcgagaccagcctggccaacatggtgaaaccccgtctctactaaaatacaaaaattagccaggcatggtgacaggcgcctgtagtcccagctactcaggaggctgaggcaggagaatcgcttgaacctgggaggtggaggttgcagtgagccaagatcgtgcctgggcaagagagcaagactccatctcaaaaaaaaaaaaaaaaaaaaaaaaaaagacctggtctctgctataactacttttgctttgtgcaagtgactttagtttgcacttcaccgattgtgtgtctccatctcaagatttctttgtgctctttaattttttcccactttaaattatatctcacccggatccatttctcctactgatccaaaacatgataccttaataattctacccaccatgcacccttgatcctcatacacaagccattatccttttctccttcattctgatgcagacagtgattcacaagtatagtccctctgctgcccagctctcactccttcagccccggaatttcacctttctacctcactcaaacgacttgctcaaaggtttgcttctaaattaaggagacttttctcattcttctttcctctttatagcattttacatcgtaagattttaaaaattgtattaaaaattcctcctgcaaagaaaacttgtattgagataaaattcaacgttttaactattttaaagtgtacaatttaatgttttttagtatattcacaatgttatgcaaccatcatcactatctaatgccagaagattgctatcaccccagaaagaaacccggtacaaataaagcagtcacttcatattgacttctcctccccgccaacccccagccctggcagccgctcatctactttttgtctctatgactttgccttttcttgacatttcacaaaaatggaatcatactatatgtgaccttttctgtctggcattttttactcagtgtaaggtcatgttttcaagtttcattcaagttgaagcatgcatcagtacttccttttctttatggctgaataatattttattgtacggatattttgtgtatctgtcagttaatggacatttgggttgtttctaattgttgattattatgaatacttatgctgtgaatattccttttttgttgaatacgggttttccgttttcttgggtatatgcttagtagtaaaattgatgggtcacgtggtaattctatatttaacttttttgaggaactgccaaactgtttttcacagtggtggcaccattttacatcacaccagcagtgtataagggttccaagttcaccatttccttgccaatacttaccattattctttttaaattttagctaccccaggaggtgtgaagtggtgtctcctagtggttttgatttacatttccttatgactaatgatgttgagtaccttttcatatgcttagcagatacttgtactcttctctgaagaatatttaaatcccggccaagtgtggtgtctcacacctgtaaccccagcactttgggaggccaaggtggaaggatcacttgaagccagaaatttgagaccaggcttcacaatcccatttttacaaaaattttttaaaaaaattatccgtgtgtggtggcatgcacctgtagttccagctattggggaagctgaggcaggaggactgcttgagctcagaagtttaaggctacagtgagctatgatggtgacactgcactccagcctgggcaacagagcaagaccctgtctccaaaaaataaaaaaaattcctttgcctgtgttttaattgggctatttgtctttttattgttgagttgtaagagtcccttacatattctgcatagtagatccttatcagatacattatttacaaacattttctcccatctgggagttgccttttcactttcttgatagtgtccttcaacacacaaaagttcttaattttgtttttttgtttgtttgtttgttgttgttgtttggagacagagtcgcgctctgtcatccaggcgggaatgcagtggcatgatctcggctcactgcaacctccgcctcctgggttcaagcaatcctcctgcctcagcctcccgagtagctgggattacaggcttgtgccaccatgccaaactaatttttgtatttttagtagagatggagtttcaccctgttgcctaggctgatcttgaactcctggcctcaagtgatctgcccaccttggcctctcaaagtgctgggattacagttatgagccactgcacctggccaaaagtttttaattttgataaagtgcaacttaactattttttcttcatgctttttgtgccgtacctaagaaatcattgcctaaccaagattacatagattttcacctaagtctctttctaagagtttcatagttttagtttatccatttaggtctttaatctgttttgagttaattattgtatatagtgtgaggtggggtccagattcattttttttacatgtagacatccagttgtctctgcagcacttagtgaaaagggtattttccgtgtattgactttaagtgtaaagtttatttgaggactctcaattctattccactgacctatgtacctgtccttatcccagcaccaccctgtctcggttactgcagctttgcagtaagttttgaaattgagaaatatgaatccttcaacttgcttctttctcaaaattgttttggctatttggagtcccttgtaattccatatgaattttaggattactttgtccatttctgcaaaaaaaaaaaaaaaaaaaaaagcaattgaaatttttgtaaggcttacattgaatttgtagattgattggagaagtacagccatcctaacaatattaagttttccaattcatgaacaccggatgtttttccatttactcaggttctttttagtgttattcaacagaatttcatagttttcagtgtacaagtcttgcacttccttcattaaatctattcctaagtattttattctttattgtaagtgaaattattttgtgaacttcattttctgattgttctttccaaatgtagaaatactgctggttttgtgtattgagcgtctatcctgtaacttcgctgaactcgtttaaaccacctcccaccccccaccccagccctgccatttcaaactttctcctttcttaaggcttctgcagcatcattctttgctgctgctgcttttaggtgtcaggtgtcatttttactctgtccaccatattatgatgtggccaaaaaaccaaaaatatctatcaatggccctcttttctatcttcattcctttgatattcttttggtttaacattcattctgtcatgaattctctatctgaggtgtccccaaagctctagcctcagccacttaggtgttcttctaagacctcagactttatctttccaaagcagaacttatgattgatgcctttaaaactgcatctgctcctttgtttcctgctgtggtcagtggcatatccatcctcctggtcattcaaggtttgtatttcagagttgcctgggattcattcatcttctattctccttagcctctagtgtattgccaagttgtatcagttttgcccctactatatctctcctgtctgccccttctccatttttgctttttgctttcagaatcctagtttacatctttattacctctgccagattacagtagcctcataacttgtttcctcagcttgttccttctgcttagaagccattaacagattaatctcattgaagtgtggatctgagaaccccttctttattaactcataaagtataaatacttagacatcaaatcttagaattcaagatcctttcggatcaattttccagcctgcttttctatatttcttactatgactttcacttgctatccaaatataacatttacgtgcatttattgatgctattctgtttgcctacaaggttctcctcttatttctcacccaccatctgatatctatatttctacactgtcttcaacatccagattaaatgccagctcgtgatttattctttttaccctcttcctcctctcccttcccaacagtaaaggtaactactcgtcttcatgctcatggcattgtctctaatcttttgtggtcctttgtgttttctttcttgccttggggttataaggtaatagtcagtctcttgaggataggattcatgcttgatttaccattaaatccctcaaaatatgtagcttagagctttatacattttacaatatcagtaactatttagtatttgttgaataaataaccagaataaaatatttcaaaatttgaaagagaattttaaaatttacatagtctaaattttaaaaattctcaaatctgaaaaatgtacatttaatttgtatttaaattctttgtattgaagtatcctattatatataactaatctgcatatgcacatagttaattcataatactttaagtccacattagtacatgaatttgtctgcattaatacatgaataaattaatggagtagcaagtaacattcaaataacaataaagtaaagacaataaaagtaaaatatatcttttggcagtaccgattggatttttaaactgcttttattctttctgtaaagtttcatttccattttgtgattacaaatgcagttacaattgtttcagaaatattagaaaaaccaaaagctataagaaattataagtcagaatataagaagtgttaatgtaaaaatgatttcttaaaaattgagatttgggccaggcgcggtggctcatgcctgtaatcctagcactttgggaggccgaggcgggcagatcacttgaggtcaggagctggagaccagcctggccaacatggtgaaaccccatctctactaaaaatacaaaaattagctggacctggtggctcatgccactgcacccgaccattttctgttttaatttcaggtaatttctaaactagagaagtcaaagtaattttgctttattaaataaggagaatctgaagagggaaggaatatagaagaaaacagtgctttaaatttcttttgtttcaattcaagtaaattacatattgggggagacttttaaaattcatttttattatatgaaataatcttgtgcttataaatattcacactgtttcactgataactatctgtagtgaaagaccagggtttttttttttttttttatttccaatctgtcacagaccaacacttttgtaaaatgcaataaaaatgaattcctggccaggtgtggtggctcatgcctgtaatcccagcactttgggaggccaaagcaggcagatcacgtgaggtcaggaattcgagaccagcctgaccaacacggagaaaccccatctctactaaaaatacaaaattaaccaggcgtggtggcacatgcctgtaattccagctacttgggaggctgaggcaggagaatcgcttgaacctgggaggcggaggttgtggtgagccgagattgtgccattgcactccatcctgggcaacaagagcaaaactccatctcaaaaaaaaaaagaattcctattgtagaaaaatgaagagaaaaaaagacacaaaatacaaaccctgattatttcatagttagattcaacagacataaaactcttcatagtcaaattgttaggaacgtttttaagtgcttgctcttgctttttgtcctcatctcattgtggacggtagtgaacactttgaggaccagcactggtcgatggaccacctttgagtagcactgtttgatcctatcataacatcatgcctagtgtgctagtttgcatccattctaggaatggcaggcttgtcttctcaaataacatgtatcagttcatctgtggtatataccattttagaataaatttgaaaacttggctaggtctgactttgctttttaaatgtcctctaaatcggtgatgaaagtaactaaagagttaaattcctttaaaggaaagagctgttaggggtattttagtaaagttaaaatatgtctctttttcatcagcttatattggtagcagcagttaatataatcttacctgtgcccctagtcacagaaagatctgagtcatctcttccccctctcccttggcacctgaagcatagcagacattctgcattcaaatggttttttatatgcctatttaatgaaatcatttctatttcatcttaatttgtttttgttctttaatgattcacatgcttttttccccctagttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcaggtaatacattttaaaatactaattttcatatttttttttgccattcaccacagaatcatctcaagtcttagtagatcttcaataaagtacttttattgttttcttactttttccactggatgactttttcatgaagcttgattgccaacaactggcagatttctgatgcattctgtatgttaaaaacatttatttggcctgacagctgcttgtttattttacttctcatgataggccattgtcttaatatccttaacacattttggagatgattaggactgcttttcttttatgacttgcttagccttttagttagtacatttagtacaaatacagatgctcaatttggaagaccttaaatgtcatttcagattgaatcttgaacactggtctcagtaaaatcacagaatagtgttagatgaacctggctctttagacaaagcttgtaaacgatactcattttcataagggagaggtgaaatagaaaaggttaatgtactcctttaaaggtggataaaaatcaccatcagctgataagttgctatgtacatctcatctgactgttaggagaaataaatttgggattatggaatccctccttccatctctcattggctcataagcttagtgatgagagagctttgaaatgcttgactcattagaatctaaacctgaaagaacacaactagcatagtactttcctcagtgtggaaactgagtggaccaatttggaattaattttcaactgtatgttaaagtacgtgttctttttttagcattttagttaaatatttatgtgagcatagggagttgtaaaagaaatttactaagtaggctgtcttcagtaactagaaagtcaaataaagaaattgtaatctaagaagtatttcactatgttagagtttagtcagcgttgtttctgacggtaatctctataagagaccaggtccttttttttttcttttttaacctcttaatagcattcgctgtatttctagtgttgcttggttggtcgttttaaacctgacaaccaaagtataaaaatctggctattaataggtattgtggcctcacctcatggctgtgtaaacctcctgggtagccaggatgcatcagtttattgtggtttgttttttgtttttgtttttgagccagtttgctaggcgtagtttaaatcaagcttgttgcttgattaagctaacaagcaagaggtaataacaatgagtatcaagacagtaatgtttaggaattttgaccgaaagtactaaaaaggaatctaaattttaaaaagtagtttctgaattgaaagatctaccctgaatcttcaaccttgagcactttttctctagtttgtggagtgctggcacaaaaggatacattgaaaacagaatatctgaaatacttaaaatacttttcaatttcaccagatagcacttcatagcacagcgctgattcatagactgtttcagtcattcttcctgtaaccgtgtatcataggcaagagagatttctagtattattttacaaatgaggaatctttggtttcagttatgtgacttacagctggtaagctatggagccccgtctgaaaccttttatctttaaaactcttgagccgggtgcaactgtagtcccagctactcaggagtctgaggcaggaggattgcttgaccccaggagttcaaggctgtagggcgctatgattgtgcctaaggatagccactgcacactagcctaggcaacatagtgagaccccgtctctaaaacaaaattaaaacacaaacaaaaaaaaaacccttgattttcaaagccttttgggtaagaacgtggtatagtctgatctcagagataaaacacaagtcctagaaagctaagcatttttggcctagttttactttctttcctaaacatttttgccggaagtgatacttgcttgtagtttcttttttttctttctctccctatttcttcttcttttttttttttctgagaccgagtctcgctctgtcacccaggctggaatgcagtggtgtgatcttggctcattgcaacctctccctcccggctcaagcgattctcccgtctcagcgtcctgagtagctgggatcacaggtgcacaccaccacgcctggcaaatttttgtatttttaatagagatggggtttcaccatattgctcaggctggtcttgaactcctgacctcaggtgatccacctgcctcggcctcccaaagtcctgggattacaggcatgaaccaccacgcctggccttcttctttcttcttttttctttttcttttgtttttctctttgcagggcattttcttagtatagattcctaatagggtctaggtaacttgactgagattaaaaatttaatatgaatagtttggcaagtggctaatgtcttcatgcataattgagaacttacagtatcaagtattcataacactattgtgttatcacaatgctaatttgaaaaaattcataatacaaacatttactattgtttgtaacggtggtgattttaaaaagatagtaaaatactaaagcccatagcagaatgtaaagaacactgggaacattgtaaggaggccaaatcttgtccctgccctgagcatgatgagtttgaatttgatcaagtaacttagctacttgtcacattttctaattgttaaagtgaagttgatattacttttttaagtcaaagtttattatctcaaaatttgagttcagtccaaaaacatgggccaagtccatttgtcatgtcagagaaatctggcttgctttcctttcaggtaaatactgtataaagtataaaataaagggacctcaagtaatagatataaacacttaactaccaacaacttccaaaaaggctagcttgttttaaagttattaccaataggaagtagagaccatttcagagtacagtgaaacaagtttatcttgttgaaatttattttcatttttactacgttgagaaataatctgtgtcagccttaaatttcttaagcaacctatgacctacatttatgttaaaataaactacaaaccaaggtaacaccacacagagaaaatacaaagtctaaatagtaatgtatttgtttaaagccaaattgtactgatttatttatttaagcacctgcagatggcgaaatttagtgacctaaaaatcttaactacctgcagtgaagagtcatgtacaattctggacttaagttgtattttaaattttttctactttttttttttttttactaaatgcattcttttaaattattttttgtaaatgattccttcatacctaaaatacaatttaatgtgaattcattgtttattatgagttgagtctcagagaaggctattctgttgcaaatattatcaagggaggaggaatggagagaagttggttaatgagtccaaaagtacagttagaagaaataagttctagtattcagtagtacagtagggaaattagttaacaaaaacgtattgtatatttcaaaggagctagaagagaactgtgatgttcccaacacgaagaaaagataaatgctggaggtgatggatgtcccagttaccctaatttggtcattacacattacacattgtgaaatgtatcaaaatatcacatggaccccccccaaaataggtacaattatgctatatcaataaaaaatacccaaagcccccaagtattaccaagtaggagaatttactcttaaactatcctttactgggaatacatatttcctttcaattaccttgcttacagctaggttttgaaaaaaaataataaatgacttggagcagtttttaattctttaaaaaaatccatgttcatgaatctagtagtaagttagaaagactaaaatgggccttacagcataggacttgagagtttctgtttatgtaacaaaacatgttcatcgtagcgtctgtagctgtggtgattttcaaaagatagtaaaatgccgaagtctgtagcagaactggcgtgtgcccgagcattctccactgaatgccagagattgacttcctcattgctattcactgtgatcaaggctttgcaggttgttcagtggctgagagtgaaacattccgctgtgctggctgatgttgcacttggtcctgactccctcttccctccactgtgctgcagtgtctgtctcactcttgccacctgggttctctgcagcctcctcactgtagttagttttgttgcaaccaatccgtttcctttggctgcttagaagaagcaaactggaaggggtgagaagtttctattgaaagttctgagcaagtagtagcaactccttgtgtagtgtgccttttgctttgttgacatgactctgtaaagcccctttctgtgaagaataaacagacaattagaattcaagtaaaatcacgatattacatgtaaaacaagtgtgaggaactgtacacagatatacagttgtttggagaaagttaatactcatgcaagaaatgagatgatccctctctgtaatcaccattttgaaccttctcatccactttgaggcatagggtcgtcatcagttctatccccaagtactttcatttcattctggtgacaaggttctgtgattcgactttattttactgtatgtgtttttgggaattggcagtagttgaataatctgaggtgaggaatatcacttctaaaattactatatttaaaaaggtgtaatatcttcccatcttgttttttggtcttatgctcaatgggtcctctgtaattaatattatatatgacacactggtgcttttttatgaccccttgaacaatttcattaattgaatcaacctgcataaaataaacattctgactctgtcacatatttgtctttatatgtttatatattttttaaatctttaaagttttaggcctgcaatatatgtaatttgagatgatgagagctagtttagttgtagatattttcattgcagaagagcatgcgcagcagggaggaagatggtggattctgctttctttttttttgtttgagacagagtttcgctcttgttgcccaggctggagtgcagtggcgtgatctcggcccactgcaacctccacctcctgggttcaagcagttctcttgcctcagcctcccaagtagctgggattacaggcatgtgccaccacaccgggctaattttgtattttgagtagagacggggtttctccatgttggtcaggctggtctcgaactcccaacctcaggtgatccgcccgcctcagcctcccaaagtactgggattacaggtgtgagccactgggcctggccagattctcctttcttaaaagaacaaattgaaatagtaaattaagcacaccggtatacattatttttaaatgtctttctgttttttatctctccatagccatatgatgtaaacttacaagtaacctcagtgttatctagactttctctcttccctcatccacacatccacgagtaccttttggatccttacgtgaacctcgctcctggctgtagatctctcttctctgtaattgtcagggtgagttactagttctgttatattccctaggattgataaatctgtgcaattaatatgttaatatcattgtatgcagttagtgtcacataatgaaaaatatatctactgcttaaaagtaattattatacattctgaactactattttttcaattattttaaataatatgtaacttttattttaaagaattaggtatgagtccttggttaaagatgattatatgagtagtgaaagtttacgttctttattaaatagtagggaaggaagatttttctttttagatcctgaggttgtctgtgtagctgatttcaggaactgaagtgccttgcctctgtgatgcaggttgttggagaccttatgcttcgaatccagcgtattcaagactttactcccaagcttctgttagtcagaaagcggttacttggtttggaacctgaaggccctatgtaagttagtgttttacatttttttaatccaaaaatttcagtgaacttaatgatcggctgctatcttgaattgatttattgtctgttttttccttaccagtattgaccacatcacactgctagagggtgtgattgtgttagaagagttctgtaaggagctggcggcaatcgcatttgtaaaatatcatgcttcctccacaccataaataacatctttcatgtaactgggggaacagaactactgtgtacatttcaccaaaaaagactcagttccacccagccacaagaggataaaaagcctttttaaacgcagtattgctgtaaactggacagaaccattaagaacctattgagtggacattcttggtgaaatgttgtataatgttgttttcattggctttatcataatggttctatatatacaattgcacattgttgaatccaggatacaatcaaaggaacttcaggaaataagcatttctaatgactgtgaaaagctgcaatatttccaatgtcatgactttgatgatatttctgttatattaatgtccttttaggtagcaaggcattttgacattctctgggactcaaatgcttgtattcttttggattaataagtagcaaaaaaaaatcactaattttataactttttaaggtcagaattcttatcaaacaaaatatgaaaactgtaaatgagaaaaaaatacaattcagaaaccattgaatgaattaattataggcgataaaaatgtgtagagcaccattaactttcttcagcttttttaagaataacaatttaatatgataaattcttgattaatataatatatctatatttttaaagaaatgttcttttactcttttgtgcacatagccatgttagtgattttcttcatgtgtgggtcccagtttatttaaactgtgtcgttttcgcagcagtgttcaatttgctcaccattggtagtgtttgctaaaattgtatttttttaagctaagtaacatgtactgggttgagaacctttttcccccctctccctctcagaaaattgctttataaaattgctttataatttgattttcttactgaaacgcatggtggtgtctaggtggggaactgactgataacccttggcagcaatcaaagtgccagtggctcctcgatgtttacatttttttctattttgttcagtcttttgttttaaatgattctaaagagattaaagaaaacagagttttaaatgtcctatttacatgttaaaggatttggggaaattgggtatgtatgtgaatgggtgtacatgtaggaacctgtagttcagcaaagctgcgctgggcacagcatgcttgtacttgattgacaaaatcgtgtttgccagtccactttctatttttcctttaagtgatgctgatcactcaaataatgcttttaagctattgtttgtttttatttgacatgttaagccgcagcactttcttcttcatctttccatttactgatatttgggggaacaggctatcaaaggttccggcttgaagggaactgtcactaccccctctaggaagttattttatgtagcatgtttgcatatacgcattgtgtggcatgtgcatagaggcttgttttacacctatctgctcattttgttgtgttagcttttctggtttatttcatagtttgttcttgctatttattaagaacagaatatcaaaagattatgaatagcctcagctctagaatgcttaccactgttaaaacaacaaaaagactaaacctctaatttcatgcaaatctttgttagcttattctaagaaatttattaagtaaaacaaagaaaaaacagaagtgggagatagttattttgtgcgtaattttctttaaatcattttgaatgatgtgaaggcattcagtttgctgtatttttttaatcacttcatacaaggaaaacttcgacatttacatttctagatgtagtaacagtctactttgatatatgagtatttaaactaaggcattaagagatattagatatttcttaatgttttcatagtgctcaataggtgtagtagcaatgatattacctctgaaaccaaatactcttttatccttgattccactatgggaccttataactagtccatgaaaccaagctcagaaaagctttaactcttatatttgtgtatatgtatgctgcttctgaaaatataatttttctaagttgttgtaatgactttaatttgtaatcagctaaggcttaagatttcatttgtttctaagtttctgtttttcatcccttcttttttcttttatatttagttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgtttgtgcaatatggaagctgtgagtggattcatagctttttggtttaattgtacattattgtgtgtgtatatatgtatatatgtatatatataaggaccaaaattcttagctcgcttacactgttgctagtgtaaacattgttacacttaattttacagggcacaaattatggaattacttcataaattcatggtaatgttttcataaattattgcattaacatacaattgccatttaattatgaagtccatcagtattgacagaagacgttacagtgaagtgctaaaaccacactatatggtaattatattttgggttatgtagtaaatcaaatatgcatgtcattgtgacactttatgtgttaaaacatggtagataatcacattttctgggccctgtaaaatagtgttactgtaatactctgttttgcctcctgccttgtttacattaaacaggatatttggtaaatttttttgtattgaaagttgtgtaggttactgacagtgttaccagcgtctggaattcttggtccctccgtggagaaactcttcagatggtcattgtgtacctactctctcttcaaaggaagttgtgatcaagttcaactttttgtgctaacaatgcatgcaggactaagagggatgatctaaaaaataaataatgtaatttaaacaaaacgtcttatgtttttgtaaaattctaattgggaacattttatccaatgataaatctcaaacaatttttaactttttgcacccccagcacacaaagggatatggcaccctacaatcagtgggtctctatagtattctagggagagaacaaaaagcaatgtatctatttgtggaggagagatgtgtagcttgaaaaattcccccaggaaaacctccacttcccttcttaataatcactgcccaaaaggaaggaatgtttatgcacgtctcaaaaacaatttttttttttttgaggcagagtctcgctctgttccccaggctggaatgcaatggcatgatctcagctcactgcaacctccgccccctgggttcaagtgattctcctgccccagcctcctgagtagctgggattacaggtgcctgccaccatgtctagctaatttttatatttttagtagagacggggttttaccatgttgatcaggctggtcttgaacctctgacctcaggtgatccacctgcctcggcctcccaaagtgctgggattacaggtgtgagccaccgcgcctggcccagaaaaacaatttattctaagcattatttcttagtatttttctaacatatataaaaacttttctttttagctgacacttaaaacaattagactctagacttaccctgttcacttgagtatttgccagaggttctgaattggaaacaaacatgtaatacacagcacagccagaaagagaaaaatccagtgattaatcccaactacccgaagattcttttcaaaatcactttagacggaaataaagatgataggttgaaaggatggaagaggcaaggtttagacattgaagagttgaaatcaccctccttgcccttcaaaagaagctacttcaaaagaaaactgtgttttgggaatgcataattggatccccagtccaaaacctgcttcaaactgttaagaatttagcagtgttttagctggaaaactagtaatcccaagggaatttaaagaattaacataaaactgtaaaagttgaagttttgctagagtaactctcaagtaaaatctatacctcttttcaaaaaaaaaaaaatagatataagcaagcagaaacactgcatgtgagtttgtttaatgctgaatgatgcagaagaaatggagtgttttatagttgttcttatggcaataaagttgtcacctagggactaccttgcagaaagtcagtttttctgtttgtttgttttttttaatttattttatgttccgggatacacatgcaggatgtgcagatttgttatataggtaaacgtgtgccatggtggtttgctgcacctatcaacccatcacccaggtattaagccccacatgcattagctatttttcctgatgctctccctccccaccccgcccccagcacaggccccagtgtgtgttgtttcccgccctatgtcattgttcagctcctacttataagtgagaacatacagtgtttggttttctgttcctgcgttagtttgctaagaataatggcctccagctctatccatgtccctgcaaaggacatgatctccttcctttttatgactgcatagtattccacggtgtatatacactacattttctttatccagtctatcattgatgggcatttgggttgattacagaaaatcagtttttaactttatttggtaatataccccactacccacctcagagagatccatctaagcctgtttcattcacactcactactcattgattggactattgtgggcattagaaatttctctgttatatcatttctaaaaatgtatcagaaataggacatccacaaaccaaacaagaattttgtttatttaacacatatttctcaagaactttctatgaaccaggtattaaggtgctaggaacacaaaaaaatgatttcggccctaaagaagtcagtcttggtgtggtgtttacaaaaataaattatagtgcacactggtgaacactgttagagaaacgagacccaaatggtgtgagccccagggaaaggaagtaagatggcaaatcatctaaacaggaagatctgaaactcaagccttgcctgaatattcttacttttaagtatgttatatatgtattattcttacttttgggttatagtcttacttttgagatatgccagatagtctcagaagttataaccagaacagacgccgggcgcggtagctcacgcctgtaatcctagcactttgggaggctgaggcaggcagattacttgaggtcaggagtttgagaccagtctggccaatatggtgaaactccatctctactaaaactacaaaacttagccaggcatggtggcacgtgcctgtaatcccagatgctctggaggctgaggcaggagaatcgcttgaactggggaggcggaggtttcagtgagcagagatcacgccactgcactccagtctgggcaacagagtgagactccatctcaaaaaaaaaaaaaaagaagttataatcacaacagagtcaacctagcaagaaacttctgcatcctattgtatttgccatgcttaactgtggcctttcacttcattctgatgttggtataaagcactagcccaaagaacagtgctttgggcccatattttctcagctgatgaatagcaattagcttgtgatttatgatctctttctaagactattgtatagtgagaaggcacatagtcaactgaaatactaaaaccaaaagattaaattggacttttaaaatgacccaaagattaggggtaagatttggttcagctaaagcatttgtagaaccatgcctttctccttacttttaactcagtactcttttgacagcgttctttattgtctcctggtttggggcacaaagcagcttgcatatccaattaagagagaaccaacctaggctgatggagatggtggagatgaattcagaagccacgtgccagatgtgcatggagagataggatgtgtagacctccactgggttatcatcccacaactcccccccattcctgaaatctaagcctggagtcaggctagaaggcaggtggacaggccagagctcactcctgccagggagcaagatcaagagacttctgctgccttcatacctagtcttcttgaggtggcttcaaggaattacctgatttcccaagtatgagtctaaggagttaaaattcagtgtgctttataattttttttttttttttttgagacagggtcttgctctgtcacccaggctggagtgcggtggcactatcagctcactgcagcctcaactcaagcaatcctgcctcagcctcctgagtagttgggattacaggcaggtgccaccatggccagctatttttatttttgtagagatacagtctcactatattgcccaggcttatgattttatatgatgaccttcctcttctctctagttcaggggtcccccaacccccgggccacagaccagtaccagtccgtggccggttgggaactgggctgcatagcaggaggtgagtggcaggcgaccacctgagctctgcctcctgtcagatcagcagcaacattcaattctcgtaggagcaccaaccctactgtgaacttgcatgcggggatctaggttgtacgctccttataaaaatctaactaatgcctggtggatctcaggtggaacagttgcatcccgaaatcatccccaagtctgtgcaaaaattgtttttcatgaaaccagtccctggtgccaaagaggttggggaccactgctctagttggactagtcaatatattgaggaactgacagggagtctttaaaaaaaagtggggggaatatatatatattttaaatattaggtaatactttagacttctcttgattgaagaaccacaaccttacatgaaggtaaaacccctagcagactgccagaaatctaaataccaccatgggtcactttgctcttatatcagaggggagagtaaggggaaagggaagatatcctttgaattttgtagctgtaagttcataatggtacccatgttgtgatgtgcattcatttgcatcgtgatcacactattaatttcttccaatgatgtgctaaagttgtccgggatggtattcagtttagaggatccaaacaagccaggaacatgacctgggtctgacagccactctttttcaaggctgagaactataatcataattgcaagctgaagagctagatgtggttcagaaaaaagaacaagagacacacccagcctgtgagattaggcaagacaagcaaaagcatctccaaggctgttattgcctcaggcctgtgatttatgagtaaggaatcataaaatcaattttactataatgcagaaagatgagatgacatacaaattcactatactctggataaagctatatttcaaatccctgaagatgagactcatttatataataacatgagaaatgtattccttattccactcacaagtagaatagcatgtagggttttaattgattagatttcccaagagagccatgtactggagatttctaggggagaaacaaattagccattccttaaacattatttttccatgtttaaagtatgctcttctacttaaatctctttatcctgttgctcttatcaacaatgtagcaagtcacagagcatttatggttctatattctttgtgggctgcttcaattctttgtcctgtgatctttatttccattttgttttagaaatgattagaaaatagaccatcattttcttaagctgcgttggtgttgggctcccacagaaatggaattgagaagaaaacacctacttttaaaataaaatattacctcattagtaatgtagcttggactccttgacaacaaacaggttccatttcataaagacttacattttccataaaatgatccaatgtcatgcagcttcaagtaagcctttctctgaaaatactgttggcaacagtacatatgactcattggaatttgggttcaaaaccacatcctaaaaataataaaagctataaatgcaaacgtgcatagcaatttctgggtgtttttctttggaatttgacattgaaataaaaataattttgcacagttcttaatggttggagtcttttcatgcatagcatataatataatttatattcattgagctgagtatttcaaagaaattagtcagaaattgctgatatacatcttgcgaagtagtgttgctcattatcattttcatttcaatggaaaggaaaagactagggaagtgtaattaatttgacatagataattctgggctgagcattttaatatcaacaccattttaaggccattattaaaatttctttgtcctcattgtacagcttgccattgctatactctgatataagaccattgtgttttggcccttcctccagtgatctgtgtaatcaatcattcaactaataccattaacttcttctaacagagatgctgactgtcaaccttattaggttaagaaagatgttggataggcgcaaatgctgagtttttctgctgattcctgtgttatatttaaagaccttgcttttatctacaaactcttcagaaatccttacatcaccatggaagctgatccctgcctcttaacaatgattttaaataaaatatatatatatatatcttttacaggagcagttaagctcccctcagtacctctattcatcaaaccactgacagtaagaggctactccacttacacaaaggcaggctctactctcttgacaggactttcctaaatgatcctgcttggagtgtaaaaaactttccagctagacacataaaacactgtaattgagtgctggtttcataaatgttgaggtctgaggtccaaaatgtattgtattgttgcaaggctacagtagtaacatcatccgtgatgttcaacagatattcactaaatcttgtagggctctgacgaggagaggggatttcaataaagtccctgtcttggaaaggtttgctttttaaagtacaagggataaggcaagttcagtggggcttactaagctcttgtccttctgttccaaatccactcctctatgtactgctttgtgttgctaggctaggacgctacaaactacatttctcctttgctaactggctttctattacatttggttaataagaggctccagagaaggggaacaggaggagaaagaagcaacttccttcctttgacgttattgttcctatctgtatcacctcagcaatgggtccatagcaattgattttagcctccacatatatatatatatacacatacatatacatacatataatttatttttaattgtatgtacaaatatatgtttttaaatatgtaatatatatactgttatatatatatattatatatatatacacacatatacacaaacacacacattttaaactgcgtctctgttgctatgttgcccaggctggagtgcagtggaacgatcatagcacactgcaaccttgaactcctgggctcaagcaatcttcctgcctcagtctctccagtagctgggactacaggatcatgccactgagcctggctaggctctgtattctttaaatcctcctagaaccagcctcctctggtctcaatgcagcaacagtagcatggcaggccccctctcagagaccagagttctacatttctagggccctggccctaagcttctagctctgcaaccccagcctcttccctttgttctgtcagccccagtggtagtagctgcctcctgggttattatttctggatgatctcagtgaataatccattttcctcactcagccttccaacattgatgtaaccaactcccatatgaaattccctctgcagaaacctctattacataattgctattttcctgactagacccatctcagtggcagcatcttccactgttaaccccaatctagcgaggggatccaccacagagctttccagggaggctggtacgcccctcattaatatatttcttagtacctcagagaagagattgtcacctgcaccccatcaggagatatggctgggtgttcatgcccccatgtaattttgcattcctatctccctaaatctatggattgttttttctacattaccccgggaagttctgtcatctcagctcactgaatgtaggccaccaataaatatattttattgactcaactaagaaaactgttagagccacttccagttggatgagctaacacagtaagtccagactctgataagtccgcccaagtccatacgttggcctgatttaatgttatattttatcttcctttgaaacttctcaaataatcctcagatttctgcctaaatcaattagcaagatgttgtcattcatttggaataaaagctaattcttcccaggtcagacttcactttttccccctggaccatgctgagatctgactctaattatagacctaaaagacaaaaacttccactgtcagagaggccttgggttcaaagcttcacaaggcagagaggccttgggttcaagattttcagctttattcccatctacccagatgtgatcattcaaaatcctagaggcccactcacccagtcaatgcgttttctcataagagtcagggaagtctatgagttcaatttacattgtaattttataacccacacaatttaattatggttcttttttgtatgagattggccctgtgactaaaaaaattacattattttagggctgccatagagcctctcactgctctgttttagacttgaatttagaagtttaaacctgagctagtgatttcctttctgtaatctctccagttggaagatgtcatcctactccaatgctttgtagtcataattactactgccattaggataatcaagggacagtgacagtttatgcctattgtccttttcattcttggtgtaaaagctatatggtcccacaaggcacttgattccataggcatttcatctcaatcaatcactggtgacaacttaatcactatgcctccaaatgcaatggagtactagcatagcaattcccattgaaaagatctcagcccagcatttaaaaccaagcaatgatcaaatcaacctccaaatccccatccctgagggtctatttcctggtaccaagcactgtaacaggcacagctcagtttggaaaacagaaaccacacaaggtacttcaacagaggaaatttatacagggaattgggtgttggggggtggaatagcaaaggaggaacattactgtaatacagggctaaaaatagcaggaagcagcaccacctctaaagctggaggattcaaaggaaaggagttgagatgatcagaacctagaaggttaggggatgggccctgcagggctggtgttcagacctctgaggagtggttgctattaggctttctgcagtgtctgcagctgttcttaagagtttccatatatttttgttgattttggcagttttgaggagtattggttgggtattttgtaggatgccctctattggaattagtctgatgttttcctcatgattagactgggattgtggatgttacagaggaggaatacagagataaagtgtgattttagtcatatcttatcaagagtacacactgtcagcatgatgttgggcttgatcccctggctgaaatagtatttgtcaagtttctccactgtaaagttattctttccctcccatttccatactgtattctcgggaagcaaagtcaccgtagatagctcacacttcagaagtgtagagttaatactgtatcttcttgagggtagagtatctgcaaaaaactgtttggaattattctgcaaggaagatttgtgtcccaaaccctttatttatccaatcatttatatcaatacaaactcatggatatttatcttatactttgggttataatctaatactatttcattggttttgttgctcaaattgttccagctttggcctttgggaacagtttcagttggttcctgtgtctctttaacatacccccatcaatatatgggtgttttgtttgtttctttttgttttttagtacttccttacttttggagattacaaaatactcccagctcatctcatatgtttcctgccccagtcctaggatcagccatttctccaagatacatcagagtcttttaaaacactgagttatttaggaatattcaggagggggaaaaaaaaaaacaaccctaagttctgtagcactgcattgacttggcatggtgctttgggtccagatagccgaggaaagggtattggactagacacgtggtatttataaagcctttcaacctaagcactctgaagacagggtagaggacatggatatgctaacaaaaccatccagaatgagtgactgagtgggaagcacagctgaacttgtttggagacaagagtgtctatgttagcagaagggaaactttcatagtcatcaatatcatacactttaacacagccacacaaaagatttctactttagatctttaattttttttcccaaaggaatcacatcctaacaggttaaagaagttattcaaaatacagctatacacctgtgccccattacttatagcacactaggaatgattactttttacaaatcctgtaattagctagtaactagcacaattatattgcattatctcttttgtgctaaaaatattaacttgctaatgatgagcatttacaaatgaactacaaattgtataacctattttagtattttttcgtttttctttttggagatggagtttcgctgttgttgcccaagctggagtgcagtggcacaatcttggctcagtgcaacctccgcctcccgggttcaagcgattcttctgtctctgcctcctgagcagctgggattacaggcgcgtgccaccatgccccgctaattttttgtgtttttagtagaaatggggtttcaccatgttagccaggctggtctcgaactcctgacctcaggagatccgcccgcctctgcctcccaaagttctgggattacaggcatgagccatcgcgcccggccggaattttttcattttaaaattactaggagactcaaaaagcagaggtgactcaggcctctctaggccacagaggcccttggatatagatttctcctttcttctgacagaagcggttagcttaaatctgtacagatgagaacacaattattgtaacacaggaaaacccacgttggttttgtacattcgtgtttgctctgtaaagggcagcgctcgtgcatcttcagctgtatcttgaaagctttcctgtttccgaagcttgcttgcattaaacatgaggcgccgctaagtgctgttgccaccagggactgcaggccgctctgcagccctggatgggctcagttccgagggaaggaaggcggccggcggaggcagtgctgtgctgcagaaggactgctgtgctgcggaaggactgctgtggattctgactgcagacgggtctgatttggatgttttttattacttaagcgattgatcgtttctccttgccatcctgtgaggagtgagggcatgccttggatctgtgagggaggagaaaaccccttttctaagaaaggggaagtgaagaaagaagaagcaaggatggtggagaagtaagaaaggaacatgggaccgggcgcagtggctcatgcctgtaatcccagcactttggcaggctggggaagggtggatcacctgaggtcaggagttcaagatcagcctagccaacatggtgaaaccctgtctctaaaaaaaaatacaaaagatagctgggcatgatggcgggtgcctgtattcccagctactcaggaggctgagacaggaggatggtgtgaacccaggagcggaggtttcagtgagccaagattgcgccattgcactcaagcctggcaattgagcgagactctgtcgaaagaaaaaaagaaagaaagagagagaaagaaagaaagagagagaaagaaagaaagaaagagaaagaaagaaagagaaaagagagagagaaagaaatagaaagaaaaagaacagaaagaaaggaaagaaggtaggaaggtaagagagaaagaaagaaagaaaaagaaagaaagaaagagaaagaaagaaaagaaagagagagaaagaaataaagaaagagaaagaaagaaagaaagaaagagaaagaaaaagaacagaaagaaaggaaagaaggtaggaaggtaagagagaaagaaagaaagaaaaagaaagagaaagaaagaaaaagaaagaaaagctctagaaggaagaaaggagcctgaggggaaagactgaggaggaagcagaagagacccggggcccccaccctcccgctcaccagcgctttgccttggtggctctgactcccccctgtctggtggctggtcatgcctcctctcccctctctaccttctcttccttcctacgttcccacctgactccaaccctttcctcagggagaacagaaggtccccaaggagcgctgtggaccaggcatgcaggtccacgtcatctctggtcctgctccgacctttggcactgagcctcctaatgcaggatttggcttgttcctgtgacagctccccctcatcgcccgcaacagggtactgcagtccagactccatcactgctcagctctggtgctttaggcaccccacatcacctccccgagcctcagtttccttatctgtaaaatggggatggtaccaactaccacagagggttgttgtaaggactgaacgagggcacaggcctccttccacacctgctaccaagtaggtactggatgcacggcaggccctgccactgcttctcagaaccctctcgggttcctaggcctcttgaaccacaattgataggaatgggacctgccgggagctttctggacaagcttcccagggggctcagatggactctcaagcattatttccagagatgagtctcttctcacctgccagctcctggggccagggctcagcacggccccctggtcctgtctactctggtgagacttcttctctgctgcccctccccacagtgcaccccactcgcctcagacttccgcccccgcacaagggaaggggctaaacggaatgttccaaatgttttgctatgaatttacactctccctccctcctaaaccctgtaactattgacatgtttatttattttttctgttaagttaccggaataattctagttgtgctcagccttcccagtattgagcaattctgcagcttttatctgcaactgttactcctgacagttaagaacacgtctgaagttttgttctgtttatgcctccaagcgtgttgccgacacatccgggcaaggacaaacgtacaacgaactcaagggagctttcacaggctggaacgggctcagagcacccctgttcttagaggaacaatcaatgggaagcaaaggtgtacccaggcctctcaacagttcccgagtgctgtcactggagggcgatgtctccaaacagtctctttccccactgggaacggcgccgcccgagggttcaggtcaagcacgagtttccaaattcattcaattagtagggcaactggaacccatgcagctccttcagaaatcccgcaaaatatggatacgctattaagctggagacaacaaaattactcaatatagaattttgcattcaatcaattatactgtcagtataattatataattataattatatataagtctcaatcctggctgaaggatcgaatcacctacaaaggattaaaaaccatagcggttcgggccccacaaaaggccagttaaatctggaatctggaagatggagcaggggaatttgtatatttttaaagctccccagtgattctattgttcagactacaaaattctaattgagacattggtggcaggcaccaagggaaaatttatgggagaaaattttaattttagacaattctatcatgttttctcctgcaaactggtagaactgcttagcctagttctgcaaaggatcaatggttgagaatttctgcatgaagtcatcttgcgtctggaagcccattttcaaataataacacccttggagagctagcaagttgttaacacccgtgtgtgaattatttttatcagatatcaaggatagctaggattctgagaaaactgagaccagagaagcaaaaattttttaaagggaagagagaagaaaatctacattggctccttccccctactcccaccttccccccaatatatagacttctctttaacagtcagtattaaaaactaaaagaaaattatctagaatccctctatttctattcacatttttatgtattttctttccagtacttcatgcatatatattttctaatctgtgaggtctacataattttgtcttatcctttttaccttaacattataagatgaccattttcttagggcttagaaaaaattttagaagcattatgaatggctgcctagaatcacattttgtgaacatacttcaaatcacaactacagtggaacacggaggatcagtttcacgcccactggctaagaactcactgaactccctggccaagcttaagttgggtgtcctcacctagtccaaccaactgaggctgaggataagaggagtgggggcaaagtcactcatagaagctgctggagcccattttcatatctttgtggatggacaatgggaatcaggatagataagtccagaaaagagaagccttggctgggcgcagtggctcactcctgtaatcccagcactttgggaggccgaggtgggtggatcacctgaggtcaggagttcaagaccagcctggccaacatggcgaaaccccgtctctactaaaaatacaaaaattagccggccataatggcaggtgcctgtaatcccagctacttgggaggctgaggcagacagaagtgcttgaacctgggaggcagaggttgcagtgagctgagattgtgccactgcactccagcctgggtgacagagacttcgcctcaaaaaaaaaaaaaaaaaaagaaagaaagaaagaaagaaaagaagcctgggcaggtggctcataggtgtcctctacaatctgttctttcctaactctttcttggcttttgcataggacacactatgttacgagctatgtggggatcagggacaatactcaaaggagctaagaatccaaatgaggaaacataacatatatgaaatgagaagttaaataatagtaatatttgctacatttttacagaacagctattattatgtgccaggcttattatttaatttactcttcagaatcattctataagcaagctaccaatattccatatttatagataagaaaactgaggctgagagaagtaaagtcacatttgttaaaggtaaccagaatttgaactcaagcagccaaagccctcactatttccacagcactgggcaatctcccaagactgcattgtgatctgatcttaatggaggaacagactctcagaaaattgggcatcatcttacagtgtctcaaaacaaacaaacaaacaaaaatcctgcaaatcctttaatccctattttacctccctcccttgggacatggcttaggtaagctccaaaattaagttagagaaggaaacagatctcatctaaaaaatgcaattataccacagccagatgaataaatccatatgaatactgaaatacacacatactctgagcactaatacttttcaagaaaggtaatgatgcaggaaaaaaatgtctatgaaatagagcattttatagagttcccaaatttctgtctgttgaatctcccggaagtggcattcccctttcttgcaataacagacgattgctcaaatgcctcataagaagcggtgggcatcgtcaactggggggctttggttttgcagagggacgggtttacttttgtttgtttgttttgtttttcagacagggtctcgctctgtcacccaggctggagtgcagtgacccctgctgattgcctggcgtaatacaaggctggacctacaggaagactgactagcttccttcgagccaatattcttttttactttttagacacaggaggctctcgcggtgtgcccaggctgacttgagctccgaggctcaagggattttcccacttcagcctcccaaatagctgggactgcaggtgcacaccatcatgcccagctataagccaatatctttacatatgtattccacacttatttagaggggtgacatccggcattcagtggggaagacaatagtggtgctctaagcctttcctctgttgcctgtaaccaattagctcttgctccaaactcacacacttcactatacgatcacacagtgcatgattcaatttacatgaaatgcccagaacagacaaatctatacagacaggaagtaaacttgggcttgcctaaggctgggggttggaggcgggaggattggggtgatggctaaggagagcagtgcttcttttggcgataatgaaaatgttctgaaattatagagatggaagcacagctccgtgaatatattaaaagccattgaaccatacactttaaatgggtgaattgtatagtatgtgaattacatcttaataaaactgttaaaaacccttcaggctgggtgcaggggctcatgcctgtaatcccagcactttgggaggccaaggcaggcagatcgcatgaggccaggagttggagaccagcctggccaatatggtgaaaccctgtctctagtaagatacaaaaaaatagccaggtgtgatggtgcacgcctgtaatcccagctactctggtggctgaggcaggagaatcacttgaacctggcagatggaggttgcagtgagccgagatcacgccactgcactccagcctgggcaacagagtgagactccatgtcaacacacacacacacacacacacacacacacagattcctgggccccttcctaggaattcaatgtgttgcatgggtgtagatatctgtattttaaggaagcactccgagtgattctgatgctgtagggcatgagacaggcatttggaaaccaccatacaaggcttcgcttcagagataagacaaaagcttcctttgtttccacatttccctatcagtccaacttccttgtagaagcagcaacagggaccttccctccttacaaggccatctcaattattatatggaaattccattttacagaggccaatggtaactttccagtataaacataacagaaagccttggagacagtgtcaaactgctgacctgctgggcctttcttattcgctggatgaatctgggacttcaaacaatcactgtgcctgaactaacgagggggctgtaaacatgcctgcaagttctcccagctccccttttggggcctgaaaatttatctcttcgcagtgagcggaaatattttccttagctgggtcccctgttttatgcctttgatttacagaagcttctcaacaaataaatacaagttgactgttaggtcacagccttttggagagctttccaaaagccttcaagagtaagggagataaactggaacaatatttggaaaataatcccagttgttttatcactttcctgggggctgagacgctgattggatcttggcccctcaccggcaccctatgaggcagacagggcttcattagctgctttctgcatatagagagcggagactcagagaggttaagagggttgcccaggattccccagctggccagtaggaaacttgtctgggaccttcattccagatttcaaggacctgggcttgctgtgttgcctaacagccataaatattttagagaagcctgctgggatgtaaggaacttcagagattttagcccccaccatttagccacagagcctgggtttatggagccactaattcattctgacagtgcctgatcacccgcagagcctcagcagggagatctacacatttcaaggatagctagctcaggagttctccccaatgcccattctaggccatctcagagctctgctagactcgctctccctaccctcaatttctcctggaaaaagcaaacatgaccaggtttatttgtaagcccaggtggttcatccatttccaagacagtcaagacctggccattaaatcatacttgtgtttgtgcgtgcacgtgcgcgtgtgtatgtgtgtctgtgtgcgtgtctgtatgtgtatgtgggctttgtttgtttgtaatgacttcggtttaagaaggctgcttttggatcttcctgtctggcctgagtgtgggacacaagctagcgcttgctgacctgaatcagcactgtgccgctgtgagcataagtctgcttactcacggacagaagagaagttcatgggctttttcgggagcagcctcagctgggtggtaactgttgctcacctccagaagctgggggagcttcagcagccacctaaggcaggcacctctcagcgaagaatgaggcagtctgtccccagacgtttccactgtgtctctagccacaggagtctcttgtggctggagagcccatgtgtgctacgctctgtgcctctgtgattttctcctaccctcatcacagtctacatggtatatatcccaatgctcacctatggatgagaaaacaggctcagagagaggagagaggcactagagaaatccctgctagtgcagtgaggactacaaaggacattccaagaagtgctaggcagtgtttgaaaggcagattttgtttgggggggtcagaaaatgccttgtgaggctgggcaaggtggctcgcacctgtcatcgcaatgtgggatatgatgaggtttctctttaagcattattcccaacaccaacactttgggaggccaaggcaggcaaatcacttgaggtcaggagtttgagaccagcctggccaccatggtgaaaccccgtctctactaaaaatacaaaaaaattagccaggcatggtggtatgcacctgtagtccaagctacttgggaggctgaggcaggagaattgcttgaacccagaaggcagaagttgcagtgagccaagatcgtgccactgcactccattctgggtgacagagcaagactctgtctcaaaaaaaaaaaaaaagaaagaaaagaaaacacctcatgagcagcagttcctttttcagcttgatccagaaggatgactaagggttcatgaaggtgcaaggcaatgccaggcgggaaagagcagccaggagatgggcggagactggcgaaaggcttgtgacagggtaggatgctgggcacttaaagagcaccagcatgatatgggtagaaggagaaattaccaggaaaggaggacagaagccagactaggggaggccttagaggttaaagattttggatcattttgtgacattacagggttagtttttcagatgaaacatggaatagcaggaccttatatcacactcttcctatgaggaaatattccaagtttcacacgcctgctttccaagggacttttggatcacagcagctgattcaggggatgaagagtggctttggacatcagttctcctcttctcatatccacgtgtcttctcttcctatccacattgtaaattctttgagctcaaagacaccgtgctttgtagaacatcctcccctcacaacccactccccaacagccttaattatgtactattaaagtaaacaatttttgataaggatgacattaaaaagataaggcatctaatggttctatactggatgaaaataaatgcaatattctatccaagcttaacatgatatacaagagatttatttttttgtttgtttgtttgtttttctgagacaaagtctcactctgtcacccaggctagagtgcaatggcacgatctcagctcactgcaacctccgcctcccaggttcaaacgattctcttgtctcagcctcccaagtagctgggactacaggcatgcaccacccctggctaattttttgtgtttttagtagagacagggtttcttcatgttggtcaggctggtctcgaactcccgacctcaggtgatccacccgccttggcctcccaaagtgcggagattacgggtatgagccaccatgcccggccgatatacaagagattttcttaaactgcagggtcaaaacatgcttcccttataaaaggtgtgaccagatagtaaagagattggtttccatcctccaaaaacaaatatccatctgattacagtgacatcatgtatagagtaatacatctatttcactatgtaatatgccaagaatgaatttacgacctgccctatcactgaaattgcggtgggggttcaattgggatacactaggttgtaagagttagaaactcaacttgaattagtttaataaaaaagtgaatttctgggaaggattctggtataatgaggagaatgagggagatgggatgtgtataaaggcagccccaacatggttagaatgagcccttcccaggagaaagatctctgaacaaaaaatcaatgttaactattaggcatctgctatttagactttgagacttgtttctataacgttattagaagaacacagtgtggtaaaaatgaaagtcactttttggggtcagacaaaactgagtttaaactgctgatctgccacgtactagtgctaagaacttagcaaatcacttaaattctctgaacctctttcttctcagctaggaaaattaccatttaaggatttaatgagagcatgtataaaagaaaatagctctgtgccagacactcactaagagcttaataaacgttgcccccatccttcccttcatttgtcagggaatgaagattaactacctgtattaaatgagccaatatggccgggcgcggtggctcacgcctgtaatcccagcactttgggaggctgaggcaggtggatcacctgaggtcaggagttcgagaccagcctgaccaacatggtaaaacccagtctctactaaaaatacaaaaaattagctaggtgtggtggcatgtgcctattgtcccaggtacttgggaggctgaggcaggagaatcgcttgaacctaggaggcggaggttgcagtgagctgagatagtgccactgcattccagcctgggcgacagagtgagactccatcaaaaaaaaaaaaaaagccaatatatgtagagtactaggacagtatctgatattcagggtaagaatgcaataaacattagctgccattatcatcattttgataatatttgcatttccctataagaatatccctaaatgaatccaatggcttctcatactgcccaccttcctgggggagaaaaatatttttaaaaggtgacccggcctggcgaggtggctcatgcctataatcccagcactttgggaggtcgcagcaggtggatcacctgaggtcaggagtttgagaccagcctgaccaacatggtgaaatcccgtctctactaaaaatacaaaaattagctgggcgtggtagcaagcatctgtaatcctagctacccaggaggctgaggcaggagaatcgtttgaagcagggaggcgtaggttacagtgagcagggatcatgccattgcactccagcctgcacaacaagagtgaaactccatctgagaaaaaaaaaaaaaagaaaaaaaaaagcagatgaccctttttctctatcctgttttcattttaaggctgggaattgtttttgctctgcagtacccaagaggctctggacacttagtcaatattaattaatgatgtttttggtggtgtgccaggtttttgacactaaacatttttatgccaacttcgttgaattaaggtagaattaaatagctgtgctgcaatcctgtctcagctgtaatcaccatttgctttgctcatctttcccatgctattcaccccacctaatcagtccagttttattgcatttacgtagattgtattgatgcatctgctgaagctcctgcaggaataatcatctctcatttttctcttctgtggctgtgggtattggaagaccctgtctctccctcagctaggacctgagtagaacctgtggtgaagagagtgtagagaaagcaataggctttgcaaccatggtgagttaggagtgtcagggctttgtttaccctgagagtttacctaggttgaaggctgtcaaagaaaactttcctttaacgtaaaagggtgacatggacatggttcccttaaagcggcttctcaggtggaagatcacaacctcttgatggcagtggcatggaataaagcgtcttagtgtctcctctagtgcctaatttagtcccttgatcaaataacaactacagtaacaggaggaggaggaggaattaacacttatgaagagctaggcattattctaagcacatcacatattatagattatttatgttcagaacaactctatgagatggttactattattatccccattttacagatgaggaaactaaaacaccaagaattaagtaactcgccaaaggccacccaattattatgtgggggacgtggctcttgaacaacaggagcacactttggagtccatgattgtggatgttgggtaactatttatttggctattttttttaattttttttttatctgtagagtgccttttaaagttttctctgaaagaaaaaaaaacagaaacagtctatagtgggccaaatatggccttagatgttaacgcgtgctttattttatttaattgtcagataattctgcaaagtagatgctattttgctatttttgtgttttggtttttgggtttttttgagacagagtctcgctttgtcacccaggctggagtgcagtggtgtgatatcggcccactgcaatcttcacctcccgtgttcaagcaattctcctgcctcagcctcccaagtagttgggattacaggtgcccgccaccacacctggctaatttttgtatttttagtagagacggggttttgccatgttgaccaggctggtcttgaactcctgacctcaggtgatctgcccacctcagcctcccaaagtactgtgagccactgcacctggcctttttttgttttgttttgttggtttattttatcctcctgcctcagcctcccaagtagctgggattacacttgcaagccactctgcctggctctattttctctgtttttacagaagaaggctcaggatcagagaagtaaagaagtttcatgagattacacacctagtaatggggaaaggtgagacttgaagcatcatgtctgtccaactcaaaggccatgattccatgcatttcctaccactgccagctttgcaccagggatggaaaactttgagtcattttctgcaaagttttcacaacactttcctttggggtatattcaccaggctaagcagatactattatccaggtgcacatggctaaaattactgtacagggagagtactgtccaaaagacccagaaacctcttttctaacagtagacaagcagctctattccaatatggagcacaattttagccataagtaacaataccaatcattacaacaccttatatttttacattataatttcattaacaataagctccttacatttttatgatactatgtgcctgacactcttccaaccatttcatgtatattcaatcactgaattcttacaaaaaccctatgagggaggcctagttttcttccgtttttagattgggaaactaacgcacagacaaacaatttgccaaaggtcacccagctaggaagtggtagaagcagacctgaccctaggcagtgtggctgtgaagtctgtgcactcagccacgggctatgttgccgttcattagttaattatttgggaaatgttagttccgttcctctctccatagattaggcaatggggattaatgtgagaattaacgatgtgtactgcatcacctgatatgtgtactgaatgatttaaagatttctttgtagggtgtttacatatacaaggcattgtaccaggctgtgagaatgccacacctgccttcaaggagctgaaatcagcaaaccagcaaatacaacaccatgtgataaagaattaatatgggaaatggtggctattctcctttcaccgtctattctctgtatctttctgtcaaactcaaggctcccagagaatggcctgggctttcttgccctctgacttctggttaggtgcagcctatggacagatattggaaggagaggaaaggagagggacatcagagtattcattccccagccccatctcagccttcttcagtctagcagtgccgatgatcttctctggctatgacttctgctggacgactctgcttctatggccccagctcccacgagggtgtcagtaacaccactctctccatttgctccttcaggcttaggggtatgaatggcttctcaagttttctggttcccagatgcctcagcattccttgttggtttctataactctgagtgtaccgtttgcttcctgtggggcccctgactgttatgaagggtaagcagaggagataataagaggagcattcaggaaagatccctaatctagacttggagggagacgggaggctgctcaaaagaagtgaaatctgtaactcctaaaggatgatcaggaattatccagtttggggaagtggaggtaggaagaatatgctaaaaagagagaatgacaagtggaaagatacgaaagcaagagcataaaatactcccaagaactgcaaagtgtccgtaagataccgttcaaggtagagagcggtgaagaagcttaagtaagcacctccagatcatgaaggtggaacttttctttttttcttttttctttttcttttttgagacaggttcttgctctgtcgcccaggctggagtgcaatggtgcgatcttagctcactgcaaactccgcctcccagatttaagcgattctcaagcctcagtcgcccaagtagctgggattacaatcacccgccaccatgcccggctaatttttgtatttttagtagagatggggtttcactatgttggccaggctgatcttgaacccctgagctcaagtgatctgcccacctcggcttctcaaagtgctgggattaaaggtgtgagccaccgcgccctgccaaaggtggaacttttgaggtttgtctgaagtttgctgatgaagttttgctctatgacttgtcatgtaatcttccctttgatttccttatgaagcattcagtgaaatctatattgcttaccaaaagttctgaagttgggtttcggagtagccaagatgaagtgctgaggctggtctgaaggagctctcggaggtaatttagcaataggtttgagattgcgctgtcagattttgaagtttatgaggccacccgcatcattgctaatgtgtgctgtgtgggtggagaatggatgaggccaaaaaaatttaggacaaatagtttggagatggagaatcagcaaagaaaaggttgagaggagaaggcagctagaactcaaacattataaaagaaggcttgttctccgcctctgcataatccttagtaaaatacgcctgggttacagcaaatgctatttaaaaaataacactgagttctgactaggagacatgagacaggcactctctctccctgctccttcattcttgcctttttttgtggttctagatattaagcaccacccttgttggcacctgtgttgcccctgcagatgccttgctctatcagttatctccatagccccttgttggtcaacaccctcttccacactgctagtcattacactcattatggcctcctggcttctggtggttaagccaccttacctctattacttcagggctccatcatccctatccacattaacaagcccaactcagaccatcttctcaatggctgaccctgacctgcagtggagcaccaccactgaatggattagcagtgctgatgccccctcaccagcacattccagtgccctggctgaagggcgtgtcctttgggccctccaagggttgctcctctggtggatcttctagcttgacatgaaatagccatccaagcatcctactcgccttagcctctgtcccttagcgttcctccctcaagcatcttcagggcaactcgggcatgtccctttgcctcagtgttggccattgctttgccaggtttcccggagccaaccccacagtgaccttgccccatccctggaggctgtctgtactttatctcagtctcttgattgtctatatattttcttttctttttttttgagacagagtttcactctgttgcccaggctggcgtgcagtggcatgatctcaactcactgcaacctctgcctcccaggttcaagaaattcttgggcctcagcctcccaaatagctgggattacaggcgcccaccacaacgcctggctaatttttgtatttttagtagagacgaggtttcgctatgttggccaggctggtcttgaactcctgacctcaagtgatccacccaccttggcctcccaaagtgctgggactacaggcatgaggcaccatgcccagcctaaccacctgtatttttgaaattacttgtggagtttgatactgggaatacctttgattgtgtgagtctaacttgagaacccagtgatttatgattatatatatgtgtgtgtgtgtgtatacacacacatatatttgcatatattatatatacaatatatactatatatgacatatatagtatataaaatatacgctatatatgacatatatagtatattaaatatacgctatatatgacatatatagtatataaaatatacgctatgacatatatagtttataaaatatacgctatatatgacatatataccgtatatgacatatacggtatataaaatatataccgtatatgacatatagtatataaaatatataccgtatatgacatatatagtatataaaatatatactgtatatgacatacatatagtatataaaatatatactgtatatgacatatattatatatgtttcaggaaaatatgaacactgactagatatttaataatattaaataattattgtagaggtttttggtgtgataataatcttgctgttaggtttttaaaatatatgcatatacaggctggacatggtggttcatgcctgtaatcccagcactttggggagccaagatgggaggattgcttgaggccagctggagaccagcctggccaacatactgagaccccgtctctacaaaaaaatttttttaactagctgggcatggtggtgccacttgaaggccccagctactggggaggctgaggtgggaagattgcttgagtccaggagttcaaggctgtagtgagctatgatcacattactgcactctagcatgggcaacaacgtgagaccctgtctaaacaaccataacaacaacaacaacaaatatatatatatatatatatatgcatatagaagtgtttactgattagagtatttgatgtctgagacttgcttcaaaataattcagtgtgagagaaagaatggggggcatagagacatagatgggccatgataattattgaaactgggtaatgtgtccatggaggtttattatagtatcttccatagtattatatacagtatataaaacctttaaaagtttgaaattttccataatacagagatttttaaaacactaaatcaaatttaaagcaaataataagatacctgaaatgccacaagggtgaatatatatatatatgtgtgtgtgtgtgtgtgtgtgtgtgtgtgtgtgtgcacgcgtatgtatgtgtgtgtatatatgtgtgtgtgtgtgtatatacatatttttttttttgaggtggaggcttgatctgtcgcccaggttggagtgcagtggcgtgatctcagctcactgtaacctccgcctcccgggttcaagcgattctcctgcctcagcctcccgagtagctgggatcacaggcatgcaccaccatgccgggccaattttatatatttagtagagatgcggtttctccatgttgttcaggctggtctcaaactcctgacctcaggtgatccgcccacctcagccttccaaagtggtagaattacaggcatgagctaccatacccagccaagggtgaatatatttatatggagtattctaacaaccatatatgaaaatatgaacttgactacagaaaaataacatagttcataaataagacattggtagaaggagaaacaatattaaccacaaaactggaaagcagttttcaaccctccactcagtaaaatacaaattaatatagaaatattatattaactctttctataaaataggcaaagaacagaaaaaatattgaggcaaagtatttcatagggtgaagaaaattcaacagtttaaatttttatctttctgcaaaccatttttccaacatacttatcaaaaaatcttaaaactctgccctactacttgacccaaagtccagcttctgtgaaattattcttagacaataaacatagatatgtgtgaacatttaggtatacatatgtgccataagtcattgtttaataataatgaagaccgggtgcggtggctcacgcctgtaatcccagtgttcgaggtgggtggatcacctgaggtcaggagttggagagcagcctggccaacatggtgataccccatctctactaaaaccacaaaaattagctgggcgaggtggcgggcacctgcagtaccagctacttgggaggctgaggcaggagaatcgcctgaacccgggaggaggaggttgcagtgagtggagacggtgccactgcactccagcctgggtgacagagcgagattctgtctcaaaataataataataataatgacaaaaattttaaataatataagaatactaattaggattgaacaaaataaggatgaagggtgacctgcatatccaacaacagaaaatcgttaaaggaattgtggtattatatacagatagaaacacacattttatccagacattacatgagactatgtaatgacaaggaaagatatccaggaaaattagataaagaaagaaaactggaaaggaggactaccagaatttttcatttgtgtttcttttgtagctctatagaggaacaacaacaaaaatggaatagaagaataagctctaaacattaaacagggataatatggtgtggagaggggtagcttatggatgttttatttttcttctttttatatatctatatttcctaaatgttctgtaacagacttgtattactttaatgacattaaacaaaaccatctgttgattcaccaatccacttcgaggaatctttcctaacaaaataaccaggaatatgatcaaagattattagcatagtctctggagcattatttataataggggaaatattgtgagtaatccaattatcccataataagagaatgattagataaactattgtattaagaattttttaaaatcgcatatttctgagaaaaggttgattgttctataaccacggtaacaagtaccattataaccaggttttaaactctatcaatcaatgcaacttgcttcagtgaacgtgctttgacaaatcaaccaatcagtgatagtctcttacatatgcaagtcagccaatcgggaacagagttagtctaatagatgagcttctgaatgccaaccaatcagcaacagtctcactggagtaaccacatttctagagttgacgtcaatctacttatatccctgaaaatcttccaatccctgaactctatgcttccccaaaatccagtataaaatcattattctgctaagccagattctacctgaccagcatggctcttccttaccataataagcaataaattcagctttgtgttatgtggtattctgtgtgtgtgtgtgtccgtccctgtatgtgtgtggagtgtgtgtgtgtgtatgtatatacacactgagggagcacacatacacatatatacgaacatagaatttcatacattcattgaaaattttgttttcaaagaccacataatgacaagaaaaatatattcaaaatatattatgtgcaaaagcattgaatacaaaactgtgtattgtacagtcctaatgagagagagagacaggagaaaatacaccaaaattttaaaaaatatatctgggttgtgagactatgggtgattttcatcttattttttccttatattttcaaaaacctccatagtgaccatttatcacttttataatgagggggaagactttcttaaaaagtcttggtttagcattatagccctaaaccagttaattttaaatgtcatctgaaaagtttagaacctccttatgagttcttcttttatgattctttcattgataacaggctatgacattaagccaaaggcctccattccaaatatttattgtgtgcttgtgtaccagacaccaaataaggcacacagacagctgctaagatgatgtaggatgaagctgggcatggtggctcacgcctgtaatcccagcactttgggaggctgaggcaggtggattgcttgagcccaggagttcaagaccagcctgggcaacacagcaaaaccccatctctacaaaaaaaaaaaaaaaaaaaaaattagccaggcgtggtagcacatgccttgtagttccagctacttgggaggctgaggtgggagaatcacctgagtccggggacgtcaaggctgcagtgagcggtgattgtgccactgcactgcagcctgggtgacagagtgagaccctgtctcaaatcatccctcagatgatgatgtttaatgatgtaacaccttcctgaaaactatatggaaaaggacattttcattaattggactgagcataggagactgtgttttcctatcaagtatgttcaaagcttattattagtggggactatcaatgcagcaagtaaaggcaagaaatgcagtctaggtgtttgttaggcaggactatgagtaatggtctataaaatacaacaaaaaaactgggaacgacctagagtgtgtagtagaaagtgaaaaacaaatgttaatttcttctactatctttttctttattttggaggagagagctttggcttcttcttttcttaataaaaatagtgtcaaggtcctaattgcatttaattaagccatatttctagcactgagaatgcagaaggatacactgtagcctgctgttctccatttcctaatgcatgcaagcagctctaaatgagtaagaaatgatgattgaatattgtgaacaggcacaatagttaatctcatgtgaatagacagtaggagtggaatgtgtttgtcttgggtttgttagaaagattttcatgatcaaacactgaaagaggattttccccattttcttcctgctgacaatgcatcactgatagtttgacttaatgaggttcttagatttaataaaatagaaaaaggcagtgagccatttcccaaaatgacttgaaagaaatatttggcagaaataattgagattcagagagtactggtccatagaaccctaccaattcctaccaccctggactatgcccgcttgctctacattttctgctgattttagaaatcaccccatcgctgcctgggtggcagtaacttcccttaatagggccatttatcataaactatgagttgctaaggaattaatcaaaattttccatgggtaagcagtaacttgagagtctgtacaatccttaataacgataccttagctttgtataatctgctggagtttacgtagtgccttcatggacctttaaccattcagatctcattctaatcctgtcaagaggggaccagtatcctgactttacagttgaaaaaaattgaggctccggaatccttaaatgagttgcctaaggttttgcagtgagtaaatacatggtagcattcagacctaggtgttatatccatgtctggtgcttgatccaatctagctgaacaactatccctaaacgagcaaaaaagattctgatttgaggtctgaggaccagggatgaagtcctggcccttgcctcttggtagcacatgatgtaaggcatatcagttagcctctctgaatcatagttttcttatttgaaaaacagagacaactgtgctgctatcaatttattctcattactcagccccaaatccaccctttattgcctgctttgtgaaactgcggcttcctgagagatgcaactgccacctggccatttggggtgacttgtgccactgagccaaccagcagaaaaaggtgttactccatgggctagaatgattgatcctagttaccaagggggaaattgagctgctactacacaatggggaagaggaaccatgtctggaacacagaggattatctagagaccctcttagtacttctatgcacaatagtaaaaggtaatagaaaactatagaaacaagcaaacaaaaaaaaaagcaacatgactgaggacttaggccctttgggaatgaaggtttgggtcatttcacccgataaagaaccttgaccatctgaggttctgcctcagggtaaaatgaatataggatggattctgggaggaggaaatcatagattattccatggcatcttacagaaatcaggactgtggtcatgtgaaaggaaaatatcttaggcccccaaaatcactaaggaaaactcaagctggaaactgcttagggcccacaggcctcccattctattcaaagtcatccctctgctcactgagatagatgcatatctgattgcctcctttggaaaggctcatcagaaactcaaaagaatgcaaccgtttgtgtttcacctatctgtgacctggaagcccctccccgcttcctgcctttgcttcaagttgtcccacctttccagaccgaaccaatgtacttcttacacatattgattgatgtctcctgtctccctaaaatgtataaaaccaagctgtgccctgaccacctagggcacaggtcatcaggacttcctgaggctgtgtgctcaaccttggcaaaataaactctctaaattaactgagacctgtcccagattttctgggttcacagtagctttgcagattttctccttacttgttatatgtgtatgtaaaaagtaaagtaaaggttcctcttcaaagagactctcctccctgactaattaggaatatagtaacttctcttagaagcaaaatttatttaaagacctgtgctaacattcttaaatatctgctagccgtaataaaaaaaaatcaatgtactttatgttcttagctcccacaatttagccttaatatttgccctggcatgcttatactggtccaagcaagcattaggtcatagcctgttcctcttccatatttggcggtgcttttacctttctcagcattccccaagttacttcctccttcctttgttcttctctgcctttgcctcttttagaaagttctaagttgctagccaattgggacaaatagagaatgtgaggtctcgttccagccaatggaaaccggacatagcagtagggtggatgtgtcaggttataaatgaccctttattcggtgtactttcgtggcaaaactgctggcaagtgtaccctttctgcagaaagtcaaaatggccttgctgaggaaattaaatgtatgttcaaatgctatttctttacggcactggggcacaagcattttattactaaataagcatttcaaacagtatatattcatttgtatattataaaaatattcttttctctccttcccactgttattttatatctaaattgttggaggttaactttataatttagtgttcaggtaacaaaatattcactggggcccagcgcattggcacaccctgtaatcccatcactttgcaaggccaagatgggcagattgcttgagcccctgagtttgagactagcctgggcaacatggcaaaacgctgtttcaacaaaaagtacaaaaattagccaggcttggtggtgcacaccatagtcccagctactcaggaggctgaggtgggaggattgattgagcctgggaggtcaaatctgcagtgagccatgattgcgccactgcactccagcctggatgacaagactctatctcaaaaacaaacaaaaattcattgggactgtgactgaacttgagaattattactattgggattgtgtgtttccttattttgaggaaatggtgaacacgtgttcatttttacaaagggaagctgtattatgttaggtgaaaacatagaggtgttttgttttcatgaaggagttcaaatgtttgtaaaagggtgcatatggaagcgaagaagccaaagagatggacagtgccccttttcaactgatcgcttttcagttctctttgttgttctgctttgtgatactgtggagctggaccctatacatgttgacctctgtcagccagcactgtgtacagctttgtcaatagagagtgccatagggactctgcaggtgcaagaggcttctttttccagttccagtgttattctttcccacttgctcctatggcacataggatgcatggcacgtatatagaatggccagggacattcatactcttgcaagtttggctggcacactggtgagagactcatggttccctgctcaccagcctcagcccaccagctgataaccagctctggcctgggacaactcaacaaacttctcctctatctactgggcaacaggcacactcctacctgccacaaggtgtgagacttgacctaccttccaagtttgttcttttcttggtcactctccccgactcttaggttattcttcagagttctcttttatctcctcccagtcccagttgctagttccttattaccagttgataactctttatattacattttttctcgttaaatttctgatggtatttctctctcctgattgcagcctgactgatacaaaaatgatattgattttgagtatttcacagggttattatgatgcttaaataagctaatgcacagagaagcacttagaaattttttaagaatttggtaaatcattgtataaatggtctcaatgtatcatccttcttttattcatgctactttatagcatgaatcactgatgctaagattggtcataacatttgttttggccaatggacatctacacacatgatataagtagaagtttggtaagcatttgtatactgacatgtgcccctgaacactgccctgacattgccatgtgaagaggaatagtctagcctcctagaggatggacaaccacatgctgagtgaagcccagccctaagctggtagaccagtggggtgcagcttcacgggtaagcctaagcaaggccaacagaagactcactcatttagcccacagaatcacagaaagaaaacattgttattttaagaccctacatttaggggtgatttgttgcatagcaatacattatggatgcaagtataactgaaacactaactgaaaagatatataagttaaaatattagtaaaaactttttctgtggtaagtgactgaaatctaacttaagctagtgtaagcacaaaataatatgtattggtttacatagttgaaagtccaggagttggttaagcacatagttagatccgtatgctcaggctacatcctcagggatcagccgtcttaccttcatttcctgatcttctttcttttatcctcaggcagacgttgccttcatggtggtaagagggattccagagtctcttatgtcctcaaagcttcaagctcagccaaaagaatctcgatggtttccacaaaaaatcttgggccttggatcaactgcccacccttgaaccaatcctggtggccccaggctgattggcagacctgaatcacctatcccatgcccagaactttggcttgaccaggctcatccaaaacaagggaatccagagtgtttccccaaagaaaatcagggggctattactgggaaaaagaattccaccacaagtataaaaaatactgttatcaataaaacatcacctgatactttggttca

SEQ ID NO: 996 - DNA, 39488 bp, Homo sapiens
gcactcttgttgcatcatcagcgtgcacctccacgatgaaacaggtctgggctacaaaagtatggccgcttctgaggcggcggtggtgtcttcgccgtctttgaaaacagacacatcccctgtccttgaaactgcaggaacggtcgcagcaatggctgcgaccccgtcagcaagggctgcagccgcggtggttgcggccgcggccaggaccggatccgaagccagggtctccaaggccgctttggctaccaagctgctgtccttgagcggcgtgttcgccgtgcacaagcccaaagggcccacttcagccgagctgctgaatcggttgaaggagaagctgctggcaggtactgcagcccgggtggggaccaggctgaggcggtcgctgcgagaggggaagcacattaggctttttgcgacgctcgtgattcaagagacaaaaggaggggaaagggagactgaccattgaattagctctggacaggaatctcgggcatctcgggcttggacttgccctggcacgaactcttgtagcctacttggcagttgtagttctcaacgggaggaaaaaaatcccgtacttacacaataaaaccctgcccttgggcgtgcagacctgttttctgtaatctgatcgatccctcaggaggcttttgttgggttcatgtggatgaaccccaaaaggaagtactggttctgcacccctaaagttgcattcctcaaaatgtattggaaatgcagatatacttcgttaaccaagacttaatatagtcgttttcacattttaatgggcctaacaattacttagagtctcttgtacaaatacagattcctaatccctgccctgtccgagattgtgattcggagagttcggggtatttttaggaaactgcaattctaaatagttgctccaggtgattccagtgtaagtagtttatggaccacatttgaggaacactaaatataacttggccactaagctgagagtgttcattttattgattcgtttattcacgtacactgggaaaatagtagaaaagcctagagaatcaccccgttaatcagctcggatgatttcacacataaagcatccaggatccttaagttcattggacatatacaataagccaggtctgtgctagcctatagagacttgaagatgaaagataactctcttaccttaactgagctgatagcctagtaatttctgcaccttgtggtggtaaaactagttagttaggttattcaaggccctccagagtttggccgtattctgtctcgccattaaaccagtaacagggactttcttacattgtttagtgtcccatggaaaactttacactttaaaaaaatgcaaaaacaaattattctgatgggaattataactgacagtacagatttaagtgtttatgggcaaataggtacactcctgcagatgtttaattccagtatcacgactacttattcttttattaaagttttgctttgttgcctgaaagtatgggtcatacagaggacgtcaaagtgaggaattgcatcaaggatatgtattgtggtatcatcatagttttttagttttccttcatagaactgctgctttcctgatttgttagctaaactctgggtttcttttcttttttttttttttttatccttaaggtaatgattaccattctttcagacaagtttctgacaaagccatattctggccttctggctaatctgcctctaagaactgaagtttcttgttgaatcttggttaaaatgtttcaaggctcttgctaggctagaacctttagctagagacattctcattatcctcgatttctatattgcttgtgattggcctattttgtatttatgttagttaggctagggctttccaaatgtcattgtaattggctgtcagaattgcttgggaagtttttgtttttgtttttgtttttgagatggagtttcgctgttgttgcccaggctggagtgcaatggcaagatctcggctcactgcaaccttcccctcctgggttcaagtgattctcctgcctcagcctcccaagtagctgggattacaggcatgcaccaccatgcccagctaattttgtatttttggtagagacggggtttctccatgttggtcaggctgggctcgaactcccgacctcaggtgatctgcccgcctcagcctcccaaaatgctgggattacaggcatgagccaccactcccggccttgggaaggttcttaaagatacctacattctaatgccatgtttgacaaccatgatcagtggttgtgtcctctaataccattccttgtctttctttgcattgattcctattatgctacaatctctactgtttgtctgttgggatccttcaaagccctaagtgtaccagaattttatagctagaaaataataaaaatccacgaatacttagttcagtggggtgaaccaaattccccactttatatagtagaggcagtacgtctgcaagttagaaggaggtatatttgggcacaaagggaagatagtatatttatggggccttcttactccaaggggtgtcaagttgaaaatgtaaagagttccccaaaaggtttctgttaatttatgagtgagagatccatgatggattgcaagtgacagatcaagggtttgaaactgaggtctggccttagaagtttatgtcaaagcagacaaccatacccttctaagtatggtgatgtcataattagggaatgacgccagggtgttccagagaccatggttctgactcagtagagtggtaattttgttgggaggccgagccacccagcatatccttttggccatttaatctggcttctgcatttccactgttgctttgttttccctcctcccttctctgtccactcgtttcgttttctttgctttattttctttctgctcagtgtcagtgttgataaggaaggtttgatgggcttgggggcaggtatagatcaatgtagcagttcctgcttttctcttctttctcacttgaagtctaatagccaatactctctcagtatgttatatgccatcatcaaaaacaatttatatttatccagaaggaagcactggctctgtctccccaaagtactttcaagtaacattattttgcattatcttttttttttttttaaacaggacaggatctcactctgttgcccaggctggaatacagtggcacagtcttggcttactgcaacctctgcctcctgagctcaagcagtcctctcacctaagcctccccagtagcaaggactataggtgcacaccaccatgcccacctaatttttgtattttattttgggtagagacagggtttccctgtgttgcctagggtggtctcaaacttccaggttcaagtgatccacccatctcggcctcccaaagtgctgggattacaggcatgagccactgtgcccggctcactttatgtttacaacaggaatatgagataagccgggctggcatcctctttttaaaaatctaaatgcttaggaagttaaggtgcaacttaatcttagctgctttccacataacgttttgttgagattcgcttcctttgtttatttatttatttttttttgagacggagtcttgctctgtcgcccaggctagagtgcagtggcgtgatcttggctcactgcaaactccgcctcccaggttcacaccattctcctgcctcagcctcctgagtagctgggactacaggcacccgccaccacgtccggctaattttttgtatttttagtagagacggtgtttcaccgtgttagccaggatggtctcaatctcctgacctcgtgatccgcccgcttcggcctctcaaagtgctgggattacaggtgtgagccacagcacccggcctagattcgcttctttaatgaattgaaaattttggttaggagaaggagacagcgaatgcagggagtttgggaatttagtgtatttagaagtagccctgcatgagatgtactcgcaatgttaggtagctggagatagcagcaaagaccatggaagagattcagaaatggaaattgaggacttttaaaagtatctttctatataaaaattaacttcttttcatgattctctatctaacagcccaccactaccaagaatttactagatttttgcgggttagcttggatatttacccaccttttaaaaatgccgtttttctcttagagaatgaattctactgtcttgatagctgattttggaatactctttctttataatttagggaatgtccattttaaaatcttttctttgctagtaatgaggtcatagtctcttaacatgtaaagtttgtataatactttttgtttgttttgaaaatgccatccccttttcctcccaagtttatgaagatcctacttcatttgtcttggtgatcaccttttttcatccccatttctctcatagaagctggaatgccttctccagaatggaccaagaggaaaaagcagactttgaaaattgggcatggagggactctagacagcgcagcccgaggagttctgggtaagagatatgaaaggcagttaagtgtccactgtcacttaatatcagaaagaaacactggttgagaacagatagattgactaaagccttctatttttcagtcattttggaatgtttcagatctactggatatatatagtgccatcttttaaagaagcccttaaatggtacaaggcctacaaggctgttagaaatagctacttttatgtgtggatgggactttgaaaaaaggtttctctctgtgcagaaaagagttaacatagcaggcctgaaattactatctttagaaaggcttgcttggacagcttgcccttggttggtatctgggaacttggattttgggagtgttcccacccttctctgtctgataaggctggttggctgtgcctcagatgttctgagaacaccagctttccttctaggaatctggaattttgttccactgctaaggcagagggtgcctgagtgatcatcctgtcaaatccccaataaaagctttgggcactggggccgggtgcagtggctcatgcctgtaatcagcactttgggaggctgaggcgcgtggatcacaaggtcaggaattcgagacgagcctgaccaacatggtgaaaccctgtctcttctaaaaatacaaaaattggctgggtgtggtggcatgtgcctgtaatcccagctacttgggaggctgaggcagaagaatcacttgaacctgggaggcagagtgttcagtgagccgagatcgcaccactgcactccagcctgggcgacagagggagactgtctcaaaacaaaacaaaacaaaacaaaacacagctttgggcactgagtttctaatgagcttccctgagagaaacattgcacatgtgttaccgctttttttgttgttggagaaagcagcacgcttgagcatcccctcacaggagggagagaggataaggaagcttgtgcccagatttctctgtgtctttttctcttatggtccagctgtgtattcttactacatcactgtaaaattctgagctatatatcaatcttcgaatgtgggctggtcttggggattcctgacaaggtagaaggctctgtttgtctgcctatctctaatctaatctctgagatcaactctcttgagaaggggaagcttgagagtaagtcattttcggctggagatgtattagttgaccgttttattgcttgtgaaggaaaattggtagaattgatcgaagggaataaaaatattttatccttttttattccatcttttttttttttttttttttttgcacctggtagagattctgaagtccaacttaatggactgctaaagtgtgtatacacaggctagggtatattttactctgtaactgcatccttagtcacagaactacctacatacattgggatccctctcagtgcccccttcccgacatatgagaaacaaacttttatggaacaatacttatctttttacatgctctggtattttatattttattcagtttcatttagagcaaaaattaggtacaaagaaacaacagcaaaccttgatctaagctatccaaagtaaatgagcgcttatttaaaaggataaaatcggtgaagaaaatagtatgcttcaagaacattatatactgtatgattttgtattttctaaaattatagatttatgttggcaataatatttttacttgaggttaaaatagaaaaaatcagttcgagaccaatctggccaacatggtgagaccctgtctctactaaaaatacaaaaattagccgggcatggtggcatgtgcctgtaatgccagctactcgggaggctgaggcaggagaatcacttgaacccaggagacagaggttgcagtgatctgagatcgcgccactgcactccagcctgggtgacaagagtgaaactcttgtctcagtaaataaataaataaacaaacataaaatagaaaaaaatcaggctgggcacagtgactcatgcctataatcccagtactttgggaggccgaggtaggtggattgcttgagcccaagagtccaagaccagcttagacaatgtggcgaaaccccatctctataaaaaattaaaaaattagctgggtgtggtgacacatacctatagtcccagctacttgggaggctgaggtgggaggatcactggagcctgggaagttgaggctgcagtgatctgtgattgcaccactgcaccccaaaaaaacaagcacaacaaaacaaaaaccccagttaataataacaagcatttattgagcatttactgtatataaggtcttcagttttgggtattcataagttctatagtttaattctcattgtaacctataagagaggttattactatccccattttacagaagaagaaaggaagaccctgagagataaagtaacatgttcactgtcatagaattagtgagtgacaaagtcaggatttgagcccagatctgctcagttccaaatcatctgccctattgtggatggcagatacctggtgctcctgcttttgttcctcatgccctgtgctcttggcagaaattagggcttcatgattcttaccagcttagcacttcagtagcctataccagttgattagagttggcctttgagttgaagcctgtgtttctaacccttctgctttactgttttccaggcatggcaccacaaatacaaggaaagagaggatcagatcagttgcttgtttacgaatagatcaattctattaatttcgggtggcggttcttcattggcatgcagaaaatagtgatattcaaggcagtgaatgaaagtttagtttttaccctgaacctaaggctagcttgtccaacctttggcctgtgggctgcacgtggcctagggcagctttgaatgcagccctacacaaatctgtaaactttcttaaaacatcatgagtttttttgtgatttttattttttttaagctcatcagctatcgttagtgtattatgtgtgtggcccaagacaattcttctttcattgtgacccagggaagccaaaagattggacactcttggcctaagggatcttgttgaagcttccattttagtattgtgaaggggctgagatttgtatgcgtggaagaaattgtattggaaacagttttctggttggaggctcaatttatatttgatcacacagggaattttatgatgatataatatgttcatatgtcagatgtattaatttttcttttaatgcatgtgatttccgaggagagagaaagtttaaaaaattgtaggtgtttagtcacagagtaagggatgtttgttgtccaagttagcagttctggaaacttatgagaagtcgatttttgattgtgtgataaaataaacactgaactctaatcatacttcggtttgtacactggctactggctgctttagttactaactgtatacatcctaagaaaatctcgtaacttcactgaacgtgtcttcatctcttaaaagaagataacgtctaccaaaactaagtcaaaaggttttcaaaaatattttacaaaatacctatagtatatagatatatactttatcctgtgaagtgctgtatacaggtcttttttatttttatttatttatttttttgagatgagtcttgctcttgttgtccaggcttgagtgcggtggcgtgatctcagctcactgcaacctccacctcccaaattcaactgattctcctgcttcagcctcctgactagctgggattataggcgactgccaccatgccctgctaatttttgtatttttagtagagtcagggtttcatcatgttgaccagggtggtgttggactcctgatctcaagtgatctgcccacctctgcctcccaaagtgctgggattacaggtgtgagccaccatgcccggccaaaaggtcttttttgaaacaaacaaacaaacaaacaaaactaaaactggacctatgcaaaaaaaatatacttttactttcaacatttttttttgcaatattaatggtgcagattaagaatttagctgacaatttaagattataacctgaaattcaggtttataattctatagcataattgctagagggttcacaagtttctcaaaaatacgtggtaggcaaaataatggccctctaaaggtgtctgtgtcctaatttccataacctgtgaatatattaggttacatcacaaggaacattagggttgtagatggaattgatgttgctaatcagctgactttaagatagattatcctggaatttccaagtggacccaatgtaatcacaatattctttaaaagtggaagaggaggcagaagagagagtcagaggagatgtggcagtggaagcagaggttggagtaatgtggttgctggctttgaagagtgaaggggatcacaagccaaagaatgggggcagcctctaaaagctggaggaggcaaaaaaaaaaaggtcctctacggaggctctagtgaaggattctcccctagcacctccagagaagaacacggtcaagccaaccctttgattttaagcctagttaaacctgtttcaggcttctcacctccccaactatgtgataaaaagtttgtattgttttaagacagattggtaatttgttaacagtagcaataggaaaggaatacacctatttatcataaatcacttaaaatgtaaataaaatttctatataccatttcaaaaaaatttttttaactttagaggttatagaaacagtgagaaaatttagaaaatacaagaaagttgcaaataaaaaattatccattttccacctttcatcaatagtcagttaacatttttgccatatttccttgtagctttttgtctatgcagatttttaaagttgagatctacttcactgtgtatacttatatatccatttttttaaacttaacattgtaacataaacattgttcatgttgataagctctttgtaaactttatttttaatggctataaaatgttccatcatatggctaaaataccatttattaaccatttccctatttgaggtcactgaggttatcaccagagttttgtcagaactgattttgtgagagatgtctttatagatagaactttttgtttgttttgtttttagtttttacccacacatctgtatcagccagatgtttcagattcttaaaatagattcctacgattggaaagatacaggtcttgtaagatgatcctacagaaagctggaaatacatgtatagagtccatgcctgtcctaaagagactctcatcataaacaaattctatctttttgatttgagaatgggatactaggacattggataagtttggagatagttatttttgtttttgtttttttaacggaaaagacatttgagtgagcacagaacacttgggagatagagtaggagagtagtaattgtgcaacagtgcatggaaaaccccgttattcatctgctctctaaattctccacaccttttcaaatgtggtgcctttgctcatgtttttcttttataagctgctcatctctctcagcacctttggttgtagaagtcctactgacctttccaggttcagctgaaatgccatttcctacctttgaagcctgcctgctgctcttctatactgctaatgtaaaatttcattttgttcttttagtttttgttaatatctgtctccctattatattgttaaatcacagctgaagccaggtcttatttatttctgtacctacacaataagtactggatacaattttgaatgattgaagggaaaaaatgccgagtaaaaattctgtccgggaaactaacctgtgaatgaaaagctgctggttggctaggtcccaactccagataatttttctatatgccaccaccatattagtcttcctaaaattctgctttcactaatcacctcacttcaatggcatttggttattcttaggttaaaatgagaggattaagctgggtaactctaagatggcttcttttaaattttatccttctgggtcactaaactagctcagaaaccatcatgagttcagtatttcagccatgttaaagtcaaacatgtcagtctgcttctaagacaccctgtgttcagttgataaacctactgttctcatccttgtatctgagagtttgtgcaattattttcttttttagaacatgcttctcttctctctgttgtgttccctatacatccttcaaaggcctaatacaaactccgaaatgcttgaatgaagcattctccggcctctttagccgtttaggatgctcccacctttgccctgctttggcagcggttctctctctgttcatttgacacttaatcatatactatcatattgttatttagcattattcactcattaggcaacatttcttgagcactgtgatttttctgtattttattttcctgatgagattataagctgtttcagagttaggaaatgtgtcacaggtttctttgtttttccattggaagtattcctcttgggattatgtgcatagtagttgttcaagaaaaattgattggagatttatttgaatggaatcaagtcgcattgaatctttcctgtttgcctcatcagcagcagtatctacaagttctgtcatttgaagagtattatgctcttcagaggattactgaggacagactgtttttgatcttagaccttgaactatatgacttagaaggacaatacagatgagtgtcatagaggttttgaggaggttggaatagactttatgaatgagttggggcttgagctgggcttcaaaggattgactttgaatactttaataaggagttggtgctgtaggcactgggaccctactaaggattgtttggggggctttgtaatgtgaaaaatagggtttcagaaatggttatgaagtggtatgaattggaagaggaagggataggatgtagaaccgtcaggtttgcagggatgtaggctggttgcagtgaggagaaagcctaggtgagttaaggtggcagagggaatggaaaggaaggggggtctgttcttagaccatttggtttgaatcttaactctaccaggtactggttgtgagatgctggacaaagttcttagtctcttattcctgtttcctcatctatcaacaggggtaattatactatcttttaaagtttttttttttttttttttgagacagagttttgctcttgtcacccaggctggagtgcaatggtgtgatcttggctcaccgcaacctctgcctcttgggttcaagcgattctcctgccttagcctcccaagtagctgggattacaggcatgcgccaccatacctggctaattttgtatttttagtagagacggggtttctccatgttggtcaggtgggtcttgaactcgtgacctcaggtgatccgcccgcctcaacctcccaaaatgctgggattacaggcgtgagccaacacacctggccttttaaagttgttataaggattaaatgggataatgaaaggagagcatttagagtagaatctgatacatggtaaactcactgaatggtatttgctgtaaatattggagatattttttctagtttgccaatcagtagtccttgtttactcttataattctgaattgtggtgattgtattgtgttcttatgcacagttatatctgttgatgacaaatatttctatacttacaaaaatgtggcttcttaacaaaaagagaagtgactaaatcctctcaccctcaccaagtgaaatgtgttgacgtatgaataatgtttgaaatttaagagaaaggtaggccattgttgtactttgggctctgtaaatacattcttcagccttcattttaccttgtattctttgtgttagactgatttgttatgtttctcttttcttgattgtatatactgctgggtgctaatcatctttaaatggttcattagctgtgataatggcttttgctttgtttaataatgaattctgtcaaaagactttatcatacccacttgaacatggttaattgtgccgtgtgtttttcactggtgcccatataaaattccagtgcgtcctttgagattgttctaaggcttcattgtctaattggctgggttaaggtttctactgagtttaatactttgagaatggggagaaaggtcttctcttgtcccttctttagaatttcttagttgcatgacaagttcaactgtttggagtaataggagccctaacattttgctaaatatctgttctttcccacttcacattacctaagctgggaaattatgaccaaaaaatatagctattttaaaaacctagttttcagaacagagtgtcataatatttctttctttgatttgtagttgttggaattggaagcggaacaaaaatgttgaccagtatgttgtcagggtccaaggtaagaatactgaaatagttctatttttctttaatgttcttaatgatctacatgtattgggtttttatcaaataaaaaataaactgagtaaactgcatgaatgggtatcattcctgagtattaattatgtctataaacatatctgagattgaaaatatcgagactgaaaattggaaattcttaattgaaaaaccaattagacttaaagaaacaatgctacagtgctcatcatttaacaaaattatatttagacttttaaaacatcatatttcttagatgattgggacttagaggtcataaactctagtgacagacttttttaaaccttggaatttttatagaaacaataccattttgtaaactgtgccctttgagcaaaaatatgctttgttcaatggttataaatgtttattaaagaaaagagtagggcctctttaagatgataaagtatgttcatatatgagagtaaccttgaatagatccaaaagcacttttccaggcacttgatagaagagagaaggggttatttggaggcaggagaggctggaaagctgtgaactgctggtagaaggggtctcttccatctctcaaagagagagtaatatctgtatcctaatgagtaattaggtgctggttataagtgctgggactaagggtcaatgaaaatgcacgtggaaggaagcttagtatgccaagaggtagcgaaaaatttcattatgttcctggaataaactttgttttaaaactcttgctctaaatgtgatataaattgttgataaaatgatttttgtttctttaaaaaaatctgttgtcaaagaccatttaaaaaacaatttccagttcattgcagactgattgatgacttttgtaaaatataattaaaatacggcaatgtaaaattgctaaataagtttctacgcaatctcattttctgaacttattatagataactggcctgtggaaaacacttgacgtagtagtggtttaagtattaaaataaaagccctgaccgagcgtggtgtctcatgcctgtaatcctaatactttggaaggccgaggcgggcagatcacttgaggtcaggatttcgagaccagcctggccaacatggtgaaacccatctctgttaaaaataccaaaaaaagtatccaggcgtggtgctatacacctttaataccagctactcggtagactgaggcaggagaatcacttgaacccaggaggcggaggttgcagtgagccaagatcacgccattgcacgccagcgtgggtgacagagtgagatgactccatctcaataaataataagtaaggtaggtaggtaggtaggtagataggtagataggtaggtaggtaggtaggtagatagatacatagatacatagattgattgattgattgatcgattgattttaaaaagcctcggagaacatattgcatgtgatgtctcattttggttatcaactggcataaaaatctgtgccattcaattggaaggaatcttagtgcctctgataaatgaaaagcttcagtgtggcttgctctgtaatcttcaaaatattggtgttgaaaaattacagagtataaaaattgcattagaatgaaggtgtttgacagtttctcagtaaatttttatactgtgcttactgacacatagagtttagaatctgtttctgatactggtttttgccagttgtttaatatttgtttctgaactcccaaagatgaacaatgtttactttaatatgggattatggatgatttttttttcacattatttggtattttctaaaatctatacaataaacaagtcacttttatgttaataataaaaaagatatatttacgttaaggaatttgtttgggtttttttaccaagataaaatatgttgagttcattgagatattcgttgttcacccctcctcccccaaaccacaaacacagcacactatatattactgaaagattttacttgtaaatttcaggcatattttcagaaatattatgactgaaaatgtaaatacatcattgactctggtataaattttgtaacagccaatttgctgttcagctacgaaagctgaatgtcatacagtgaaatcactgatcctcaaaatgactgtaacataaatagaataccacaggcacgtcttgttacagaaacctagttcttaggtatttcaaaaataggcatcgttgtcttgttagctatttatatttcttatccttttaattttatgtacctgttaaaagaactaaatcattaagagtttaatgttgaagattattttttaataaaaagtagttaaaaactgttaataaatattttttctttttttaaaagcactagaaggaatcttagagatcatcttatctagtgactttcaaaatttttttgactaagacccatagtaagaaacatattttatgtaatgaccatatagatacatacatttatgaaaaggaaaaattttatcaaacaactttgtgttagtctgtttgtgttgctgtaaaggagtagtcgaggctgggtaatttataaagaaaagaggttcatttggctcatggttctgaagtctgtacaagaaacaaggtactggtatctgcttctggtgagggcctctggaagcttacacttgtggccatgtcgcatggtgagagagggagtgacagagagagaggcggaggtgccaggctcttttaaacagccagatctcgcgtgaactcattgcagggagggcaccaagcaattaatgcaggatccgccctcataacccagacaattcccaccatgccccacctccaacactggggattatatttcaacatgagatttggagggggcagacatccaaactttatccaactctaaccctatgtatgatgtattcttgatacttttccttctatttcattaaaaaaaaaaatgtggctgcagccccctaacttggcccagatctaatgtccactttttcttcacttcctattttgacagatgaatttttatttgcatcacagtgcaactagaaaaattagacttctggtatgtgtaggatggagttacgtcaagagtagaaatatttagttctaggatggcaaatattcagtgttcttgttacagccatattacagaacagccttctctccctagccagtcgtaattggagatattgctaattgaacatggcctaacatttcttcttgctgaatcaagaaacacccttagaatcttcttcaacatggtgccacttcatacaactactgtcacttactagatgaaattctggcttttaagtaaaatctttaggccatcacattattttgcttccatctgtgaagactagacactaatcagaccacccaaatcatttcttgcatttcctcccattcagatcagggtaaaagttaagaaaagagccactgctctgtgttcctcattgtcttcctctcctgccttggagtgagctttgttctgccagtgatcatatttctcaagtctttttttttttccctgtgcctgatcatttaggattatgtgtataatgtgtgtgaaaagcatgtgaactttttgtacagtgccttgtgtatggaaattgctcattaaatactgttattactattcccaagtattttacttatccccaagtctctctcttgaggtccaggcctgttggagctttctagccacatgttctgtagacacctgaaattaattttactcaggcaagttctgttggaactcttgaatacagttaatttcttttttttttttcatggctatctgtgattgctggtgatgtaggcaaaatattgcactcatcagaaagagaaagcatgccagttctttaagggagagacagactttccttggacattaaagccagaaagaagtttctgacaataagagatattaaatgacagatagatggtgattttcaaaaatagttttacaacagatgtagaaatggagctacataaaatacagtttaggtaaaattctgagaggttaggctgatgtgttcctttggcctaagttgatctaagtataaaacgttgcttacctagaggagggcaaatagcccctcttatatcttccctaaattacactttctttgagccagtcattcagcaaaagctggatagcagatgtcgtactttgaaggaacagacagaaggaacagaagaaaacagatgaggttttggagtgctgtctttattagttttctatattgttgatcaaagttggttactttataaatgctttagaaaccagatggaaaggttatgaaaacctgaataatctaactagcatgtccagatataaaggtacctccatatctctgtgcaggtaaaccatagtggcacctgcaggcaaagccagcatctcctcagaaggcaactttgtatccccctccagtagttaaacaagtgtcatcattggagtgaatgaagtttccccttcttggtgtggtcaaaggatagtaactttccccaagaacacagtaacatttttaggttaaccagttatgagaactctaaagtgtggcttgagtaatgctcctatgaaacttagccaactcttgaagatttcagcatttctaatcagttttctccagaggctagtccagtttgtaccttttctatatacgctattaattttcatatatttcataaatactgtattgaaaattttaaagggcttatacttatgaactataaaaaaggactgttccttcttaatgaagacattcaaagccacatgtttttggtttgataggttttttaaaaagtgttctttctcatcctcagtaatatccctattttgtttgtgaaggtttaaatcacaagctttcaaaatcacacctcagttgagatccaaggaaatgattgtgtgtatactttctgtagtagaaacatttttctttctcctaaacagaacagaagctgatttgctgctagagatgtctagctaatacctgctgtggggtttagggagcttgacgatgagtaaagtagagagtagaataataccagtgagaaactgtgagtcccagagagtacacaggtcaatggaatgttcttcaggacctctcttttgttgcagtagaattacattgtaatgaatacagtagtagaattcacggttcccaggtatacgtcttggagaattaacaactccaaagcacagactctacgtagaatttaagccagtgaaaagaaatattttagactccataagataaaatgttagggttgaatgtgtgtatctccatgtcttttttcttctatcccaatatctttttggtcgtgaggctttgtttcagctgaaggcttaactgtgtgggtgaatttttctaaatggtttgtggataattgaataaaattgaaggataattataactagatgccaggacaagggaaagctaggagacagctgatttcaatcatcggttcgcagggtgtggtctaaggactcctgagactctttcagggtgtctgttgaaattgaaactattttcatagttttgcctttttaacttgcaatcccacaaatacatggtagagtttttcagagattactagatgtgcaatgacatcattgctctgatggctaatggaagttttaaacatttttcagctttaatttctaatacaataaatctaggcagatataacatgtttttaaaaaatgtgtgccagggtttctcaataagttttaagtgtgtataggagttctgaaagcaaaatgtttgagaacattttgatttgatttgatttgagaatgttgatttagatattgtctcccctaaaaagaatccagcacgtagctacatacaatataattgcagaccctggagtgggttgagacttagcagatgaaatctagatattcaaaactatggtgaaatgtgaagaattgcacacataggcacttctctagcatgtgtatcattctgtcagcaactttttattaagctgctactgtgtttctatttaggaaagaacacaatagatgagcaatgggaaactctagctgagagttcatacttgcagaaagtaaggatcaataaagtatacttggaaaacagtgaatatctctgtaggtcatcatgtgctaagatgtgtgatatgtgtgatatgagagctcagtgagataaaccagacatgtctgttgttgccattatatccagtcctctctgcagtagttgtgtttattgaagttttcctgttacactgtaacctcttagagggagagcaatctatcttatgtatctgtgtatccttccctagcacttaggagaatactttggacattcatagtccttaagaaacatgatcgaatttgtggatttgatatatgccttccttctttctatgtatggaatttgtatcgagcacctactcttagtcatgctgtggaggtgggtaaatggaagttgggatggattaaggggtggctttgaaagctgaataaggtttgatccttagagaagagtgggagttcaaggccagggaagtggcatatgtgccccaggtgcacaaaacaccaagagtccagagactagaatgggcattgcatacttgggaaacatgttaaggttcctagttcaaactcgttgcagagcagaatactgcagatacattcaaggcatagtctgcaagattgcaccatggttttcttatgcaactaaacagactctaaagacaaaaaaatcataaagcattttgatgctttgctttccttatgggagctgactgtaaccagatgagtcaactctagccactgttaactgcgaatcattctgtattttctttcttagaaaataaagatgatgatggtattattatctgttatttaccagggctagatattgttactctaaactctttgcttcttctcatgaggcattattgttttccacattttaagataaggaaattaagctccagccggaaagactaacttggtctacaaattgtggtacagtcagaattcaaatccagccagttgaccctgagcctgtgctgttaccattgttgtacttctctcatacttccccctgtggtatgcttagtcgaggttgattgtcccaaaatatagaagcaggaatgggtgtctcaggtgatgagactgtgtttagttacaaaaaactaatttttgtcaatacctatgaaactttaaaaaaattaattgaaatgcgttggaatattcccttctgtattatatttatttttaaaaaatctgagctagataatattaaggtgatttcatcgaagggccttaagctgttataaaatgtctgcatacttacaaggttttgaagttttaatatttttctcatttttgtcttgggtcccttcactagcctcataaatttgtcatgaataagcttatatttctgcaaagtactttgagttttcttttataaaattgctcacataaatacagattattttcagtgggaaataaagttcttgcacttttttcactacttcatgtgatgccccaaataaaatttgcgtttgaccaaagtgaaaagagtacgtactacaagtgtgtcctaagatgagaaataagacaatcctcacgtaactaagaatgatctaattcttcacttgtgaataaagatcagttcttagaaacgattcttgttcctgagatcttaagtagtaatttatctttattaagaaaacacatggccgggcgtggtggctcacgcctgtaatcctagcactttggctttgggaggccgaggtgggtggatcacctgaggtcagaagttcgagaccagcctgacaacatggtgaaaccccatctctactaaaaatacaaaaaattagccgggcgtggtggcgggtgcctgtaatcccagctactccacagggtgaggcaggagaatcgcttgaacccgggggacggaggttgcagtgagccgagatcgcaccactgcactgcagcctgggcagcgagcaaaactccatctcaaacaaacaaacaaacaaaaaacacatttaatagttaagtcactaattctgtgactatactggttttgctctttttctacagatttagcttttgtttaatacatgacctagttactaagaattgtcttagtatttcatgtaagaagtactaagttggcttatttaaaattaattttaattgtatatgtgggaagattattgaatcttatgatgaccatggagtcaaggctattgtaccattctctctactcatggatagacttgaacattttccttaaacaaacttctcagtataaaggtggtttgagaaatttgcttacaataataatggtcataattattaagccataattatcaataaaatcaggtttatctttctcatattggctagtgtgagacgtttgttaatgttcttcagtttacacaattgctttccacatattaaaaacaaaacaattgcagtctgttgttttagcctgtattttgtatcaggttggtagtagtagtgaaattctgtgtaaacttcaagacatgcataacagtttttgtttgcctcacggcccattttctctcttgtttcccttcctctagagatatactgccattggagaactggggaaagctactgatacactagattctacggggagggtaacagaagaaaaaccttacggtatgaagctcatctaatgtaggcctcttttctaacatttaggaaaagtttctgtgcaggtagcattttaaaacaaatctctgatattatcagccattttaattctcagtgtgtttctttgggctaagaagattggaaattgtttatcgcattgttgcttacttgataggagtttttgaataaagatttattgtgattgcctctttttctatagtgatgttttaagtgttcagaattattcttccaaataacctccttgcaaaagcatgtatggctaggatttaggttattttccctagtaaacgagaaacaaagcagagatactctgttagatttcatctgtcttgccattaaaaaaaaatatattacctgtcagctgttgaaataaatgtaccaggtttagtactttaaaacttgtcatgtttttgtgctttcggactatgtaaaaagaggacagagggcaagctatttctctggaagtaaaccagaactcactggggcccaccttaagtttcctactatcccttctttcactaccgtaaggaagaatagataaattaaatggtctcctagcaactctcacagtgcttatgctgtttataatgcagcaattgcagttttctaagtcagttcacctgcatcattatgtcaccaatttgtggactgtttttttgtttagtgttatctcttagtcataggcaagccagcatttggcccccttatatttttgtgttgattatccttattacgtactgcatattgccccagtagtgaggccaacctttttattgttcataatagcttcattttttctgttaacatttatatgtagcttagtatcttgctcaattaatcaagcaacataatgaaaagaaaaattactgattgatttcaaggcttttcaaaaacagatgttgaaatattcttggaattattattattaataaataatagcagaccctcacttaactgaaagccagctataaccttcaaccagaagactttaagattaaggaggcatagggcaataggaggacgtcagagacttccagaggatactaaagtatttataagtacttatgtaattaagtctcctgtatctctgactccatttaccaaaccataataaggagaatgattattattcagaacagtagtcctggggtaatataattaaggctggggggtgtgggtaccacgtggtgaaaaatataaggcgcactagagtagacaaatctgggtttaatttctagctctgcccttatctagctgcgcaaatttgaaattttcttagtctctttatgttgtagtttttccatctccaaaatgacaataatgatagcaacctcatagtgtgattatgaggattgattggaggagaatgaatttggaggtctcatagacaagtcatgaggctcttatagtagtccaagcagagatgatggtaagttggaccagggtgccagtggtagagacagagttttcctattagaaaaatttcccatgattaggaagtaaaattagcaagacttgatttttagttgattggacaggatagcgaggaagttgtcaaccatgacctaggttttggggttttaaaattggttacatgatagtgtaattcattgaggatgctggaaggggcccagggtgacaaaaatacttaaacatatcctttcttcctattcttaagcattttagtattttaaaaagctctatgctgtattaggtaatttgtaaccttatttacttaccttaaagaaagctcagtttgttaaatcatctcattgtaatgatgcagtaaatcatagagaaactaagaacgtttttcaggctgtgaagagaagagcttcctacagtttattgaatagtatttatagtcccggaaaatgagagctcagagaattttgctgattggcatgatttttctgtgtgctttcagtaaatcaacaaatattttttatttgttgaagctgctatagcaggtaccaagggaaagatagataaatgtaagacctagcttgtgtccttaaggaacttactgtctaatggagaactctgaccaatattctcagccttctgagacctaatacagagacctatgaccaatatcttataatgccttctttactatcctgaaataaaattcagagatacttgaatttacttatacattgagaaaaatcaatatgatgtagtaaatggaatataagtaagaaataaaagtaatttataataaagtaggtgcattcatatgtaagcacacagatattagcagactaaaagtcttttggctggggtgcagtggtgcactcttggctcactgtaacctctgcttcctgggttcaagtgattcttctgcctcagcctcctgagtagctgggactacaggcatgcaccaccatgcctgactattttttgcatttttagtagaggcagggtttcactttgttggccaggctggtcttgaactcctgatcagcactcaaacatacagcataattgtaaatagtgaaaaatgctatttaggaataatagagtgttatgatagagaacaaagggaaaggccctgttacatgctttgatgtttgagtctaagccagagactcattttcttattcctctgagctagctttcagctgtctgaaataacagttaaaaatagtatttgtctagataggacaaaatgacttaagaacattaatttgccattgactgcatactgagttactttagccaacatcagttgttcttgacaggtcaattaaaaactgtgtttctagttgttacaatgactgggtggggtggtgacaccagctgccttcagtgggtggagaccagggatgacagatgtcctgtaacacagaggatcgtagaacacaatgaagaattgtcctgtgtactgtcagacttcaggatgtctgccagatagtcatgcaggtgtatttcagccatgaggctgaaaccatgtctcttttggtcctcagtagtgtatttttggtgtggtatacggcatacagaatgacatatatgacatatagagtttgaatcaaaaaagataggcagcagaggcattctcagaaaagatgactgcagataagccgggaaaggcaaagcatcttcctgccttctgctgctgtcttctcatccacatctaggtattaagtgtctgctactattgccagtgtctctgaggacacacagcttcagtgtgctcatctgttctccgctgagctaaggacactaagaccatagcttcccaggctagatgtggaccaagcatccgggaaggcctaactgtccctgtactgggagtagttttttctgtccctcccatgagtcaacaaaggtagaaagaaaagtggaatctcatgctaatcttttattctaaacaccaccaccccttagtcctgagatcagatgttaccaaggtcttctcaaatggacgtagctgatgttgtatctaatggtactgtctcctcttggactgtatatggtttggctgctgagacttatcctggagtaagctcaagagttgaatttagtttcaaattgtgatatgaaccaatagggtatatgctataattggactagtgtgtagctgggtataaaaattcttacaaagctgtttgcatttaaacttttcattataaaatgtacaagtaaagaaaactgaacaaaaaataaaggtacagctctatcaatttgcacaagacaaatatctgtagctagctatcacccttagtcaagaaatagaagattgctagaaaccacacttgtgccctatctgtcattaccctgtcctccttttgcaaagataactactgttctaacatccaatgctatggagatggttttaaaactaaggcatagttttgcctgtttttgaatttagtataaatggaattaaacactatgtgtcctttggtgtctaaattcttccacttattatatttttgagatccatgttggtacatgtatgagtattttggacttttttgttgctatgtagtatgccactgtgtgaatatactacacacatactctcccagtttggggctttgtgaataaagtgctgtgtatattttatacctgccttttggtagacacatttctaccgtcatttcttttgggtatatacccaagtggaatataggtcgtgtgtgtgtgtgtgtgtgtgtgtgcgtgtgcacgtgtgtgcctgcatgtgttcctgggttatagagtgggtgtatatttaactgtactggaaattgtcaaacagttgtccaaagtgattgtacttggaaaactttgcatttccactaggagtgcataagcattccacttgccccacatacttagctattaatagtgtttttaattttggctgttctggtgagtgtgtagtgataattccattgtggttttaatttgattattgatgagatttggcaccttattaagtgtttttggcttattagccatcttcttttttgtattgtctgttcaggtctcttacccattttttgttttttctttcccttttgagttgcctttttcttatacatttgtatgagtttttgttttttattaagcaccttccattcgaggatgcataggttctttatatagtctggatatgttctcttcttttgcctatgtgtgttgcagatattttctcttactttgtggcttgcctttttcctctcttgtcttttgaaaaacacaagttcttagttttaatttagtccagcttatcaggccttctcctttatggttggtccttttggtgtcctgtttaagaaaacttttttgactctaaaagtgtgaagatattttcctatgttctagaagctgttattgctttgcctttcatgttccctctgcaatccaccttttcttcctgcatggatgtccagttgcttcagcactttcccagtactcttgtgttctcttctttattacacatcaagcacccacttaggctattgtttaaaaaaaaatctatttttttacattgatcagtttgtttatacttgtatatacaccagactatattaattgctgtagttttagactatctggatatctggaagaacaagtccttcctgctttatttcttatagatttttttctataggttttttttttttttttttgagacggagtcttgctctgtcgccaggctggagtgcagtagcacaatcttggcttactgcaagctccgcctcccgggttcatgccattctcctgcctcagcctcccaagtagctgggactacaggtgccagccaccacgcctggctaattttttgtatttttagtagagatgaggtttcaccgtgttagccaggatggtctcaatctcctgaccttgtgatctgcctgcctcagcctcccaaagtgctgagattacaggcttgagccaccgtgcccagccttacaggtttttttttaatagctttcttatcaaagtaaagaagttgccttttattcctaatttgctgagttctggttttttaaaatcatgagcagatattaaattgtatcaaattttttttctgtatctattgatttttctccttattcacatattaaagtaactttacatttctggaataaacccaacttagttgtaatgtgttatcctttatataaattgttgcatttgttttgctaatatttagtttaggatttttgcatctgtgtttgagtgagattgccctgtatttttctttcctcttaatgtcctggactggctttgatatcaaagttatgatgacctcatacaatagtttgggtgctgttctcattttttctattctcaggaagaatttctatcagattggtatttttttctaatgtttggaagaatttacaggtagacatctgttcttgagttttctttgttaggaaggttttaaactatgggttggatttttttctactagctattggatatactattttttattgcttatatcaatgtagataattttttctcctaggaatttgtcatctcatctaaaatttcaaaaatattggtataaagctgtttataatagtcccttatgaccttcgttttattttgaaataatatcaaacttacagcaaataacttttgctaaattacccaagagcaagctcagccatgatgtcccaccaccccaaattcattactgcaattcagtttgaagaccctatttattttttaaaaacagctttctgaagtataattggcatacagaaatactgtatttaaaatatataattttaaaaattaatatacattcacctataaaatcatagctataatgaaaacagtgaacatatttatcatcataaaagtgtctttatgcccctctctccattgtgagttaatttttgaatatgatttcagatatggattcaaggtcattttttgcatatgtacatcgttttgtaaccattttttaaaagactatcctttctgtggttgccttgaacctgtgtcaaaaaacagttgtccatatctgcatacttttattttgagacttttaattctattccattgatgtatttatttttaaaccagtaccacactgtcttgattattgtagctttgtaagtctttaaattaagaagtgttagccctccaacttgttctttttcaaagttgcttttgccattcttggtcctttgcatttccatatgaatttttgaatcagcttgtcaatttttatgcacacacacactcaaaatctactggcagtttgagattgttttgaagctatagatcaattttggaagaattgacatctaaacaatatcaagccttctgacccatgaaataagatatctctcttcatttatttaggtcttttatagccatatttttgtagttttcagtatcagatctttacatcctttgtttatgaaatctctgagtacctcaaattctgaagtttcaatttctaatagttcattggtggtatatagaaatggagttgatttttgtatattgatcttgtgtttttcaaccttgctaaactcacttatttgttctagttgtgttttgcatagattttatattaggatggctctaaaatagactttttttccaggtctagattagctctgcttctaaagcatgacttttctggggtgtctatcaaatgacttgtgcattcaacaaagtttcttcattctggatggttgaaattaaaacatcccccagccttgtaagagctttggtagtatttctttagttaattttgtagagaccctgtatgtatgtatgtacagcttagaatttagtcagagtatcaagggtgccttcatagacatttctttgtctgtgtattttcctcaaattccagctgccactacttcctcagattctgatctctgttcagtgagatcactgtgctttgacgttcccctctctgtcccacagttaagaaagcacctccagacaaaaacaagtgatcatgagacttgctttgtttgtttctttttcctcagggtttacagtgcttgctgcctgttgtctgtctaaaaactgttgcttaataattttgtccagtttaacagctgtttatggtggcaagatttgtctagtcacagttactctttcgtagtcaaatatgatttttaactcaatcatattgtttttagctctgtagtccagttaaatctcaactatgatgttgtgagttcactggaagagtaaaattttaagcaaataatgatgtataacatgatcttgtatatattcattttatgaaaatgattttaaaaaattaatttcaaatgaatgctgtcacattgatggcttattaatttactaaacaaaaaataattacccaagtcctatgacacttgtacctcttttaccaaatatgtttattctgcctagttattggatatatttactgtggacattttattctgtttctttttaaatactttggaagtacagtctttatacttatgtcataagaacgattattattaatttgattgaacttatatcatgttttagatatagccagtttgtactacatactcatgtaccacaagcttagattttattataagataacttgctgtgtaggctgcctagtaattcaaacatcagatggatgattggcctaggtgacttttaaatgcccttcagccttgagattctattattcttcagcaaattaaattcagcagatgtcttgagtgccattttaatagtgtatgttatatacgaaaaattgtctttgagaagcttagaatttcattggtgggataatacgtacgtgtgtgtatgtgtgtgtgtgtagaaatcaaatatgtagaaagaagagagaatatagaaagaatagttaaaaaatgtgtatgattaattacagagtgaacagcacaaaccacgaatgcttgacatgttcagtcagagaaagagacaatatggcagaagtagaatgagaaagaacacatcttgtcatcttgtgtgtgatgatatcagcaaaagagggccaccaaagcagcataaaggagaacacagttgcaggagcgtcagtagagagaccagcgtagcagaagtagaaagttgtttggccttgtttttaaaaatatgtggctaagttgttaactattgcaattttatcaacagtgacatttccttcagcaagtgccagcatggtgacagcattggctgtctagatctggaaatcttacatttgtatgactaaggtgccgctagtaataatgtcttaatgttgctgtagactaaaattttttcatagaaaaatcctcatctgtatcatgagatacatctgtttgagaaacagtatgaacagatcagccatctgaggtctgccttgttggagctgctaggtgctagagaaattcttttgagtgttatagctcttctgtctgtttgagtctagtagattctagtcttttgtttgtgtttagcttttaagggtcaaggtcatactgaggttaaaactgtcttgttgggttgatattaaaatctggacatagtattccatgctgacttttaattctggtattggaagaataattcaaagcatacttgtttttatttaatattgttcaaataaattcaaatttaatacacatataccagaataaaaagtttagataaattttctacaaaatggtaaaaccactgaaatttcttaccattggctgtgaactaaacagattatagaatatttctgtgatttagtttattactaaataggaaatatgtatgaagacatctttgagtatgaaaattctaaatttcagtatatcatagattttagtttttaaaattatagaactgtattttttgtctttttttttttttttaaatatggaacacggtcaggtacagtggctcacacctgtaatcccagcactttgggaggctgaggcaggaggatcacctgaggtcaggagtttgagaccagcctgaccaacatggtgaaacccagcctctactaaaaaatacaaaaagtaggcatgtgtggttgtgcacgcctgtaatcccagctgcttgggaggctgagacactagaatcgcttgaacccaggaggcagaggttgcagtgagccaagatcacaccactgcactccagcctgggcaacagattgagacctgtctcaaaaaaaaaaaaaatagataaataaaaataaaatatggaacacttcactaatttgcatgtcaccctcgctcaggggccatgctagaactctactttaatattgcatcattttgtttgaagcaataccaaacaaaagctgaaaacatgattaacagatagtaaaagctttatgtatatgtcttcattcatattttctaaaatcattgtttaaaaaatgcttgtttagtaagcatgctaaaatccttgcttatgtgtgttttttttttttttgcactggcttatttttgaggccggctgggagtgttcatgtaaaacaagagagaaattccaacaacagagaagggggaggctggggcggggggacagataaatgcaattttacttgacaacagagttgaatgtgagtgtgtaaaatttctgccataacataaaacagatttgaaatcttaccaggtaaaatttaaaatgtggataatacttgttaagtgccacattaagttatttacaatatttgatccctagagaaacttagaaaagaacttacggggattattttgctgcttgtattctgatcacttcattattaattactgcaggatcatttctatagctaatgtgggattttcctcagatcttcttaaggccatagtcagaaccaactgaatatatatataagatgattgcattatttttattggagaaaaattgaagcaaatgaaattgttttaataaagaatataagactttctccctcttttatcttgttaatgtatattttattctttttaacaaggtagaattttggctataaaacatatactgtaatatatgcttttggaaaaagttttaaatgaattttcagggctgttggtgctgtgaaaatagtacatgtacttctgtggttgttttagtgtcttttttgttgatttttggcagataaaataacacaagaagatattgaaggcattctacagaaatttactggaaatataatgcaagtgccccccctgtaagttcaattagtaaatttggaaaaatgtttacttttcttttccaatggttaacatcactctagttaaaatacacgagtttcctcttagcatatggcaaggcaggttttaaatctgatgtgccaaatgttaaagtgaaggtgagacaggatgtggagcttttgacactctaagaggcagtggaatgtggtcttctttgtttctgagtgtggccccagcctggcatctgtgctattacagtgtttattggcttttctgattctatcaacagacataagggcagttaaggagcccagagatgtctcttttcctagaactgttgtgaagggaccagtcccgtctgggagggaagtcagagctgtgagtcagagtcctaatgtgcactgcatgtcaggtgctgggaccattcctattgggcacaatcttttgcttcactattctctgcagccagcgaaaccgatgagagttacaacttattaaaaatacaagtatattgctttactgcttgtcttagtttgggctgcagtaacaaaataacataaactgggtagcttataaacaacagaaatttatttctcaccattctggaggctgggaagtcaggatcacagtgcagtgggctcagcgtcgggtgaaggcctgctttttcacagatggcaccttcttaccgtatcctcctagtagaaggggcaaggcagctctctggagcctcctttataagcgtactaatttctttcatgagggctgcgccctacgacctaattacctcccagaagaccctacctcctaatatcaacaccttgggggttaggatttcagcatataaatttggaggtttggcattcagatcataataccatgtagccatattttcgtgcacattaccatttcaagcaaattgcctcttttgaaaaaaatggctgaattggttataggatatgtcagggtaagtttctgactttttttttagaatttagtatttattttgtatttaaaatcttgagtttttttcaggaacattgaaatatctctgaggagacgctttttaatgattttgcctcaaatgtaaaaatttaaaaattttagcaagatctgcataaacgttattttggatcattgttaaatttatttatatttatgtataagaattgttttaatattttctgtgattattgcaaggattttgttttctagtaaaattttatcacgaaaagctaagatacgctaagtaggttatttgcttattagcttcttagaaatgttttggtaacttatataaaaatgaatattatagtagagattgtttcaaggaaatatagctgagagtattatgaccagagtctactaaattccttgtgccttttaacacagaatgaggactagtaaggacaagacatgaatacattgtctctagaaagatgattaaagaataaaattggtaacactgcatattgtgtgccagaatgaggttatatcagccttagaaatatttagaaactctatccatgacagcattatggagtagattagaattaaaaattcattcattttttagaaggattttcattgtgaagcactgccagtcatccttcctttccatgctaaatctgaaattatcatctcccaatccttccaaatccctctcaattcttgctctcctttccttccatttctccttctctcatctcacaagctattctgcattaaagaaagatggacaaagactttcgactttgatgaagagaggtgaagtcgtagaagcaaaacctgccaggccagtgactgtatacagtatctcccttcaaaaattccagccaccatttttcacattaggtaagatggagaaatttgaaatcatttgtatttacgtgtatttttaatttgtatttggctacttttgtgtcattttaatagatccgtaggatgttggagattttttaaaatttgaatttaaggaaagttaggatttctttataccttttttggtaacacatttaatgagatacctgtagctatatggaggttcagaaatgcgtttctaactgggctgactttttcatatattgtactatgttatcttactagaaagttgaaagtaacatactttagatctctatagagaagagtaggtaaggagtgtatatactttttaaattttaggtttttattatcttttggatgcttttcctcccattttggctagtacctaatacattccgttttagaactgacattaattttccaatgaaaacaaagcatttttagtttttggacaagaaacccctcactcccttcttcaccacctatcacttactattaaagatcctgcaaatatggaaaaacatgggtaaggcagaaatgtattcctgaatacatggtcacatttttaattcaagttatgaattttaatttctaatatatatttgaaatgtaaagactaaaaagttcatttctgttgtttggaaattttatgatctggctgcagaaagttgtaaacatgtaagatctgtgaagaatccaaagccgtggttcttaatcctcagactcctttaaattgagcctacccttagtttcacagtgcactgaataggattccgtttagaaataatgtccccaaatcttttaatctaaactctattgcttttttattggcattattgttttatctgtgttgtgtttctgcaggatatggttttgtaccattagaaaaaaaaagtcactttgtttcttcatgttcctgcttctaaaatatttgacagataatgaaaaaaacacacttaggaaggttgtgctccattccatggaaatgaagcagctggtttgacacagtagatattctctatgaaagcaagaaaaaactcagatttttcagattgcatttaagtcagaaatattttattgactagggagagtgtaacgggccaaaagagctgtcttttcactcaagtcaaatatcacgcaagagtgctagcgcgcctgcatttcatcccagtgcccactttcaatttcagcagtggcccccaaccatgagctgactaaagaaagcagggggtgattaaaatccccaggtggtgagttttgattaattcccccaaatggctttatttgtaccagtaagactcgaagcagctagaatatagtccttttgtgtggaaatgtggcagctcttttcaggaagtcttgctgatggataaaaataatggagagctctgttcttaaccaataaacttgtgttagattgtgttaagaagatatttagatttacattcagttctgggacattgtgcaattttaagttgttttatgatttcttcaggagtatttccaagagaacatttaaataaactgagttcttcatgtgtagtacggtaccctaaacataattcttgtcactgtgaaaaggggtttttggttggttggttggttggttgtattttttttgaatgtacaagtcagaaaatattttaaaaatctaccgctcatgatggcaaagctgccatttctaaccatttacaacctattaaatgaacaaggcatataaatctgaaaatattttttaaaatctcaagctcatgatagcaaagctgagatttctaactatttaaaacctattaaatgaacaaggctgaagtattaaagtggtatgccttgccagttaatttaaaatgtgttcatgagtttgtgctgtttgctttctccacactctgacttttcagtctcacaaacacatatgctactggatgaataatttatgttttagtgcataaatattttatcactcaattgtttgcatagtgcatttttacatttgtttagggacatcatttctatgtaaagtggatttcataggaggttagcaatttactatgtcactgttaacattccagatgttgaatgtggaggaggtttttatatcagaagcttggtcagtgacattggaaaaggtaagcataaaaatgaattatgaattatcatttagagaataatactccttttcaattggaagagggaattttccgtttttcttatttctgagtactggccttaggaactgaactcttgctgccttcagctttaaaagcattgtaggtttctggcttgcaattatcagcctcagcagctgcagtgaaatgtttgtaatgggaaagaagagaaagagagaacagaaaacgaagacaggaataatgaacgtagggccaacatcttttcaagtacaaaagattttaactcaaactagggatcaaaaaaaaaaaaagatttaaccttctaaaagttattttcaaatttttttaaactggaagccgtagtcttataaacagccagaaggtttcggttctggctgtgccatttactggcagttgtcgcactggacaggtcatatgatctcatctgtaaagtgcggctaatctttactccatggggttggctgcatgagttaaataacaaaaatgtgtgcaagttctttgttgattttaaagcagcttataaggtggattattaagtattattttgctacttaatcatttctttatctgaggcctcttggttcttatattggattattatacttttgggtggttttgagagatttcaattgagtacggtcatttgaacaattacagactatgaaatactgaatcgtttatcttctggattttttttctaccttttgttgccatagaactatcttcctgtgccaatgtgctagagctgacccgaaccaaacagggaccatttacgctagaagaacatgcccttcctgaagacaaatggacaattgatgacattgcacagtctcttgagcattgctcatctcttttcccagcagagttggcacttaaaaaatcaaaacctgagtctaatgaacaggttttgagctgtgaatatataactctaaatgagccaaagagagaagatgatgtaattaagacgtgttgagattggcctgggaatatcatcattttctagttgacatttgaatcctgtgtgcagatgcagaatgacaagctgcattcaaaagacaaacaatatgtcttttttttttttgcatgaagaaaaatgtctatcatttacagtttcaatagcacataatttattttctatgcattataaatggccttgcagttggctcagttgtttgttgtgttgtgaaatgttttaggattttttgtattgtgaaaatatgaatatgattggattcagaaaaattaactttctgaatttgatctgtcttcagtcttgtgaaaaagttgaacaaatttcctaatcaaagaaaaaagtatgagctccatgtttctttagtttcacaaaaatgaccataatttagtgttatttttactttatttaggcttcctggtggcttcattttattgaaattctttaaattgtttaaagtggccattattgatctctttcttctgttttggagagtttattattaaaaacatttctttgataaaatggccatcatctagtaatacctgtgtttgtttagatcttggaaatgaataagctttgataatatttgtaaatgaaccaaattattactgctaccactaacaggttgtaaatagaagactaatacttaattaaagtcaccttcctaccattagagcagaagacagctcctatagttttgtattttggcagctatgagatattttcatggtaatgtcaacatggtcaagcactttgtaccaagttattaagtaacataatttttaaaatttaaagaatgtgtcttcaactaaaaactttattctttagcatttatttatatttctctgtagggtgttccctgtgacattgtctctttagtttgctctttcaagagatacttacagatgttgagatggctgccctgcatttccagctaatctcttctgctctaaatatttaaaaacagttcttctcaaacattttcattcagatagctttctgaaagttccctatccctctttaccataattttttaaatgtagccacattgtaatagtaaacttcatatataatgagtgcttcatatttttgttatgggaaagcaatatattatgcagccagtctgtagaaacattcagatccctcttcctttactcaaatacagtttcaaaaggaagactcatgagaaatttcataaaatacaagtttttagatgtttatgctttgcctttctttttaaaggtgttttcctgctttgtagtctctaactctgaaatttaaaatatgtaaactaaagtggttttatttgtgcttaacccaatttaaactcaatgtaaaatgttatatatgcatcagtacagcattttcaacatattggcaacatattttaaatgaaaacactaaaacaattcttagtatgagacaaaactgtaaggaaaaagagtgttaataccatgatgcattaacataaaatatcaaacacacaaagtcataaaatgaaaatttacagttttacctgttcatatctagtgccccacagtgtgtgtcaaccaaaggtggcagtggctacatctgcctgttggactggtacaggttacaatatgtcctcttccattgcaaattaaagtccaaatagagaaatacttaggttttagaacacatcagaggtatttctgctgtatttttcaccttaaaaattgacacagagtttactaatagaggagtagagattgttgaccatttttaaaaaacgatagccactctttttcttttatgtttaaaactgaagttttgccaaatgggaaaattactgttacctctaccatcttaatgtagtaactttagaatttaaatttttatattactattttcctttttgttgttcacatagtcttaaggcacctatacttttaaattgactttttcatttgatattatctatatgtatgtagttgtgataatgattattttaattatattactttatactcttaatttatttagagtatttctctattgctgaatacttaagtagttttaaattttattatgataaattcctgggagggggattatttagtgaaataatatgaagaactttatgacttatgtttgccttattgcattcccaaagagttgtaacattttacagtgttaccatttgagtaggggttttatatgttgttgctaatttagtaaacataggagagaaatcaaagtttttctgatttgcttttatgtgatttatctgtatactttgttcatttatataaataaatgtcttaatggtttctatacata

SEQ ID NO: 997 - DNA, 78002 bp, Homo sapiens
agttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagtaagtgccttcgccggaccccgaacctccagccctgcctcgctcccgtcgcggccttccccgcccccctcgcggcctcccccgcccccgtcgctgcctctgatcccccggccgtgagtgaacctcagcgcgcggcgggagcgggcgagagtggggcccgcgccgcgccccctccagccccggggcgccccgggagagctcgggcccgcgcggagccctgaccaacggggagctaggcatttctcgagcgttccagatgtccgcagcgacttctgatccgctgctcagcacgaacattttcacaatcagttatgatgcccagcaccattttcttgggataatatttaaaaatcagaaattgtccaagttacttatgaaatacatgcgcattgtgaaaaattcacaaaagtgtaaaggttcagttatgatctatgagtgcctctctctttccccatcctcttctctctagaggtgaccccttctaacatttatttagtcatcatagtgatgttaataagtagagtttatgatggacttgctaagtgccaaacactcttctaagcgctttatgtcaattttctcatttattccctacaacaactctgtgagttgctagaattattatgctggatttacggagagaaatcgaggcgatacattgaagtaacttggccaggattacacagtagtaagggccgagttatgattccaaatcagctggcacattctggagccagtacacactccagaatgtgtacttttaacgaatttgctgtgttgtatttgctaggacaatcttgaattgagaaatacaaaggtgactttaggttagatagaaggacgtttttatgtggtgaggataatggatttttttctgatcggttaattcactgtcagcttttgtgcgggaacatcgctttggcttgtttgaagctcaaggagcctaagaagtttgcttgctaaggtgaaggtactttcttcgtactggttggtgtttattacattcttgcctgatataaaaagcaatgggtcacagtgtaggggagtagcaaaagtcacttaatattggggcaggcttctaacaacatgcaggtaacagtcattaagaaagtcagcttcttagtcttctagatacttaatatgaagtttgctggctggtttgtggctcttgaatattgtagattactgatattgttaggctgatagccaaaatctaggtgaaatttctcttgggctctaaggcaaaggtaagactggttcaccttattaatgtattctaggacaatttcctggaattttaaacacagcatactttcctttttttttttttaaaaaaaaacttactattactgattaaaataaatgtcccttaaaactcaatgtaaaaatgtatatttttaaaatggcactttaaaattttaggtagagtctatgatttaaattaactagtaggttttggaagtgaaatcttaaagtgaagttttatgaaacttatgcaataggttgaaatttttctagggtttatactttaaaggtagtatagtaatgtagttttaaaaatactttttaaaaaaattaggagagatgctgattaaaagtttaaaaagtgtttcaagatgaggaaagagatcttaatgaattctgcttgttagttgtttttttttgcttgtgttcttaaacgtttgctatgacagtagaattcagcgtctttacctagcaagagagaattttgaacatgtaaactggtagtcagcagtgaaaaagcctcatccattttttacattttttttacataaatagggagagtgcctgatttatatgtagggatattggcttttgtgtgggtgggtttgctccgtttgtctaaagaggacaaaatttgctgcagtcctgagaagcttcattttaaagtagcggaacttgttaatcagctggatcagcagcctgtgacctcactagcagatgttgtcccagttaaaaagatcacagatcaagttaaaactagcttaaataacattgagaggtggtgttcataaacaaaatacattagtgagtagaagaagaatagatatttgatgtagatattgttaaataacaataaatcctgagctaatcactgagtattcatcttttccttggaagctattatttcctaggactcattgtactctattgggtaaatgcttttgcatttctctgtggaatacaagctattaattagagtaaatataactggtgtaacgatctgtgtttttattatgtatactcttggggataaagaacacattggtatttaatgttaaagagaaggattatgtatagtagaaaagaattcttcttggtaaagtacatgcaaataaacctatgaaaggtttatttgaagatagtagcttgttttacctggcatttgaagtaataacacagtgggaaaggctttaactagaaaatctcacttcactaactatcttgaaaatctttttctaaactgaaggatagcaaccttacaaacagacattaaaaatgattgatcaatcttggtaagcaggtgtcaaaattaattggttggctccatggtaacttagctttttttctactatagggatttcgccagggaataaaaatgttcttcaaatgtttcttgaggatagaagattgatagttgggggaagaaatgcagaagcaaatatagtatcaaaagtggtacttcagttctcttagcattgattccagtcttctgttttcatttgaaaagaataaagcactcagaataacaagccattccttccttacacaggtaaaacaaaaggaacattgatttttcacccaaagctagactaaaggacttgggattgagaataggaaaatatatttgaaatataataatcaaagatacagactctaattcaagttgtatttatttgaatagttcagtgtaatgttaagcaagaaaatattctgctataatctatttgaatgacgttctcttttagaagggagcccttgagaattaattttgtagagtagagatttatataaatttatataaatataaagagtattgctctttatattagtcaaatataaaggggtatatttttacccctcttaggttagtcaaatttggatacttcatttcacgcatttaaaatggaagtatgctgggtgccgtggctcaggcctgtaatcccagcactttgggaggccgaggtggaaggatcccttgagcccagaagtttgagaccagtctgggcaagatagtgagacctcatctctacaaaaaatattttaaaagtagctgggcatggtggcacacacctgtggtcacagctacaagagagagtgaggcggaagaattccttgagctcaggaggttgaggctgcagtgagctgtaatcacgccactgcgctccagcttgggtatcagagcgagactcttcttaaaaatttatatatacatatatgaagcattctatttgtagtgacagcaaaatgaagatgtaatgatataatgtcaggaattaggttgttattatagacaaaaacgggcagaataaagtgtgtaaactcttcccctaagctgttaaaaatatatgcatattgcctggcttggtgtctcacgcctgtaatcccaactctttgggagaccgaggcgggcggatcatgaggtcaggagatcgagaccatcctagctaacacagtgaaaccccgtctctactaaaaatacaaaaattagctgggtgtgatggcacgcacctgtagtcccagttactcaggaggctgaggcaggagaatcacttgaacccaggaggcggaggttgcagtgagcataggtcgcgcaactgcactccagcctgggcaacagagcgagactccgtctcaaaacaaaacaaaaataaacaacaacaacaaaaaacaaatatatatatatgcatatgtaaatacatatatatttggaatcctttttacttgtaaggaaactgacagtaattataaacttaaactgaatgttccctgtccctaagacttctttatttcaaagttttattttaatggataatttatatccatggattatttttacattattaaagtgtataatcacacagtaggaatttaaaataatttaaattgagtgtttcttagattctaaattgataaggtaagttacttgtagaagcatagtagcatggttttcaagaacacgtgtctgcatgatttggcccctttagctgattagactcaggcctcctttcctctgccctgactggccttttgaagttccttgaaagtgtcacattccttttggccttagtgcattttatacacgtaactgtgaactctttcctctctggtctttgcttgggtgattactgatcatccttctaatcttagcttaaatactagtttcttttttttttttttttttttttttttttgagaccgagtctggctctgtcacccaggctggagtgcagtggcgcaatctcggctcactgcaagctccgcttcctgggttcacgccattctcctgcctcagcctcccgagtagctgggactacaggcgcccgccactacgcccggctaattttttgtttagtagagacggggtatcaccgtgttagccaggatggtctcgatctcctgacctcgtgatccacccgcctcggcctcctaaagtgctgggattacaggcgtgagccactgcgcctggccacttaaatactagtttctaaaggaggcttgtctgactcttcacactaggttaccccttatatactgccctaatagcactatttttccttcttagtattgtcaaaaatgaggtgtttaattataattttgatagttatttaaacaaaatttttaagagattgaggtataattgtcaaacagcacaatttaaaatgtacaatttatttaaattatacaatttgataagttttgtcatatgtatttgcatctgaaactgtcaccacaatcaaaatcatgaaaataccaatcacgctagaaagtttccatgtgtttcctttgtaaaccctcccttttctagttgccaattcctgtcccagggcaactattgatctgctttctctcactatagatttgttggtattttctagaactttttgtaaatagaatcatacattatatacttcttttttgtctggcttctttcacacagcgtgtttattttgagattcattcatggtgtgttagtagtttattctactgccgaatagtgttccagtgtctggatacaccataatttgtttatccattcaactgctgatggacatttggattgtttcaaatttttggctgttccttataaagctgctacgaagtttcatgtggaaggctttttatctttgtatggtcatatgctttcctttctcttggggaaataacctgagaatggctggatcatatgggtagatatatgtgtaactgttaaagaaaccgacaaactgttttccaaagtagttgtatcatttatgttcccaccagcagtgagtcagtgttctatctagttaatttcacatccataccaatacttggtatggttagtcttttaaatttttgtgattctaataagtgaatggtatattattgggttttagtttgcatttcccgaattactaatgatattgagtatcttctcatgtgcttacttgccatccgtatatcttctgtaataggcatttattcaaaccttttgcatgttaaaaaaattttcttactgatttttgtgagttctttacattttctggattactagcttcttatgaggtatatcatttgcatatattttctaccagtctgcggcttgtctatgaaaacaatgcaaagagaatgaaatctcttgacagtatttttcaaagaatctaagttttaaattgattaattccagtttatcatttttttcttttatacttttcatgttgtgcctaagaaaagtttgcctaggctgggtactgtggctcatgtgtgtaatcccagcgctttgggagcctgagacaggaggatcacttgagtctaggaatttgagtgcagcctgggaaacaaggcaagacactgcctatacaaaaacatttgaaaaattagctggtcgtggcggtgtgcgcatttagcccatctacttggaaggctgagatgggaggatcactttaacacaggaattggaggctgcagtgagctgagctgtgattgtgtcactgtactccatcctgggcaacacagcaagaccatgtctttaaaaaataaaaaataaaaaaaaaaagaaaactgcctaaaccaagttgatgaagattttcttcattttttttctctagaagttttgtaattttagattttacatttatatttatggtccattttaagttaatttctatatatggggagaggtatggatctaaattcagttttttggcatataggtatttgttttagcactatttgttgagaagagtattctttctctgttaaagtagctttgcacctttgttgaaaccattcatatatttgtgtttctatttctggactctgctttgtttcttgatctctttgtctatttgtatgtcagtacaacaatgtcttgattattgtttctttgtaagtcttgaattctgggagtgtttttcagttttgttcttttccaattattttggctactctgagtcctttgtatttccatatgaattttagaatcagcttgtcagtttctataaaaagcctactaggattttgtttgtaattatgttgagtctatagatcaattttggggaaaatgaataccttgtcagttttgagtttcctacatggtatatctgtttatttatttagttgtttaatctgtcagcagtgtttttaaatttctagtcaatagatcttgcacctcttttgtcagatttttccctaagtagttaatatttttggatgctattgtaaatggcattttttaaactttcacttttgattgttgctattatactgaaacacaactgatttgtgtatgtttgattttttatcttgcaatcttgccaaacttacttattacttgtggtagatttttgcagattccttatggctttctacttagatgattatattgtttacagacaaagatatatttacttctttctttacaatctagatgcctttttttttcttgccttatttcactggccagaacctctattacagtaatgaatagaggtgatgagagtggtcaatcttacttaagatttagggggagatatttgatctttaaccatgaagtatgatgttatctgtaagttttttttttagatgccttttatcacactgagaaagttcccttctattcctagtttgccaagagtttttaccagtgatggaaactggattgtattaaatgcattttctgtgcccattgagataatcatatgattttttcaagtttgttaacatggtgaattatgtacataatttttgaatgttaaaccaaccttacattcctaagataaacttcctctgacacaatatgctttcctttttattttaggttggatttggtttgttaaagttttatttagaatttttgtatctgtgttcatgagagatattagtctgcacttttcttataatatatgactagttttggtgacaagataatgctggcctcatataatgagcaccatgggactctcctgatcatttgctgaaagagtttttagggaattggcattatttcttcattagtgtttggtggaattcaccatcgacaccctctaggcctgaagttttctttaactccaaattcaacttttattaatatacattcaacttatttaatatacagaaggctatatgactagaatcctttaaaatttattggccagaatattgtctatcttggttaagtatttttttgggcgtgtgaaaataatgtgtattcttctattgatgggtggagtgttgtatacatttcagttaggtcaacttggttgatagtcttgttcaagtcttctacaaccattctgattttctgtctgtttttaccacttattgagagaagggtatcttcagttataattttgtatttacctgtttgtccctgcagtcttatctgtttatccttcatgtattttgaaactatgttattaggtgcataaaattttggattatgtcctcctgataaactgagcctttatcgttatccaatgaccatttgttgaaaagactatccttttttcattaatgtctttgtacctttattgaaagttaattggacgtctttatgtatatttattttttgactcttttctgttccattgatccatatctctatccttttgcaaattcctcactttattaatgtatgtatgtactttattaatgtatgtatatgtgtatatatatatatacatacatatatttgagatggagtctcactctgttgcccaggctggagtgcagtggcatggtatcagctcactgaaatctctgctcgtcaggttcaagcggttctcctgcctcagcctcttgagcagctgggattacaagcatgtgccacctcacctggctaatttttgtatttttggtagagatgaggttttgccatgttggccaggctggtggtctctaactcctgacctcaggtgatccacccacctcggcctcccaaaatgctaggattagtatatttttacagtaaatcttgaagttagataatgagattcccccaactttatttttatttttgaaaatttacttggttcattttgtttttcatatacattttagaactgtttgtcaattaaaaaagtcttgctgggatttttattgagattgtgttgacttagtaaatcattttgaggagaattgatatgtaaataatattgaattatctcgttcttcattgcagtatgtttttttcatctatttgggttttcattgattttttacaacagttttttgtagttatcagatacagattctgtgtatatatttttagtgttttttttttttttttgagatggagtcatgctctgtcactcaggctggagtgcaatggcatgatctcggctcaatgcaacccctgcttcctgggttcacgcgattctcgtgcctcagcctcctgagtagctgggattacgggcgcccatcatcacgcctggctgattttttgtattttttgtagagatggggtttcgccatgttggctaggctggtctcgaacttctgacctcaggcaatccgcctgcctcagcctcccaaagtgctgggattacagatgtgagccactgcgcctggtcatattttttgattttataccaaaatattttatgttctttaaggctattgtagttggtagtatttcttttaatttcaatttccagtttgtagactttaaaaaaataatcagggaaatctttctttggtgatatttcctcgcccatatctctttattttttatttttgtggttacgttataggtgtatatatttatgggataaatgagatattttgatacaggtatacaatgcctaataaccacatcagggtaaatagggtattcattacctcaagcatttatcctttctttgtgttataaacaattcatactaattatactttctacccattaaccatccccatttcccccactccaatacctttcccagcctcaggtaaccatcattctactctatctccatgaattcaactattttaatttttagctcccagaaataactgagaaaatgcaatgtttgtctttctgtgcctggcttatttcatgtaatgtaatgatgtccagttccatccatgttgttgtgaatgacaggatatcattcttttttatggctgaatagtactcccttgtgtatatgtaccacagtttatttatccattcatttcttgatggacattttggttgcttccaaattttggctgttgtgaatagagctgcagaaaacattgaagtacagctgtctcttcaatatactgatttcctttcttttaggtaaatacctagcagtgggattgctgaatcatatggtagctctatttttaattttttgaggaacctgcaaactgttctgcatagtagttacactaatttaccttcccaccaacaatgtaagagggttcccttttctctatatccttgccagcatttgtttctgtctgccttttggatatgagctatttaactggagtgagataatatcacattgtagttttgattttcatttctctgatgatcagtgatgttgagcatctttttatttaccttttgacattggtatgtcttcttttgagaaatgtctattcagatcttttgcatatttttgaattggattattagattttttttcttacagcattgtttgagcttattatataatctggttattaatcccttgtcagaatgatagtttgcaaatattttcttccattctgtggatcgtctcttcatgttgttgattgtttcctttgctgtgcagaaactttttaactcgatatgatcccatttatccatttttgctttggttgcctgtacttgtggggtattactcaagaaatctttgcctagtctccaggtgtcctggagagttttcccaatgttgtagtagtttcatagtttgaggtcttagatttctaagtctttaatccattttcatttgattgttgtatatggtgagagataggggtccagcttcattattcttcatatggatatccagtattcccagcacaatttattgaggagactgttacttccccagtgtatgtgcttgacacctttgtcaaaaatgagttcactgtaagtatggatttattctgggttccctattctgtaattgctctatgtgtcctttttttttctcttttttttaatgccagtaccatgctgctttggttactatagctctgtggtataatttaaagtcaggtaatatgatgcttccagtattgctctttttgcttagaatggctttggctattctgggtctttttggctctgcatacattttatgattttttttctatttttgtgaaaaatgtcattggcattttgatagggattgccttgaatctgtagattgttttggatagtatggacattttaacaatattgattcttccaatccatgagcatgaaatatctttccattttttttggtgtcttcttcaatttctttcatttttcccctgcctagaggtttgtggaactttgaacttcagcgagatgatttaaggtatctggcagaagaaatttctaagcagcaaagcattcaagatgtgacttgggtgctgttaaaggcattccattctcaaagggaaacagagcataaaaatttgggaaatgtacagcctgacaatgatagaaaagaaaatcccattttctgaggagaaatttaagccagctgcagaaatttgcatgagtaacgagaagccaaatgttaatttccaagacaatggggaaaatgtccccaggccacgtcagagatcttcggggcagcccctctcatcacaggcctggaggcataggaggaaaaaatggttttgtgggccaggcccagggttcctgtgctgtatgcagcctagggacttggtgtcccttgtcccagctgctctagctatgactaaaaggggccaaggtgcagctcaggctgtggcttcagagggtgcaagctccaagccttggcagcttccatgtggtgttgagcctgcgggtgcacaggagtcaagaatcgaggtttgggaacctctgtctgcatttcagaagatttatggaaacgcctggatgtccaggcagaagtttgctgcaggggtgggactctcatggagaacctttgtatgtcagtgtggaagggaaaagtggggttggagcccccacacagagtccctactggaacattgcctagtggagctgtgagaagagggccactgtcctgcagaccccagaacagtagatgctcctacaccttgcaccatgtgcctggaaaagccgcagatgttcaacgacagcccatgaaagcagccaggatgaggctgtactctgcaaagccacagggtcggagctgcccaagaccatgggaacccacctcttgcatcagcatgacctagatgtgagacctggagtcaaaggagatcattttggagctttaaaatttgactaccctgttggatttcggacttgcataggccctgtaacccctttgttttggccaatttctcccatttggaatggctgtatttatccaatacctatacccccattgtatctaggaagtaactagcttgcttttgattttacaggctcataaatggaaaaaacttgccttgtctcagatgagaccttgggggtgctgaaatgagttaagactttgggggactgttgggaaagcatcatttgttttgaaatgtgaggacatgagatttggaggggccaggggcagaatgatatggtttggctgtgttcccattcaagcctcagtttgaattgtatctcctagaattttttgatgtgttatgtaaaggaattacccagcgggaggtaattgaatcatgggggccagtctttcccgtgctattctcgtgatagtgagtaagtctcaacaatatctgctgggtttatcaggtgtttctgcttttgcttcttcctcatttttctcttgccactgccatgtaagaagtgcctttcacctcccaccatgattctgaggcctccccagccatgtggaactgtaagtctggttaaatctccttttcttcccagttttgggtgtgtctttatcagcagtgtgaaaatggactaatacacttggtaatttataatgaatagagatatattggctcatgattctggaggctgggaagtctaagatcaagaggctgacatcttgtaagggctttcttgctgcatcatcctgtggcagagggtaaatagagggtcaagggataggcaaaagcattcaaatctcatccttttataaggaacccattcccctgataatgaactcactcctgaggtaacagcgttaatgccctcatggtttaatcacctcccattatgccccacctctcaacactaatccagagccttcactcagtccagcaccaactcaaaagtccaaagtctagggtctcttctaaatcagatgtaggtgagactcaaggcacaattcatcctggggcaaattcccttccagctgtgagcctgtgaaatcaaaacaagttgtttacttccaaagtgcaatggtgagacaggtataggatctacattcccgttccaaaagaaaaaaaggggtaacaggccccaaataagtccagaacccaacagaacaaacaatgttaaatctgaaagctagagaataatcttttttgactttatgtttcgccttctgagcatacttggatgaggattgggctcccaagacctcaggcagcccagcccttaggctttgctgggctgagcctacatagcagctctcatgggttggaggctcatgcctgccgctcttatagtctgaggctgcacatgggtgactctatagttctgaggtctcagaggcagccctgctcccatggccctattaggcattgctctagcaagtactttatgatgagtctgctgctgtagcatcctttcagatctacattgaggtagccgcatctccacaacttgtgcagtctgtgcacctgcagaattggcaccacatggatggataccaccaaggtttatttcctatacttttcagagctgcagccagagacacaccctggtttgcttgaacagtgactggggaggctaagggaagctgtgccagaatgcagggagcagatacttgaggcagcacagggcagtgaatgctgaggtcccatagatgcctttctggaaactgtgatctcaggatcctagatgggaggggcagcccaggagacctctgaaatgccttcaagatctctttctatcttgatgaatagcacgtgacttccttttatccatgctaatccccttatgcaagggttccttggccacacccttgcatgctttgcttttttgttctttacatatacaaactgtgacttttccaaatcattactttctgcttcccttttcataatatgttttgtttttaaatcattctaccttctcgcatctttactatatgcagttaaaagtagccacgcagctctttcaatattttgcttagaaatttcttccaccagatatcctagtgaagtggctacattgtctggggtatataccctggggttcatcatcatgcaccaggaaaatttagggcatggacacacacaaggggtttaggagtagaggtttaataggtagaagataagagaaggagaaacagcctcctttataaagggaggggtctctgatcggaaaggactggctggtggcaaatgtgccgagttttatagtccagtttgaggaggcagtgtctgatttctgtaggggtcacagattggttagatcaggtatgaagtttacatagtgcatggggaaggctggttgccccaccataatcttcttatgaaaatggatttcccagttgatcagcatcatcttgtctgctccttacaatacacatggctggcagagaagagaggatggagccaccattttgaaaatgtctagtccttagttcctgtcagcattcacccatgcaagctctcagcttgcaggctgctccttgttagaaaatgatttggggctgcttttcattgaaaaggaaagccttaccaagcactcccatgcccttgttctctgactaagtaattcctttctaactcccattatactagcttattgctcttaaattctgccttccatgaagcactcagatatgggcacaattcagccaagttatttgctgcttcatgtcaaggatggctattactccagtttgcagtatctctttcctcctttctgtctgagatctcctcagagttccctttactctccacatttctgccaatattctgatcataagcactaatgtaatctctacaaagttttaggctttccctgcagttctcttctgagccctcatcagaatcatccttaatgttcttttcataccaatacaagttttttctagccttttttttttcccaaactctcccagcctctacttattgctgagtttcaaagtggcttccctattttcagatatttgataaagcagtgttctatgcttcaataccagttttttgtgttattcagttttgtgctgctataacagaatacttgagacctagtgatttataatgaataaaaatttattggcttatgattctgttgggaaggccaagattgaggggccagaatttggcaagagctttcttgttgcatcattgcatgacagaagagcaaagagagggtgaagagagaaagagaggagggcaaaagggggtgaaatcatccttttataaggaactcattcctgcaataacagcattaatccattcatgagggctatgctctcatggcctaatcatctctcattaggttccacatccccacactgttgtatcggggattaagttttcaacacttttttggagggacacattcaaaccatagcagagactctgcttcatgtcaaggatggctgttattccagtttgcaatatctctttcctcctttctgtctgagatctcctcagaattgcctcacaattaaatattctgttttaggaggcaatcaacttgttttggttcagcacacatgacctagctcacttttcaaaaaacagagctttactgagttacaatttgcacctcaccatattcaccttttaaagatgtacagttcacttatgtttagcatatttagagagtggtacaaccatcaccattacctaattttaggctgaagagccaaattgtataaacaaattggtatctgtgacttgttaaaaaataatttctagggtatcttatatagtcagtataaaatcaaactaatctgtactttagatgtataaaaatgaatttttataatgatgttttatcataacatcattatatcagtattttaccatcctgagttatcaaagcatattataatttccaaaaatatagaaataaactgaggtaggcaaaactttaagatggcccttttgacttttatccctggtattactgtcatgattatgttatgtcatttgtcaagagggagattatttgggttttcttactctaatcacatgagccctttaaaagcagagtatttcccctgggtgctagcagaagaggaagctaaagactcaaagcataaactggatttgacatgctaatgcttgtttgaagatggagggagccatgcctgaaagtactagagaaagtggcctcttggtgctgagagcgagcaacccctggtcagcaactggcaagaaagttgggacctcattcatataactggaatgaactgaattctaccaacagtgaataagcctggaagtggatgcttttctggagcctctggataacagcctagctcaactaatacccatctgagtctatagggacttctgtcctatagaactgtgagataataaatggatgttcttttaaatttctatgtttatggtaatttgttaccagcagtaaaaacaaatttaggggcatatttagcaatacatcgttgaaaaaagttattctggctgaatttcaatgatactgagttaaccagaaaattaaattaattctttaaacatgatggtcaattgagttttattatctttaacagtaataatacaaggtgattgtcatttattaatttaagctttttataacaccttgtgtacctgtctttgatttctttggtctgccatgaatggttagaattaatgctcaaaatgtttgccataaggttactaattgctgtctggatccacgaaaggaagatgctctggcattttagatatctgatttatttgaccctatttgatgcacagtatacttccagtctaccatttgagccaaaaagtgaataggagaactattttacagatagcataaagttatgaaatgatcagtagatgtgatgaagtttagccaaaaggggaagagattgatcttatcattagatagtagattaatttgaaaataatgattaccatgtgcaagagaagtattccctgattaaaaaatgtttgagttgtatagttatctcagtagctgaagggaatgttgaggaaaaaatgtattaatgagctaaaatcttatttggaaatatccttgttagaattatagagctcagaatcagctgatgttgtagtccatttgtattgctacgaaggaatacttgacgctggataatgtgtaaggaaaagagatttgtttggctcatgattctgcaggatgtacaagaagcatggcaccagcatctgcttgtattgcggggctcaggctgcgtctactcatggcagaaggcaaatgggagctggtatctgcagatttcatatggcaggagaggaagcaaggggtgggagcggccaggccctttttcataaccaactctctcaggaactaatagagtgagaactcactctttactgtgaggatggccccaagccattcatgagggatctgcctccatgacccaaactcttctcagtaggcctcacctctgacattagggatcaaatttcagtgtaaggtttggaggagtcatatattcaaaccatagcagttgagaattaggcctcaaagtcagatagataatggttaaaatatcaactatatcaatactgaattggagaacatctttttcttgtgtggccataatgggctaatatttcacctcaaaattaaattacccactcatttatgggccaagttaggcaactgctgatctgtattgcaaggtaggacaacagtagtggaagatagtagtcagaatgcatttcctgtgcctaaaatagtctgacagtgaatgatctgataaagaagttaggaaaacagttccatttacaatagcatcaaaaaacaaaacaaaaaaaacccaaaaaaaaaacttacgataagtttaaccaaagaggtaaaagatctatatgtagaaaactagaaaacattaatgaaagaaattgaaggtgacacaagtaaatggaaagatactttgtgtattcatgaagtgaaagagtattgttaaaatgtctatattacccaaagtaatccacagattctatgcaatcctatcaaaatagaattagaaaaaaatcctataatttgtttgaaaccacaaaagaccacaaatagctaaagcactgttgagcaaaaagaacaaagctagaggcattacactagctgactggtctttgaaaagttaatggaaaatgcatattatgaaaaaactgcgtggatttcaaattttttttgcaccaaaacaaactcataccaaattgttataacaagtctgaatgggatcaagtttgaggcactaaggaggataagacattggtttgaaaagggcccctatcagagtaacataaattctgctaaaattgaagcaagagcaaacatcaaatttatggtgaagcttgggtggaagaaggtgaaattattgatgctttatgaaaagtttaggaggacaatgccccaaagtaatcagcagtttataaatgggtaactcattttaagaagggatgatatgatgttgaagatgaagcctgcagcaggagactattcacatcaatttgtgaggaaaaaatcatcttgttcattctctaattgaagaggactgatgtttgacagcagaagcaatagccaacaccatagacatctcaattaattcaacttactcaattctgaatgcaaattaaagttcagtaaactttccaatctatgggtgccaaaaccactcggaccagattaactagagataagagcagaggttttagtggaaattataaacaagtgggatcaagatcttgaagtatttcttggaagaattgtaacaggtgaagcatgactttaccactacaattctgaagacaaagcacaatcaaagcaatggctaccaggaggtagaaggggttcaatcaaagcaaaagtggactggtcaagagcgaaggtcatggcagcagttttttgggatgctaaaggcattttccttgttgactttctggatggccaaaatataacatctgcttattatgagagtgttttgagagttagccaaaactttagcagaaaaacacctgggaaagcttcaccagagagtccttcttcaccatgacaatgcttctgttcatttctttcatcaaacaagggcaattttgtgagagtttctatggaaaatcattaggcatccaccttatagtactgatttggctccttttgagttttgtttgtttgtttgtttcctaattgatatggtttggctgtgtccccacccaaatcttatcttgaattaccacgtgttgtgggagggatctggtgggagataattgaatcatggggccaagtctttcccatgctgttctcatgatagtgaataagtcttatgagatctgatggttttataaagaggaggtcccctgcacaagctctctctgcctgctgccatccatgtaagacatgacttgctcctccttgccttccaccatgattgtgcatgctccccagccacgtggaactgtaagtccattaaacctctttcttttgtaaattgcccagtctcaggtatgtctttatcagcagcatgaaaatggatgctaatacactaatcttaaaatgttttctaagggcacctatttttcttcagttgataatgtaaacaagactgcattgacatggttaaattcctaggaccttcagctctttagggatgtactaaatgactggtatcattgcttacaaaagcttcttgactttgatggaacttatgttgaaaaataaagtttatattttttatttttatctgtttttttttccatgaacttttagtcatctcatagttattaaaacagcgtgatacctgcataaaaacagacaaattgacccatggaacaggatagagagcccagaaataaattcacctgtctgctgtccactgattttcaacagaggctcgaggaatacacattggagaaaggacagtcttgtcaataagtgattctaaaaaactaggtatccagatatagaagaatgaaattaaacccttatctgatcccttatagaagaatcaactcaaaatggattaaagatttaaatggaagatctgaaactaaaacaactagaaggaaacataggagaaaagctatgactttggtctgagcaatgacttcttgcatgattccaaaagcacagacagcaaaagcaaaaatagacaaatggtattgaatcaagaagcttctatacatcaaaggaaataacagagtgaagagacaacctacacattgagagaaaatatttgcaaatcatacatcagataagggactcatacccaagacataaaatgaactcaaatcattcaataacaagaaaacaaataacccctatttaaacatgggcaaataatctgaatagacatttttcaaaagaaaacatacaaaaggtcaaaacatatatgaaaacatgctcaacattactaatcatcagggaaatgcagatgaaaaccacaatgggatgtcatctcatacctcttaaaatagctcttataaaaaagatgaaagataacgtgttggtgagtatatggcaaaaagggaagtttttgtacactattgggggaaagtaaattagtacagccattttgaaaaaaaatatggaggttcatcaaaaaactgaaaatagaatcaccatatgatccagcagtctgagtatatatccaaaggaattggaatcagtatgttggagagatgtttgcattcacatgttcattgcagcattgttcataatagccaatattgggaaacaacctaagtgcccaccaacggatcaatggattaaaaaaagaggtatatatacataatgaaatagtattcagcctataaagggacaaaatcctgtcatttgtgacaacatagatgaaactagaggccattaggttatgcaaaataagctaggcttagaaagacaaatatcacctgatctcacttacatgtggaatctaaaaatttgaatcaattgaagtagagagtagaatgggggttaccagaagctgtgggtggtggtcagttgggcagggaaaagaaaaatattggtcaaagggtgcaaagtttcaattaggaagaataagtgttctattatttcgttggcgttctattgtacaatgaagtgactaatgttactaattgtgcattgtgtatttcatatactacattgctaatagagtggattttaaatatttttgctgcaaaaaatatgtatgtggggtgatgggtatgttaattagcctgatctgctcagtctgcaatgtatacatgtattgaagcatcacattttaccccatgaatatatacaattattatttgtcaataaagatgaaatgaaaataaaaaggaattaataagctgataaatagtattttaactagaaaatctgtttttaaaaaagatttctatgtgaaaaaggcttacaaaggccaccctgcataaagactatccctgagtggatctgactattccttgtaggctggttatgccaggactaaacctatattctgtgataaacaggatttattgtttcagagatttcgtaaattaaaactatcacactttcttatttttataatgtgttaagttatatatccatagtcaaattatatatccatagtcaggatagacaacaacatcccactagatttaattttagtattgtctaatatttgtgctggttttcctgcatttattagtggccaaccttgtgttataaacagcccagcatgcttttaattaaggactctactttcagctagaatgagatattgacaaggcatatggatatgtggcaggcatctagacaagtgattggcaaactttttctggaaagggccagatagtagatattttaggctttgttggccagatggtctctgttgccagtactcaactctgtcctcgtagtgtgttagcaatcttagataatacttaaacaaactagtgtagttgtgttccaataaaagttcatttacacaaacaggctagtagtttatgtagtactgatctagatgaataagtcagtatggttctcagttcaagaagaggaatgatagaaagtttaaaaaaaagttgtttgaaacttggaatatgtattagaaataatattagaaatagtagttatgtaagagcctattttactttctttagggagttgaactatgtgctacctaatttctggagagcactacacaattggaatgtaagggtattaggagtaagaagtaaaaaaaaataaatggaaaactaggtgtttatggttagagtatggtcctggagtgcaagacttctgaattttagaagaacagttctagactgtaaagaggtccaaagtatgtaatgggaatgctttgcccaagtggcatgcaggtaaaggttcttggagtttaagaagagatcatgaaactgaagaaggagaattgttctttctttattatagaagtagcaggagatttctcccctttacgcatgtcttttggtggtgagaaggaattttccatttcttttaccttgattggtgacatcctcccatgcttccagtggactggtattggcaaggaggaaacctttttgtagtaagtggaggaaaaggtgggctcttggtaagatctttagtgctaaggataaggaattcagggattgtggtgagtagtttccttttaagtttgggaaattgtactactgaagttgaataggacgggacagggtgtgtagttttcaggtactcctattgtttagcttaggtagggaggcataacagttccttcacatcacttataagagggagataaggattactatggtagctcctacaatatatgtttctttggaggaagggggatatatatttttaatttttgtgggtacagagtaggtgtatatgtttatggggtatgtgggatattttgatacagtcatgcaatgcataatcacatcatggaagatagggtatttatctcaagcatgtatcctttgtgttacaaacaatccaattatactctcagttattttaaaatggacaattaaattattattgactatagtcaccctgttgtgctttcaaatactagtctcattcattcattcattctatttttttgtaccccttaaccatccctacctcctcctcactttaccactacccttcccagcctctggtaaccatcttcctactctctatctccatgggttcaattgttttgctttttagatcccacaaatcagtgagaacatataatgtttatctttctgtgcctggcttatttcacgaaacataatgacatccagttacatccgttttgttgcaaatgactgaatcacattatttttatggctgaatagtaattcattgtgtttatgtaccacatttctttatctgttcatctgttgatggacacgtaggttgcttccaaatcttggctattgtgaacagagctacaacaaacatgggagtgcagatatttcaatatattgatttcctttcttttgggtatatacccaacagtgggattgctgaatcgtatggtagctaaatttttacttttacgaggaacctccaaagtgttctccatagtggttgtactaatttacattcccacaaacagtataagagggttcccttttctccatatccttgccagcatttcttactacctgtcttttggatataagccattttaactggggtaagatgatatctcattttagttttgcttttcatttctgtgatgatcagtgatgttgagcaccttttcatgtacgtatttgaaatttgtatgtcttcttttgagaaatgtctgttcaaacctttagcccatttttaaaattggattgttggctttttttcctgttgagttgtttgagcactgtatatattctggttattaatcctttgtcagatggatagttcgtaaatattttctcccattctgtgggttgtctcttcatgttgctgtttcctttgctgtgcagaagttttttaacttgatgtgatcccatttgtccatttttgctttggttgtctgtgcttgtgggttattcctcaagaaatctttgcccagtccaatatcctggagagtttccccaatgttttcttgtagtagtttcatatgcttaactacctgttattatgctagacattttatttgaaaattattgatagaaataatttaaggcccaggataatgttatctttctttagagagtaccatgtatcttctgttaggagacttggcatattggcagttctggcagcaccataagccgattttaagacttgggagttttctgctgctcagatgactcatagctaacctacagttgaggtaaaggctggttaacttctggtacaccactattttaatagcaagtcattatgtcccaagtcaaagtgccctgttgtttctttgaacccctatgttttgtgggttattgcttccaacttttgtcctcctctccccttgaggctactaaatgcactctcaaccttttggcagtctcttctaaataagcaaatctctcagaacaaaagcatctctgaatgcctgcctcctcttaaagaatttgcaacttctggatcttggctttgtacattttatcattttgttacttgtaagattttaaaattgtcctttaactttttaagttgtcttcagtggagagtttttctgaattactgcacttagtattaatattattggaagtgaaaaatcagggcaagttatttaacttgttacttaaaatgtgcttcagacttctcatctgtaatatggagttattaattatttactatcttataggttttttgagatttttaaatgaggcaacacattgtgtttatagtggtacctgacatgtagaaaatgcttaagttattattacatttatttgagaatataggaatttgttgctcttcaaagattttccaagcatgaattagccactttattacaaaagtaatttgcagggattatgaaagatttgcaaatgacattaacattgactgacatttctgtcaaccctgatttaggtaaattaaagtttttcccccctaatgtatttaaggctctatactataaggaaaatttaattttatctaaaagtagataatggccctgatatgtatatgtgtgtgtgtgtatgtttatgtgaatatgtaaaaactgattagctgtgatgtgtgtgtgtttgcatatataagtatagtatataaatgttaaatgggaagacattttaattctttaaaatatggtctcttgataaaataattgggctggaagtaaaaaaaacaaaatgaagcagaattgagatttttgttttaaagatttttaatttctgaaaatagagtttttccaaatatctttttcttttttatgcataaaatagaagatacaattttttttatttgtcctgttttaaaaattgagttcttggactagatgtaaagtagacaggagaaaatgataataaaaaatatatttatagcagaactctttcaagtttggtgacacctattttagcaataccagtacatgaagaaaaaatatagcttacatgctaactccccaaagtggaacatacgtatactttttctctattccatagatttgtatttgatcttccttctgcctcaacctaatttttgtgcagatgaagtttaacttactctattttgcatcaacattgaatccttcagtactatgttcagtctttcagtgtcttttttcgcttcgtaaattgaaatggtcatgatatattaagatttaaagaaatccaaaataagtatcttttgagatgcagagaaaaatacagcactttgaaattttcctaagttgtaaataaatcctcctttttgaaaattgttatgtcccgttcctttggcttaatgacttttaaattttcttatcctgctatatgtcttaaagttattttaaggtaattattttcattattttattttctcttccaggttaacagaaccttctggatatttaacagatggcccaattaactataaatataaaactaaatgtacttggctcattgaaggctagtaagtatacagtctgagtcaaattaatgtattttattcttaaatgataaaggtgatcatattaatgtcagagcattagagtataattactttatcatttagtttgtttattattagataatatttacaacttctagacatcacatttaatgtaaattacactacctcttcacttgtgacagtagtttaatttttatatatattttgtttttgagttatgttattgtggtattaaattgagtaggcatttttttggtttattttgaacatcttgttatgaaatttgaagacttagaaattataaaagtatttcttgctgagctatgctattcatataatttagcattttagttcaaagggtatttttaaaagaacattttgtagaagagagagttaattattcatttagaggtattttcagtaagtagggcttgaaacaatctatctatttaaatgtattgtgaatggagcataaaagaattgatatgaattatttttgaactgttttgtaatttctaaagagtatatttggaaaattttgtatttaaatttttctaacttaaaagctgttcattctctgctgtgcacctgtagttacattttgtttatttgttaacattatatcacattgagaattttgattaaaatttaaatagttttttagtgcctccaacttaagggttctgtaaaaataagaatagtggcttcttgagtgttgatttttaaaaatcaactttatttaagtaccatttgtatacaacaaaatgcacccatttttaagtgtacagttccataaggtttcagtgatgtatacagtctatgtaacctctgccttcaatcaagagaaagattttttttttttgagacagagcctcattctgttacccaggctggagtgcggtggtgcgatctcggctcactgcagcctctgcctcctgagttcaagcaattctcctgcctcagcctcctgagtagctgggactagaggtgcatgccgccatgcgcagctaatttttgtattttcagtagaaatgggttttaccatgttggccaggatggtcttgatctcctgacctcgtgatctgcctgctttggcctcccaaagtgccgggattacaggcgagagccactgcacctggctgaacattttttattgactacatttttagaaaacaatgatacatacatatgtcctgttaatagattttgaaagttacattttatttgtacaaattagatatgatggcttatcaatctttcaccctgataaggatttatagcaaaattatctataaacagatttctaataaaataccctatctaaagtttcttcactctgtgctttgtatattatataataaatattatgtatttattcactctgtgctttgtatattttaatttgaaaaatatttcatattcattttcagtccaaatgcagtgttaagattaagattcaatcattttgctacagaatgtagctgggatcatatgtatgtttatgatggagattcaatatatgcacctttaatagctgtacttaggtgagtaattatatttaatcagttgcagaaaagtgactgtgtaattgcttctttaaatatatattgatatgtactgcaaaataaatttagtaaagatattgatagttacatttcacagatgattataatactttgttatgtgctgtaactgtcaatttaggtaataattatgtaaatattgatataacataaataagtactatattggaaatatagatttctttctaaatattttttattctcattgtatttagtttattctttcaaagtgccttgaatatgttttcagaactatctggatatattagcgtgagttctagctgacaaataaatagacaagttttgttttttaatagttgtttttttattttagtgaaatggtaaaattttaaattctgcataaaagggttaagttatgctttgtgcaatgattaataaagatggagtttctaccaattgtcaaaatgtgagagttttatttgtttcaaaatattttattgttagtcgtaaggtagattattaattttaaaattatagcattgtatcaatttaaaaatcttttcttgtgtatgtttagattattataaaaagtttcgtgaataggagaaaatctattagacacagaaaaaattatgaacatgtatagattttatatataatttaacatgattgttgataagttactcattatattatttacttttgctatttatacaatatctgttatatgttctgtcattgctggaaatttaagtatggataaaagcttattggtcccttcaaaatattttctttccaatttttctttttattattcatgtggcaaatattctatttcattctattctaatacattttattttgttctattttatcaggaatgtgaattattattttggacaaaaatgtaacgacttgtatttccttaggagcttaggtacttattctatgatattgctattgcttacatttttgagtcatttgaacattagaaaaaggatagccataagcagcccttcatctaaggacaatagagagaaaatagagtggagccttgcaaataattaggttgtaagataatttattgtaacaattaaatttgatcctcagttcatacatttatttttagcaatttaaacatcactttgctatctttactctatttttatgataccgttgactgaccatcatttagatgtgtgcctgttcatttgtttatctagtaattctaattactttgtattaatactcatccattagcattcttaccaacattttcttgttattaaaggaagataattagcaggtgagatttagtatatggctgtgaagatggaattagtgatttctcattagcaagtgttcttgttagccctcctaagggaaatggaaaactcatgtttattgatattgaatatccacttgatgttaagcactaggctaggcagtttaaatgtcatctaatcctcacaaagatctcgttgggggagtactaagtactattatccccattttacagttgagaaaattgacattcagagaagttatttgcttctaatagatggtagagctaggattaggacttgaatctcaatctcctgatttaaaagcatatgctgtttgtacttcatcttgctaagaattcagaatctaatatgtttgaattacttcaattgtataaatatttattactcaacatttaattacagagactgtgtcacaggcttagagtacatagtaaggaagaaggcataggctatcgcagtggctttagacaccaactacctgcagttgggctagaacagatttcctaggttaagagcacagtcctctacaacaagggtctcctctccaccccagatccccgtaccagtccatggcctgttagcaacagggctacacagtaggaagtgagtggcgggcaagtgagcaaagcttcatctttatttacagctgctccccactgcttgcattactgcctgagctccaccttctgtcagatcagcagcggcattagattgtcataggagtacagaccctactgtgaactgtgcatgtgagggatctaggttgctcattccttatgaggttctaatgcctgatggtctgtcactgtctcccatcagccccagatgggaccatctagttgcaggaaatcaagttcagggcttccactgattctacattatggcgggttgtataattatttgattacatattacaatgtaataataatagaaataaagtgcataataaatgtaatatgcttgaatcatcccaaaatcatcctcccccggtctgtggaaattttgtcttccatgaaactggtctctggttccaaaaaggttggggattgctgctctataacactgctgtcatttcagacactagctgcaagcttggtgctccccacctactctgaccatctggctacatatttaggggttcctactctgtcctaaaagtttgataattcactagaattatcatagaactcaggaaagttctacacttatgactatagttttatcatgaaggatagaaatcagagccagccaaataaagggatgcatagagtgaggtctgggaggatcataaatgcaaagcttctgggtcctcagaatgtgttacccacccagcacatcaacatgtatcaccaacagggaagctcatctgagcttcaggtgtccagagttttattgaagtttcattatgtagccatgagtgattgaatcattggccatgaggctgaactcaaatctccagcccctcccatccccttctctctcgggaagttaggctaataccatatggccccaacattttaatcacatggttagtgtttctggagtggccatcccctattctgaattatatctttagcttaaattaattaggggcccaccatgagtcacctcattggcataaattttcagggctcaccatgaataggaagacactcccatcactcaggaaatttcaagaatttagaggttatgtcccaagaactggggacaaaagccagccaaattctttagtatgcagtagtcatgcattagtgggggtatgtaaacagatttttcacacagcctagttagtgttacaatcaggttatgaaggagttctatataatttcaaaataaataactaatccttcatgttgactttcatcgtgagtaaaagtatgaagtatgggggtcagataggacattctagagagagaaaagcatatatacaaaggtatagacacattaaagagcattatattttagggcaatagttgaaagttttgagtaacttgattgtaggaactgtgaaggatacgtaggagtcacattaccccaaaacagcaatcagtgacatttacttagtgctcattttgtgccaatgtacaggagttctttatatgcattagtttatttaatcctcaaaataacctttaggtaggtattaatattgtaattttacaaatgcagaattgagacacagagattttctgtgagtggcccgaaggttgcctagctggtaagtcagaatatgaatcaaggttatgtaattataggtcctaatcccttaatcactgtaatattgcttgcttgtacaccacactaaagaagttgggcttttattctgtaggcaagagtttttagaatgtggagaatgcattggaatggagaagtgttatttttttttttttttactgtgtgctggacaattgtgtgttggacgttgttgtttggaaaatcatatatagtaataatttgaggcctagaaagattatattcttgcagagactacctggggacactcgcaatccatattcaactcaatccaaactcagatactgaggtgattcatagctcagctgcagtgcagtcctttggagggcctaactttaggtagtttgctttcacttccaaccattggagtcccagttcaacgtgaaggccttgtgtttcactttttctttccttcattctgtaaaatccctgaaattaccaccgagttttttttagcccttcaaatcttacctccagccttgaaatcagcaaatgccaatagggtaaatgacctcaatgcctgggcaggccttcaagctgatttttttgtttttatataatttgtcattttactagatttcagttggtccgaatttcctggtgtattatacagtaagtggaaactctcttttatttattgtttttaaaatacttgtaaacaaaaaaccaaacagatctattcttttttgtttgtttgtttttttgagacggagtctcgctctgtcaccaggctggagtgcagtggtgtgatctcggctcactgcaacctccacctcccaggttcaagcgattctcctgcctcagcctcccgagtagctgagactacaggcatgcaccaccgtgcccacctgatttttttgtatttttagtagaaatggggtttcactgtgttggccaggatgttcctgatctcttgacctcgttatccgcctgcctccaccttccaaagtactgggattacaggcatgagccactgcgcctggcccagacctattctttttatctttttcagagagcgctcagagactagctgtatctattataaagacctatttttagtaatactcacctttatataattttattacaatgaacaatatgtatgtataacttaagactggtgtcatagggtttgtattgttttgagagtctcattttaaaatcatttgttgcttcacaaacataacctagtagatgtaataataattactaaagcgttaaatcaagagttgattactttttaacttgtttgcatttgagaatgtattttctaaatcaattatttgactataatatttcatttatgtgtcaaatatgatttgaatgggggaattcagttcttagtggtacctaaacataattttaactgtttaaaggaattgaccgtgtcgagttatataatttgtttgttagcagcttcttttctttcaccaattgcatgttttcatagatttagagaggttagaacatataactaaatgaagataggtaattttcctcatgaacaagtatccttaaaaagaagtacaagttaccagtttaaaactattttgtacatttatatctcccccaccccaagtttttgtttgtgtgcttatgggcttatgtgagcaatattctgtcttggaatagttatatattaatgcaatttgcatagatatgcaaaattagaaaaacattaaagtctatatagttttaaattttttgaagtaaatattttaaatcacctagataaatgtattggaaatgtacagctataactagaatgtaattgtaattgcttaactgatgtagagtgtcttccagcttcatcggatttttaaaccaatcagaatgagtaaaggtacagggttttattagagtagcaaggtgactttaagtgaagttttatacgaattaagtggaagactaccctgtagtattatgacaggatggatagcaggacaaaaaggagaaatgagacattgccttacaaatagtgataagaaaaaaaatggggtacagtggcatgagagtagattttagtgtattggcagcagtagtagaactaatttagtgagaaatggatagggacttcttttagatgtattctccttttagttgcccattctgacgtacaagcattactgatcctggtaagaatatttctgagtaaattttatgtgcttaacagtcttatgtatatctatacatacaatattcagttttgttctcttttagtggtttgatagtccctgaaataaggggcaatgaaactgtgcctgaagttgttactacatctggctatgcactgttacatttttttagtgatgctgcgtataatctaactggtttcaacattttctattcgtaagtattttttaaaaattccttcttttaatgattcttgtaatttaatgtaaaagaggttttttttgtttatttttattaatgtcttgtataccagaagcaggctaccgtgttaaatttcaaattagtaggcaggatcccttcttaagtgacataaaatcttaataatatgccacaaaacgtgatctaaacctataagtttggttgaaaattaattatgaaattgacaattgttttttggcaagtgattaagtaaacaagtactagtgtagctttactggtagcaacagatgtggtgagactgcagggagttgtgaactgcctttcagtgctctaaggtatatcacttgtaatttgaagaggattatgggagctaagtttttgtagtccctattgcagagactgtactgaaagctatgcatacattatgtcatttaattaccttcaattctgtcaagtgggtatatttcccattgacacatgaggaaattgtggcttaagagttaagtggctataccactatctcctctaaaataagaaaagtaatattcattgagaatctattatatgcctgatactttatatacatttttatatctagaagactgagggtgaagtaatgagagatgctttcacaggaatggctagagaggaagtctatatattatttttttcttttcttcagaatgtagaaattggtaaccagagaatttttcaccagaaatattataaatatccttgaatcagcaatttattatggaatttatttatcctacaacgtatccaagtatgtatgcaagggagaacaaatatatagtagaatataatcacatggtggctcacgcctgtaatcccagcactttgggaggccgaggcgggcagatcacgaggtcaggagatcaagaccatcttggctaacacggtgaaaccctgtctctactaaaaatacaaaaaaattagccaggcatggtggcgggcgcctgtagtcccagctactcgggaggctgaggcaggagaatggtgtgaacctgggaggcggagctttcagtgagccgagatcgcaccactgcattccagcctgggcgacagagcgagactgtgtctcaaaaaaaaaaaaaaaagagtcttaaagctaaatatgataaacataccttttcttcaataacagtgtatgggtgatagcatgctcttttatattatacaaccaagttatatcttgacttctcatatagttttgaattttcatgaatttaatttttttctgtaaaatatacaatcaaaacattgagtacttaagtctttacaaaacattttgcctggaaccgtacagatcctgcagatgttgagcatgtagtcgttagacatttggagtcttggtatcaaagtaaatctgttgaataaaataagaccaactgcaaataaatactaacaatttcataagagtaagagggtacagagtaaagaattaaaactacattgtgaaattctgttacatttataagcacataggacacagtataaaaattataaagtttatgatgtatcaaccaaaattctttttcaattaccttgaatctgaatatatatgaattatattttacagaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtaagcatgtgtggtgtgatggcttttgaaacattgattcatatatgtaatagattaatacaaattccacacgtttgtttcgttatagtttgcacacccaagccttatatatttacttttatttttagaatgttcagattaataatcaacttcttaataatttttttgtcacaaatagaattaattggcaaagattttgtctccatactactttgaagatcaaatgaagttatatatgaaactgaattgttaggtgtgtgataattatggtcttctgtaatttgttgttgaatctccccaaatttggtgacttcactgaatttaatgtggtgcattcaaatttgatttataagggtaatataaatagtatactacaaaaataaatgttcaaagggactgcagtatatgaaacttatttcttaggaaaggctgacatcttgtggctattttaaaaagaactagactatttttaaaagtattttagctgcctattgcagaagtcagatacctaggaaagaatttctaagtaatttttataaatatctatcatcaaagattaagtttagactacagtgaagaatgttggcttatttatctgtatataaaataataaatattgtcattatgaaattaagagatatgcttatacatatacctacccacctagagcttactttttgctagttacatttacctatgaagagcttcctttgtgccaacatattaatcctgttgaaatagggaaatttgactcaataattacataacctgaagtacttgattatgtattattataacacagtgtaataaatagtagcaatagttcccaagttaaaaaccaaagagaacatactcttcatgaagttgtattcattattcctgagatgaccttttcaaaaaagtgttgttgggtatgttgagtacttacttagaggaattattttaggctttgtgtaaattatgcctgtcttaagctcatgttagctcattaaaaaatattaggtatgtcaactgcacaaaagatctatgatttcttattaaatcgaatttggttaccaattgcaattatgtcagatgcaaatttctaaatgttttgtaattacagggacatgtattttaagtgactcttttaatcatttatgacttttcttccccccaaaagtgccttgagatgtaattttattttcatttctgtcgtgaaactaaaataactgtcttttctatagagacagtggtgtatccatattatatttgatttaaggcctgagaaatagaaatatagctcatatacacagtatttttcaaactggtcttcaattgctattagtctccacctcatttcagcagtcttaaaagcaaatgaggaatacatttgtataacattctctgtgaacaactctgccccttttctgttttttacttactttcattagtccttctttgaaatgctttattttgtgtaagtcttgtaatatagatctgattcaaagtattaagaatttttttctggcctttgttttttggccttttcatatcctattattctcatctgtaatgtcccaaatcataagaattcctgaatctaatatgtctataagcaaatggaaatgaggaagcaaatactgggtatgttcacttttaaagcaaagttatattatcagtagtctaagaactacttgtctgtgtgtgtgtatgtgtgtgtgtatgcatatatacacatatatttataactacatatatattttatatggagaatagtgtgaaagtgctttgtaaattataaaacgcagaaataagacaattttataccattttcttaataattaaggaaatgatttctgaattgatatgtttgaaggaggccttgtaaatgagataatatggtgttttcaagacaaattatgtgcagactggttactttgtgcctcaaactgatcctgattctgtatttaaggaagcatagctccaaagaaggtaggattgtgagcaaactcatttaggggaaaatgatgtttttatttcagatatatatagaatgggaaggaatcagtgaggtaagaagaggagatagatttgcttctaggacaaatggggaatgatcaaagaatgagagacatgtgaaaatgcggactgccgaggcaatctttatgaggttcaaaatctggtagttttatacaaggtgttatttggaactggattatttaggttagagtaacagattgttgttacctccattatattttatcctttgttgttgcttgactacttattctgtttggctgtatgcctaatgtatattttttaaaaatgagtgttaccctctagaaacttgggttttattaagataacacagaggaaaaacctagctttatattaagtcctttttttatttttatttttatttttttattatactttaagttctagggcacatgtgcacaacgtgcaggtttgttacatatgtatacatgtgccatgttggggtgctgcacccattaacacgtcacttacattaggtgtatctcctaattctatccctcccccctccccacaccccacaacaggccccagtgtgggatgttccccttcctgtgtccaagtgttctcattgttcaattcccacctataagtgagaacacgcggtgtttggtttttttgtccttgcgatagtttgctgagaatgatggtttccagcgtcatccatgtccctacaaaggacatgaactcatcattttttatggctgtatagtattccatggtgtatttgtgccacattttcttaatccagtctatcattgatggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacattctctccagcacctgttgtttcctgagtttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccctcacccactttttgatggggttgtttgattttttcctgtaaatttgttggagttctttgtagattctggatattagccctttgtcagatgagtagattgcaaaaattttctcccattctgtaggttgcgttttcactctgatggtagtttcttttgctgtgcagaagttctttagtttaattagatcccatttgccaattttggcttttgttgccattgcttttggtgttttagacatgaagtccttgcccatgcctatgtcctgaatggtattgcctaggttttcttctagggtttttatggttttcagtccaacatttaagtctttaatttatcttgaattattttttgtataagatgtaaggaagagatccagtttcagccttctacatatggctagccagttttcccagaaccatttattaaatagggaatcctttccccatttcttgtttttgtcaggtttgtcaaagatcaggtggttgtagatgtgtggtattatttctgagggctctgttctgttccattggtctatatctctgttttgataccagtaccatgctgttttggttactatagccttgtaatatagtttgaagtcgggtagcaaatggaaaacaaaaaaagcctgaggttgcaatcctagtctctgataaaacagactttaaaccaacaaacatcaaaagagataaagaaggccattacttaatggtaaagggatcaattgaacaagaagagctgactatcctaaatatatatgcacccaatacaggagcacccagattcataaagcaagtccttagaggcccacaaagagacttagactcccacacaataataatgggagactttaacaccccactgtcaatattagacagatcaatagacagaaggttaacagcgatatccaggaattgaactcagctctgcaccaagcggacctaatagacatctacagaactctccaccccaattcgacagaagatacattcttctcagcaccacattgcacttattccaaaattgaccacatagttggaagtaaagcactcctcagcaaatgtgaaagaacagaagttataacaagctgtctctcagaccacagtgcaatcaaactagaactcaggattaagaaactcactcaaaactgctcaactacatggaaactgaacaacttgctcctgaatgactactgggtacataacgaaatgaaggcagaaataaagatgttcttgaaaccaatgagaacaaagacacacaatctctgggacacattcaaagcattgtgtagagggaaatttatagcactaaatgcccacaacagaaagcaggaaagatctaaaattgacaccctaacatcacaattaaaagaactagagaagcaagagcaaaaacattcaaaagctagcagaagacaagaaataactaagatcagagcagaactgaaggagatagagacacaaaacccttcaaaaaatcaatgaatccaggagctggttttttgaaaagatcaacaaaattgatagaccattagcaagactaataaagaagaaaagagagaagaatcaaatagatgcaataaaaaatgataaaggggatatcaccacagatcccacagagatacaaacaaccatcagagaatactataaacacctctatgcaaatgaactagaaaatctagaagaaatggataatttctcgacacacacaccctcccaagactaaccaggaagaagttgaatctctgaatagaccaaaaacaggctctgaaattgaggcaataattaatagcttaccaagcaaaaaatgtccaggaccagacggattcacaggtgaattataccagaggtacaaggaggagctggtaccattccttctgaaactatttcaatcaatagaaaaagagggaatcctccctaactcattttatgaggccagcatcatcctgataccaaagcctggcagagacacaacaaaaaaagagaattttagaccaatatctctgatgaacatcaatgcaaaaatcctcaataaaatcctggcaaaccgaatccagcaacacatcaaaaagcttatccaccatgatcaagtgggcttcatccctgagatgcaaggctagttcaacatatgcaaatcaataagcgtaatccagcatataaacagaaccaaagacaaaaaccacatgattatctcaatagatgcagaaaaggcctttgacaaaattcaacagcccttcatgctaaaaactctcaataaattcggtattgatgggatgtatctcaaaatcataagaggtatttatgacaaacccacagccaatatcataccgaatgggcaaaaactggaagccttccctttgaaaacgggcacaagacagggatgccctctctcaccagtcctattcaacatagtgttggaagttctggccagggcaatcaggcaggagaaagaaatagaaggtattcaattaggaaaagaggaagtcaaattgtccctgtttgcagatgacatgattgtatatttagaaaaccccatcatctcagcccaaaatctccttaagctgataagcaacttcagcaaagtctcaggatacaaaatcatgtgcaaaaatcacaagcattcttatacaccaataacattcaaacagagagccaaatcatgagtgaactcccattcacaactgcttcaaagagaataaaatacctaggaatccaacttacaagggacgtgaaggacctcttcaaggaggactacaaaccactgctcaacgaaataaaagaggatacaaacaaatggaagaacattccatactcatggataggaggaatcaatattgtgaaaatggccatactgcccaaggtaatttatagatcagtgccatccccatgaagctaccaatgagtttcttcacagaattggaaaaaactactttaaagttcatatggaaccaaaaagagcctgcattgccaagtcaatcctaagccaaaagaacaaagctggaggcatcacgctccctgacttcaaagtatgttaagtcttgagttccttcctaacatttctcttttgcttaacctacctggtcttgtgtgtcatttttttttctttggtttttctttttcttggagataggatctcactctgtggctcaggctagagtgcagtggcatgatcgcagctctttgcagcgttgaccttccatgttgaaatgatcctcccaactcagcctccggagtagctggcaccacaggttgcacaccaccattcccagctaattaaattgttttttttttttagagatgagatctttctatgttgctcagactggtctcaaactcctgggctccagtgatcctcccaccttggcctttagagtagctgggactactcgagggcacacaagtttgttgtataatatttaattttgtcataaagtatagttgtcaaagataatgatatatacatattaaatatatgactaaaagtatagggacctgtgtagactcatctgcttctatgacagtaaaataaaaaaaatagacttcatagtttgaggttcacaggaaaattgagcagaaggtacagagaattcccatttacctcctgccccaatgcatacacagcttctctcattatcagtatctcccaccagagtgtatattcattacagttcatgagctcacactgacaaatcattatcaaccaaagtcatagtttacattagcattcactgtcagtgttggacattctgtgggtttggacaaatgtatcattacatgtatccaccattatagtatcaacagaatagtttttttaacctaaaaatcccctatgctctgcctattcattctttcctctccctacccctgccaaccactgatctttttactgtctccacaattttgccttttcccaaatatcatatggttgtaatcatacagtatgtagctttttatgattggcctttttgacttgacaagatatgtttaagtttcctccatgtctttttatggcttgatagctaattccttttcagcactgaataatattccattatatggatgtaccacagtttgtttatccattcacctactgaaggacatcttggttgcttctgtaaaatttgtttaaattttagtaagtcacctgagggaaaaaggcaactttgaaaagaactgatctcttaaaatggcttccaaacattgggatagaagagcaatttttataacacatgaaaagcaagatataagaaattgaattcatgttcatgtgtaaagaacacaatagaacagtaattttcaaagtactctgttttatataacttttaaaaaatctgaggaggctgaggcaggagaatcacttgaacccaggaggtggaggttgtgagccaagatcgcaccattgcactccagcctgggcaacaagaatgaaaatccatctcaaaaaaaaatctgaatgatgggaggtctttggttgaaagcaacagaaacaatctggcttacttgagcagaaaagtcagttattggaaagtatgcagagacagagactgctgtctcctagcattcattatagaattctcattgtaatagaattctcatttagctcagcacatggccttccatctacataccaaatttctcatgctgccttgcagctagtatggctatgttactgtattagtctgttttatgctgttgataaagacatacccaagactgggcaatttacaaaagaaagagatttaatggacttacaattccacatggctgggggggcctcacaatcatggcacaaggtggaaggcatgtctcacatggcagcagacaagataagagagcttgtacagggaagctccccctttttaaaaccatcagatcttgtgagtcttatttgctatcatgagaatagcaagggaaagacctgcccccatgattcagttacctcctactgggtcccgcccaaaacacatgggaattcaagatgagatttgggtggggacacagccaaaccatatcattctgccactggcccctcccaaatctcatgtcctcacatttcaaaaccaatgatgccttcccaacagtcccccgaagtcataactcatttcagcattaactctaaagtcctaagtctcatctgagacaaggcaagtcccttctgcctgtgagcctgtaaaatcaaaagcaagttagttacttcctagataacaatcagggtacagccattgggtaaatacagccattccaaatgggagaaattggcaaagcaaaggggccacaggcctcatgcaagtctgaaatccagcagtgcagtcaaaccttaaagctccaaaatgatctcctttgactccaggtctcacatccgggtcacgctgatgcaagaggtgggctcccatggtcttgggcagctctgctcctgtggctttgcagggtttagtcccacctcccacttgctttcaggggctggcattgagtgtctgtggcttttccaggcacatggtgcaagctgttggtggatctaccattactggggtcttgaggacagtggccctcttctcacagctccactaggtggtgccccagtagggactctgtgtgggggtccaaccctacgtttcccttctgcactgccctagcagaggttctccatgagggctctgcccctgcagcagacttctgcctgggcatccaggcattttcatacatcctccgaaatctaggtgaaggttcccaaacctcaatttttgacttgcatgtacctgaaggctcaacaccacatggaagctgccaaggcctggggcttccaccctctgaagcaacatccagaactgtaccttggccctttttagccatggctggagtggctggaatacagggtaccaagtccctaggctgtacagagcaggggggccctgggcctgagccatgaagtcatcttttcctcataggcctctgggcctgtgatgggaggcgatgctgtgaagaccactgacgtgccctggagacattttccccattgtcttggtgattaacattcagctcctcattacttatgcaaatttatgcagccagctttctccttataaaatgggattttcttttctatggcattgtcaggctgcacattttccaaacttttatgctgtgtgtcccttttaaaactgaatgcctttaacagaatccaagtcatatcttgaatgctttgctgcttagaaatttcttccaccagataccctaaatcatctttctcaagttcaaagctccacaaatctctagggcaggggcaaaatgccacgaatctctttgctaaaacaaaacaagagtcacctttgttccatttcccaacaagttcctcctcatctccatctgagaccacctcagcctggatttcattgtccatatgattatcagcatttttgtcaaagtcattcgacaagtctctagggagtccacactttcccacatttttctatcttcttctgagcctttcaaagcgtttcaacctctgcctgttacgcagttccaaagtcacttctacattttcgggtatcttttcagccgcgctccactctactggtaccaatttactgtattagtctgttttcacactgctgataaagacatacctgagaccaggcaatttacaaaacaaagagatttaatggacttacagttccacatggttgtggaggcctcacaatcatggtggaaggtggaaggcatgtctcacatggcggcagacaacagaagaaagattgtgcaggtaaactcccctttttacaaccatcagatcttgtgagacttacttgctatcacgagaagagcacaggaaagacctacccccatgtttcagttacctcctactgggtcccttccataacgtgggaattcaagatgagatttgggtgaggacacaaccaaaccatatcagttactaagtttagattggtaggatgtgagtagaaaatctgtatgcaaatattagatcattcagatattttcctatggctgataaatggcaacaactataataagtagcactggcccattcatctctagaatgttcattagagagaaataagcttttcccttcttttagcaacttattttgcttcactcaacctgttctctgaataatacaaaaggatattgagtagctcacaagagaaatgagaagactggataaactattgttggaaagaggccagatacaaataaaggctagcctacagcaaagatgaagccaatggaaagtttgagtaggatattcctgtcattgccacaggatcctgggttactaccactggcaccctttcagtaggtactgcatgctacaggaatggagagaaagaattgtaaattgcctttacatctttgcatcacttattaagactgagtcctgcttaatagtatctgcttggctaaacctaggtcttgtccataccgtggctgcctagagatatgaaatagggaatttaacttttctgttatatgtagtgaaagaggttctctttctggacaaaatccacacaataaaggattctcccaaacacaggaaaggggattcaaatgattgagattcccaaacaaataaaaaattcaaataatatatttttagctatagattgttaccataattaacaaggaatgggctaatttgttctctcatgtctactcagagaaactttgtaatgtggactagatgtaggggtagacaggttaagagacaaaccagcaagcttcagcatacaattttttcttaatgtattacaacagattttttttcctattctacagagaacagtgaaaaacaggtcaccatcatttatatgtaagagagttgcttaactgttatcaaattgttcctgttccttttctattccagaatgtcctgctcaatcctattgctcgattcttttaaatgtcttcaggacatttttatgtttttagtattcctttttaattcaattcagctacagttctcatataaggattgaagttggctgttttaaactcttaaattattgattgaaatacagtatctggaaatgtaaatcatgtaatttaatagttttgttgcgtagtgcctctgatctttatttaaagtcacactttattgtaacttactccagtttctcagatgctctttgtccttcactatctcaagacctttcttaattccaaagttcttcctagaaaacccttaccccattcatattctaagtccaggtcagatccccctgtaatatgctgtcataagaccctatcttttaaatttatatcatttatccctgtttataattatgtgcttgtatgattctttgattatctttcccagtggaatataaactccaagaagttaagaatgattatgttttgatcatctttgggtttccagaacctaatatagtgcatggcatgtactagccacttgcatttgttgttgttattgaatgaatgaattagaaatgtattagtttactagtatagtgatatgtagacattcaactagagatgttttataaggttattactctaataaactatgttatttacttcctgtataattacttctgaacattgagataagcaattgaatttgaacattttttaaaatgttattttatcaagcattggttcttggaatcttggtcttattttgtttcaatcctttggttttagattttaacatttgccattgggtggcagtattgactaccagaaaactcacttaaactctggcattcaagttgtagaaacttggtagttttgtttgacttagaaaaatgtaaaaactttcaactcaaactcatgaatattttatctgaagtattttatctgggttagtcatataacatataaggacatatttagttattttaggatagtatacacatgagattataggttgccttgtagaaattcataaagtagcttacattttcctttagaaatataataataatgaacacggtcaatctatttcttctcttttaactttgaggagggagaagtgacaggtaatgcgtttaattccgttaaattcttcccacttagcaaaaacagcagatctgacttttttgtgagagctaataaaattaaatttttactcttaacctactaagaaagttgactgtttgaaaataaaagcagcattaaaatgtatatatgacagccctttttcatgaattcatttatttatctttttcatttattaatgtaacagtttctttttttgagcttctattaagtgctagagactgctctaggtccttgggatacatcatggaacaaagaagacaaagatccttgtggaacttacattcaagctaggagagacagaccctaaataataaatatacattatatagtatgttagaaggtgataagtacaatggaaaattaaagtagaacagagaaagaggaatagaaagatctgggggttacatttaaaatatgatgatatgcttaggttttatggagaagttgacatgtgagaaaagactttaagcaagcaagagagttcaaccatatagatatctaggggaagaacattctaggcagagacctgtcagttcaaagaccctaaggcaagagcaagccaggtgtacataaggaccagtaaaaaggccattgtggctggaattgaattactgatggggagattagtcagatatgaacttagaagttacacaacaagggagatggttggggatgtggaattaaggggttgctggaggggatggagattcctgaaggatggagctatatcagctaaatattcttagctttgtagaccatagtgaggattttgactcttaccctaagtgaaatgagggagccattgaaggattttgagcagaagattagtattatgtggcttagttttataaagctcctattggtttccacctgagaatagactgtagtagcagtataccagttcagaggctactgctataatctaggtgagagatgatgatgatggtagcttggacaggttggtagctatggaggtggtgacaatggcttgaatactgaatgtgattttaatgcaggattaataggatttgctgatggtctagatgtggggggtgagggaaagaagagtcaaagatgactaaggtttttggtttgagcaaatggaaagacagagttgtcatcaactaatatgaggaagattttaggaagaatatttggttatggtatgccaagttagagatatctttgagatattcaaaaggagatagtgaggaggcagttggatatatgggtctggaaattgatggagagagatctgtactgtagatataaatttggaggtgttcgcttaaatattaaattggaaaccattgatgaaattggatgagattaccaggaaagttagcatagagagagagaatcgaaccaaagactgaactgtgggtcccaacaaaattcagagtatcctgtgctaggcatataaattcctttcttagataagcttgccttatgttgaactatttataaccacttattttgttgcctctgactttataagattttgttgcctctgactgcataggacaatgtaaaatgaacaaatcctgctctcaatatagctaattctacgtttgtcattttcagctgatcagaaccaaggtcttaaatctttcttgggattttttttttttatagtgtgtattgccctgtccatactcttaacatggtttatcaattttcttcaaagcataatatcttagctcaggctgctataacaaaataccacagattaggtcgcttaaacaataggcatttattcctcacagttctggagaccagaagtccaataccagggtgctatcatggtgagggccaccttcctggccctctcactctgccacataaagaacgaacaagatgactgcctttttgttctatccttatatgacagagagaaggagaggaggagagagcgagagcaagagagagccagagagagagagagggagagagaacgcacgtgagagtgcgaacttgtgagagctggagagagtgagcaagctctctggtctctccttgtaaggcactgatctcaccatgaggaccctaccctgataaccttatctaaatctaattacctgtccagagccccacctactaatactatcacgttgggagttagggtttcaacatataaattttgaagggacacaggcattcagtcaataatatgagaattttttttgtttcttttttttttttttttgagacagagtctttcactgccgcctgggctggagtgcagtgggctatcttggctcactgcaacctccgcctcccagtttcaagtgattctcctgcctcagcctcccaagtagctggattacaggtgcccaccaccacgcccagctaagtttttgtatttttttttttgagacggagtctcatgctgtcgcccaggctggagtgcagtggcgcgatctcggctcactgcaagttccgcctcctgggtttacgctattctcctgcctcagcctccggagtagctgggactgcaggcgcctgccaccatgcccgtctaattttttgtattttttagtagagacggggtttcatggggtctcaccgtgttagccaggatggtctcgacctcctgacctcgtgatccgccttcctcagcctcccaaagtgctgggattacaggcgtgagccactgtgcccggccaattttttgtatttttactagagacggggtttcactacgttggccaggctggtctcaaaactcctgacctcgtggtctgcccgccttagccgcccaaaatgctgggattacagacgtgagccaccgtgcctgggccatgaaaattcttagcatgaatatttcttaatgttatttcaatttatggaggaactattctctattcacaattaaagttatcttgggaaagtcaattaactatctggttataaatttcattatttatacaaagagattatttgcccttgtctgagtcttgggatgataacttgatcaaagtgaattgaaatagtgtcttgctgtttatgcttgactggctgataatacagtagcagtttcctttttagtaagtagacattttgtaatagtttgatttagtaaaatcttctgtttgcaatgaggttcagtacattttattaataaaaaaattgaatttgtgattaatatttatatattaggcaactatttacatattctgtgagcattatacatgcaccagtctaataaaatgggcagtttaacttttgtacctagaagaaattttgacatacatgctttcattattttataatttattattttagatgtttttgaaatatgattttgacagttacgattattcaaaaatctggtctttaaaatttttgaagttagtcttttctaagcatacatattttgataataccaggagttttcaaaatgtgtggtgcaagggttatataaggagatgggttggggtaggatggaagataagtgactcttccttttctgcctcaaccatagtgtcatcactttgcaatattttacatattgagattccttgtaaaactttgttttaagccttctgcagcccaaaaagagtaaattggaaaccattgatctttaaacaagagggcaatttgtttccatgccacaatagcatcattgaccgaaactgtaagagccaagtattcttggaacagatctagtataatgattaccactcacacaattcattgtcttataaaattaacagattgtcagaatagttgtggatatttaaaatagacaaaagttaatacctggcctttggagattgattttatgggtctagaacatgtgtagaatactttggatactgtaacaaaatcaaatttttaaaatggtgttagaagagagaacacttgcattgaaatcttgttttgacttttattggagaacttcagattcagtacatactaaatcataagactatatctggaatgattacaacaagctacatttacccctcttgctctaaaaatctttattcccaccatatcttccacttcttattaacaatccagtttcttctgggaaattgccttttgctaacgtagcatagtcttgctgggatgaaaaaatccaggtacctgtctattctaagcttgatttttctccttgaaaaactctctgaatttctacatattttttcaatacagtcccattttcccttaagctagccaaattaatttctgtgactcacatgtaagaaaacaaactgaagtaccaccttagagatactgttagggtgtgttttttttttctggttattagacttctttaaaatacccaaaattatatcagcaacctgcatttgatagaattcagagttagcaatatttatttaatgtgttcagttgaaaactgcaaaaagaaaataaatatagttggctctttaaacatgtaccacttcaacattaaaatgaatgcttttttcgtagtagtatagatgaaatataaattaagggtatgagccaaaattacatcaaaaagtctaaaatcctggagtaagattattttttgcttactttcccttttacttattttttattgatacataatatttacatatttatggggtatatgtgagtatttgttatccgcatagaatgtgtaatgatgaagtcagggtatttggggtattcttcactttgagtatttatcatttctgtgttgggagcatttcaagtgctcttttctaactacttagaaatatacaatatgttgttgccaactatagttaccctacactgccattgaatattataatttgtatcttctaactatatgtttgtatccattagccaatgtctgtcctcccccactacccacaccctgtccagcctctggtatccatcattctattctatacctccatgagatcaactcttttaactcccacgtgtgagtgagaacttaggatatttgtctttttgtggctagcttatttcatttaacataatgacctccagttccatccatgttgctacaaatgacatgatttcattcttttttttttttttgtggctgactagcgttccattatgtatatacactatattttcattatccttttgtctgttgagggacacttaggttgattccgtatctttgctactgtaaatagtgctgcagtaaatatgcaggtgcaggtatctctctgttacagtgattttgtctcctttggataaatacccagtagtgggattactggatcatatgatagttctattttaagttttttgaggagtttccatactgtttaccatagtggctgtactaatttacatccctaccaacactgtattaagagttcccttttctgtgtatccttgccagcatctgttatttttagtctttttaataataaccattttaactaagatgatatctcattgtggtttttgattggcaaattccctggtgattggtgatgttaaactatttttcatgtacctgttggccatttgtaagtcttcttttgagaaatgacttcatgatctttgctcacttttaaataggattatttgtttactgttcagttgtttgagttccttgtatatcctggattttaggtccctgtcagtaacatagttttcaaatattttctcccatcctgcaggttgtcttttcactttgtggattgtttcctttgctgtgcagaagctttttagttgaatatagtctcatttgtctatttttatttttgttgcctgtgcttttgaggtcttagccaaaaaatctttgcctaggtcaatgtctcaaagcattttgcctatgttttcttctagtagtttgatagttttgggtcttagggtttaagtctttaatccattttgagtttatttttgtatatggtgagagataaggggtgtagtttcattcttccacatgtgaatatccagtattcccagcacaatttattgaagagactgtgctttctccaatgtatgttcttggtgtctttgaaatcagtgagtataaatatgtaggtttattctttcactattatgtttcattgatctatatgtctggttttgtaccagtaccatgctgttttggttactatagccttgtaatatattttgaagtccagtggtgtgataccttcagccttattctttttgcttaggatttctttggctattggcctcttttttggttccatatgaattttagaattgttttttctaattttgtgaaaaatgactatggtagtttgcattgactctgtagattgctttgggtagtatggtcattttaacaatattaattctcccaatccatgtacatgggatgtctttccatttgtttgtgtcctcttcaatttctttcttctgtgttttgtagttttcctatagagattgtccacatgcttggttaaatatatttctaggtattttattttttttgtagctattgtattgccttcttgatttctgtctcagctagttcattatttgtgtatagaaatgctgcagatttttgtatattggttttgtaacctgcaactttactgaattcatttattacatttaagagttttttggtggaggctataggttttctagatataagattatatcatcagcaaagagtggcaatttgacttcctctttccagtttggatgcattttctttctttctcttgcctaatttctctggctaggacttgaagtagtatattgattaggtggtgaaagtggacatctttgtcttcctccagttcttagagaaaaagcttttggtttttctccatttggtattgaagtggcatcatttggggaaatagccaaggtttgttgtctcgcactaaggaaatcgaagacgtggacacacaatgagtgggtttaagagcagaaagtttaataggcaaagtaaagaagagaaaagctcccctgtgcagagagagtggtgttctgaatggatctccctctttgaggccagatgcgttttttttttttttttttttctttctaagaatctgactctgtcgcccaggctggaatgcagtgatgcgatcttggctcactgcaacatcctcctcccaggttcaagtgattctcctgtctcagcctcctgagtagctgggactacaggtgtgcgccaccacacccaggtaatttttgtatttttagtagagatgaggtttcgccatgtttcacctcctgacctcaggtgatccacctgccttgggctcccaaagtgctgggattagaggtgtcagccactgtgcctggctgtggttggttttatagaggggcttttggaggcggtgtctgatttacatagggcccagaggatttgttggaccaggtgtaccatttgcatagtgcactaagaggctggccatcccaccctaatcttttattacgcagatggggtcttttcctggccagtgtagacgcctgcacacatggcaacaaaagggaagggaaaatctccatgttgaatatacctggcttccaggtatcccttttctgttggcacagcttccagcattccagcttgcttatctatgcttgcagcttgatttttcaggctgctttttgttagaaaagaaatgattttggggctgtttttttttaaaaggaaattccactgagaactcttttacccttactaactgcctgaataatttctttttaactcctgtaacagtatgatattaactgtgggtttgtcgtatatgtccttttttatatcttggtatgttcctttcatgcttagtttgttgagagtttttatcgtgaagggatgttgaactttatcaaatgctttttctgcatctcttgagatgataatatggtttttgttcttcatgttgctgatatgatagatcacatttattgatttgcatatattgagccatccttgcatccctgggataaatctcacttgatcatggtttattatttttttaatatgctgctggatttggtattttttgagtatctttgcatctgtattcatcagggatgttggcctgtagttttcctttttttgttactttaatatttgggtttggtgttaggttaatcctggccttgtaaaatgaattagggacaattgtctccttttcctttttttttttttttttggactagcttgaggagaattggcattaattcttctttgaaagtttggtggactttggccgtgaagccgtcctgtcctggactttcctttgttgggagactttttattactactttgatcttttcagtttttaatggtctgtttaggttgtctaaatattttttcttgattcaatcttagtaggatgtatgtgtctaggaatttgtggattttctctatgttttccagtttgttagtgtatagttatttataataatctttgataatcttttgtatttctgtggtatcagttgtaacgtgtccttttacatttctgattttgttgatttgggttttctaatttttttttgttgttgttgcttaatctagcaagtggtttattggtagaccacatcttttcatgttgatcctttgtattttttttttccacctctatttcatttagttctgcttttatctttattatttatcttcttctagtaattttgagtttggtttattcttacttttctaattctttgaggtgcatcattagttcattttaaacctttctgcttttttgacgtgggtacttattgctgtaaacttccttcttagcattgcttttgctgtatccaatagcttttagtatgttatgttttgattttcatttgtttcaaaaagtttttttattttctctttaatttattctttaatcctttgatcatttaggaacatgtttttaaatttgcatgtatttgtacagtttccaaagttcctcttttcattgatttctagttttatttcattgtggtttcacaaggcatgattttgatttttaaattttttttgaagtttttttattattatactttaagttctaggacacatgtgtacaacttgcaggtttgttatatatgtatacatgtgccatgttggtgtgctgcacccattaactcatcatttacattaggtatatctcctaatgctatccctccctgctccccccaccccacgacaggccttggtgtgatgtttcccttcctgtgtccaagtgttctcattgttcaattcccacctatgagtgagaacacgcagtgtttggttttctgtccttgcgatagtttgctgagaatgatggtttccagcttcatccatgtccctacaaaggacatgaactcatcattttttattgctgcatagtatgctatggtgtatatgtgccacattttcttaatccagtctatcattgatggacatttgggttggtcccaagtctttgctattgtgaatagtgccgcaataaacatacgtgtgcatgtgtctttatagcagcatgatttataatcctttaggtatatacccagtaatggaatggctgggtcaaatggtatttctagttctagatccttgagggatcgccacactgtcttccacaatggttgaactagtttacagtcccaccaacagtgtaaaagcattcctatttctccacattctctccagcacctgttgtttcctgactttttaatgatcgccattctaactggtgtgagatggtatctcattgtggttttgatttgcatttctctgatggccagtgatgatgagcattttttcatgtgtctgttgactgcctaaatgtcttcttttgagaagtgtctgttcatatccttcgcccactttttgatggggttgtttttttcttgtaaatttgttggagttctttgtagattctggatattagccctttgccagatgagtacattgcaaaaactttctcccattctgtaggttgcctgttcactttgatggtagtttcttttgctgtgcagaagctgtttagttagatcccatttgtcaattttggcttttgttgccattgcttttggtgttttagacatgaagtccttgcccatgcctgtgtcctgaatggtattgcctaggttttcttctagggtttttatagttttaggtccaacatttaagtctttaattcatcttgaattaatttttgtataaggtgtaaggaagggatccagtttcagccttctacatatggctagccagttttcccagaaccatttattaaatagggaatcctttccccattaattgtttttgtcaggtttgtcaaagatcagatggctgtagatgtgtgatattatttctgagggctctgctctgttccattgatctatatctctgttttggtacctgtaccatgctgttttggttactgtagccttgtagtatagttggaagtcaggtagcatgatgcctccagctttgttcttttggcttaggattgtcttggcaatgtgggctcttttttggttccatatgaactttaaagtagtttttttccaattctgtgaagaaagtcattggtagcttgatggggatggcattgaatctataaattacctttggcagtatggccattttcacgatgttgattctccctgtccacgagcatggaatgttcttccatttgtttgtgtcctcttttatttcattgagcagtggtttgtagttctccttgaagaggtccttcacatcccttgtaagttggattcctaggtattttattccctttgaagcagttgtgaatgggagttcactcatgatttggctctgtgtttgtctattattggtgtataagaatgcttgtgatttttgcacatgattttgtatcctgagactttgctgaagttgcttatcagcttaaggagattttgggctgagatgatggggttttctaaatatacaatcatgtcatctgcaaacagggacaatttgacttcctcttttcctaattgaataccctctatttctttctcctgcctgattgccctggccagaacttccaacactatgttgaataagagtggtgagagagggcatccctgtcttgtgcccgttttcaaagggaatgcttccagtttttgcccattcaatatcatattggctgtgggtttgtcataaatacttcttattattttgagatacatcccatcaataccgaatttattgagattttttttagcatgaagggctgttgaattttgtcaaaggccttttctgcatctattgagataatcatgtggtttttgtctttggttctgtttatatgctggattacgcttattgatttgcatatgttgaactagccttgcatctcagggatgaagcccacttgatcatggtggataagctttttgatgtgttgctggattcggtttgccaggattttattgaggatttttgcattgatattcatcagagatattggtctaaaattctctttttttgttgtgtctctgccaggctttggtatcaggatgatgctggcctcataaaatgagttagggaggattccctctttttctattggttggaatagtttcagaaggaatggtaccagctcctccttatacctctggtagaattcggctgtgaatgtgtctggtcctggacattttttggttggtaagctattaattattgcctcaatttcagagcctggtctattcagggattcaacttcttcctggtttagtcttgggagggtgtatgtgtccaggaatttatccatttcttctagattttctagtttatttgcgtagagatgtttatagtattttctgatggtagtttgtatttctttgggatcggtggtgatatcccctttatcattttttattgcatctatttgattcttctctcttttcttcttcattagacttgctagcggtctatcaattttgttgattttttcaaaaatccagctcctgctcctggattcattgatttttttgaagggttttttgtgtctctatctccttcagttctgctctgatcttagttatttcttgtcttctgctagcttttgaatgtgtttgctcttgcttctctagttcttttaattgtgatgttagggtgtcaattttagatcttttctgctttctgttgtgggcatttagtgctataaatttccctctacacaatgctttgaatgtgtcccagagattgtgtgtctttgttctcattggtttcaagaacatctttatttctgccttcatttcgttatgtacccagtagtcattcaggagcaagttgttcagtttccatgtagttgagcagttttgagtgagtttcctaatcctgagttctagtttgattgcactgtggtctgagagacagcttgttataacttctgttctttcacatttgctgaggagtgctttacttccaactatgtggtcaattttggaataagtgcgatgtggtgctgagaagaatgtatcttctgtcgaattggggtggagagttctgtagatgtctattaggtccgcttggtgcagagctgagttcaattcctggatatcgttgttaaccttctgtctcattgatctgtctaatattgacagtggggtgttaaagtctcccattattattgtgtgggagtctaagtctctttgtaagtctctaaggacatgctttatgaatctgggtgttcctgtattgggtgcatataaatttaggatagttagctcttcttgttgaattgatccctttaccattatgtaatggtaaaggataccattcttcgaagaagaaaggtagcttctttgtctcttttgatctttgttggtttaaagtctgttttatcagagaaaaagaattgcaacccctgcccttttttgttttccttgagttttcttttgtgtcctaacatatagtctatcctggagaacattttatgtgctgatgagaagatgtgtattttgtagctgttgattgaaatgttctgtaaatgtctgctaggtccatttggtctaatgtgcagtttaaatccaatgtttctttttctgtctggatgatctgtctaatgctgagagtagggtgttgaagtccccaactgttattttattggatcaaataacactggtgccaagaaacggtgccagggagcccaagacaggcactcttagactgccactgtcacccctacggcccaaagattggcccagggccaatttctccctttaaatgtattaatttcttcctttaaatgtaataatgtttgctttatatgtctaggtgctccagtgatggctacatatttgtttagaattgttatatccttttgctgaattgatccctctatcattataaaatgaccttctttgtctctctttattgtttttgacttaacatctgttttatctaattagagttactcttgctcttttctagtttctgttttaatggattttttttctatccctttattttcagcctctatatgtctttacaggtggtatgagtttcctgcagttggatcatgtttttctttttttttctttttaaaaaatccattcagtcagtctgtgttttttaagtggaaggtttaatttgtttacaatcaaggtttctattgatatatggggacttaattatacttaatttttttgtgtataaaatgagaaggttgtcttaataataacaaagttactattatgaagcatttattatagtattaaatattaagcattttacttagaatctcattttatatttagaaaaatcttatattctaggtggaagctccacaattaaactgaagcttagagaaattaggtaagtttgcccaaggtttcacagctagtaagtaggaaagctagatttgactgcatagctcatgctgttactcctttacagcttaaggtgcttttcattcatccatccattgattgattgattccataagtgtatactgaggctaatcattagtaattgttggctatgttaagtacttttcattgtattttattatgatgggaagtcactgaaggattattagtaggggaatgataggagtagaattatgtttttaatcattctggttgcattctggatagttgaatgttataggaaagggataagtatggaaataagaagaccaggttttagactattgcagtagtccagttgagagtgggtggtggcttggactgaaatggtagttgtagagacagggatcagtggttggggtatcgtggggtgctagaatttaaaaattcttataattagtaagatacagaccagacaccaatcaaaatggatggtggccattggactagagtaagatcttgatgtgccgtgttgtgccaggcattacccctctagttatctattgtagggaggtttgaattatctcaagtgaggagtcaggggaacagggacagcaagactgataacgtgcgatgctgaggtacatctacttaccaacagtcattgaaacttttatactttaacatgtggaaagactgtaatccctgcatacctaattaatattcagtttgtttgtgggttggttgtatggggtgctggagaaagaggcaacttaagaatggcaccaaagtttttgccctgagcaactggatgaatggaagtgccgtttactcagctggcaaacactgctgaaggaattggtttgggaggaaacgatcaaggttttagttttatacatgtgaagtttgagatgaccctctatagatatccaagtggaaatgtaaagtagtagtttgaattcatgagagattgtggggctggacatatacatttgggatatatcagagcacaattctactctgtatgattatgtagtagctttttcccttaaaaaatctctcagcagcccgacactaatgcttaaagttacagtgttagaaattcatttatactctttggttttttaaaactgtgcataacctgcggagaagattctttttgaaattgcactataaggtgaatttgtttattacaccctttaaaaaacagctgagatatactaccttgagaaattgtcatactgattgagaaaagtaatgcagagagagttatggggatatattgcatgagatactaaagtatgaagtggtagaataatttttatggatatatttttataaaaaaggagtcttgcacatatagtatgttcttattcataagtgggggctaaaaaagttgatgtcatggaggtagagtagaatgatggttaccagaggctgggaaaggtttcggggagagagggatgacgagaggttggataatgtatacaaaaatatagtcagacagaggtaatatgttctagtacaataacatagtagggtgactatagttaataatttattatatatttcatagctagaatatttggaatgtttacaacacaaatgtgttcgaggcaacagatatcctaattaccttgttttggtcattacacattgtatacatgtatcaaaatattacatgtagaccataaatgtgtataattgttcagtatcagaaaaaaaattttaaaaagtggactcttgcttagatgtccttaagtgtagatattagtattagctgtttaatgggtggggaagtctttttgtcgttgtttgtgttttaaattaatattcagttaattagtatacattttaagtcattttggttatagaatacagaaagcttcaaattaagacatctaatttttttcttaaatctttgaattatatttataaatcttgtcattctatttataaatggattaatttagagtaaaataaagacaacatatagattgggctacagacctataacatcctggaactgcattccctgcattcttgcctccttgcctgttcctctatcttcagatccgggactgcagcatcttgctttgatagtcacattgcttccttctgcagtcaaatctccctctcttataaggacacctgtaattatatttagagccaatttagataattcacgataatctctcccaaatttcaaaatccttaatttaatacatctgtaaagttccttttgccatataaggtaaaatccaaagcttctggtggttaagacctggatacctttgagggctattattcagtccactggaaacttgttctgcagtattttgctttaatgcagatttgataaatatattggtgatttaaaaatgtacccaattttcaagatttttttcatgccagtgttctctatcaaactcttttccaagtaatacccacatattacttggctgctttcaactctgtgcctttgggtggtggcctgtttttaatgttttatttagaaataattttaaagttttagaaaagttatacaagaataagaatagtacaaagactatctgaatgtccgtttcccagattcacctattaacattttactctattttctttggtataactgacttacatgttaaaataaatctatatttccttttatgaaaatagatacaacatttataccaatagatgcattatatataatttctatatgatttcatgtcttttcagttaaattagaggttggcaaacttttctgtaaaaggccaggtagtaaatactttttctttgcaagttacatggctctgttgcaaccactcagctctgctaaagcagccatagacaatacttaactgaatgaacatggctgtgttttaataaaactattaaatgatttctaagttactgtaattaaattaaaaaagaggttcctttaatatctctgattactaaggaatagttcacagtcttttctcactcagaaataatagttttctatagctgatttaaaatattatcattatcaaagagataatctgagatacttcctagtttgtacctgaaaaatacagagccatacaatgtaagcattgaaaaaaatcttgaagatgaatcaattaatacctgggtgagtgaacacatgaagacatgaaaactgtatgggtcaatatttcttaaatcagactctgcttgggagttttaaaattttgttattaaatgacaatctaaaactttttgatataagcaaattgaagattaactgcctgatctcataattgagtaatgccactgtattgtaatgccagcagttgtgttgacaatttaaagttgggattaagtagtatccctttaattactgtaggctaaaaacaatacaactaaagtgtactaatacttttgtgacaagtgaagggtaaatgattatatgccatagtatatgaatttaaaagatttgtaaaaagtaggttgaagaaaaatggtgggagaattatgttgtcaaaataatgtaggtgtgctaaaattatgtaaaaaaggcattatgagaattaatatcatttttaacttgggacccattattttaaacaaaacaatattatcatattcagtaaatattagttttataaatttacttatatataatttataaatgtatgtttgttttatgcttataaaagaaatttaaacataggagtttatgtctagtatttgagaattttttagtttcattaaaattaaaatactttgtgagccctaaagtttgatgaaaatatattccctttaggagaattccttctattatgtttgagaaacactgatggggaaaccaagacttatgagtaacatcatgaatatggaaaggaaaaggctgtgttttcaactttatagtatttgaaattattctgcactaatttaataatttttattttatgatgcataatttttttttctttttgaggactccactgaagcaaactttggttgtccttaataatgctaaaaaaaatgtaatcttttttatgtttgtttaatagttaataatttttaaactttaatttttaaatgcttttacttccactattttaaaaaaataaatatttattataacccttggtggtagattattatatccatttgtgtagatggaggcttgatgatgaaagaggtaaacatacttccctgacagaactgatatttgagtacattgttttctattttaatactcttgtagcatactaaaataaatctgacattttatattatttaaataattctttaaaattgtgaaatttatttgaacatccaagtccgattgtgagtatatgacttttttcgcctctaagcattacattttctgtgagtattattcttgtaagttatatttcagataatttatgtatatatttgttaatatgataaacattgaattcttaaattctcttaatccatatgttgtatttctataatctgagggctttgtttaatctagtgtgttgtttcattttttttttaataggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaagtaagtatttattttcagattcttgctgttttttaagctggatttttatccaaaatgtcttttttttttaattgttgtccgagagtaaaagtggttatttttgtggtagtgtctatttgctagtgagactgatttgtgaatacatgaactcagtatgtccatagctgtcattgcacatagaagtatgcttcatgtagaaatgttattacttctctagagtacttttaataaattctgagtaagaaaatattaacttcaaatacaggcaggccttgcctataatggataaaatgaatcaaatgaatcatgccacctttttttttaatgaagtataatctcatatataaaaatcctctcaatttgttctgtaaattttagtgtacctgaactttactttgtatgtgctttacaaactttcattgggagaacagttctagtattatgagagagatgattgatttactgttggctcaatagagattgttctctgcatgattggataaggggaatcatatggatggcagctttatctgatttctttttcagctaatgattgtattttatgaactgtttagtaacaatacaaaaggaaatagggagaatcatttgatttttaatgttgcttccaggggtagtgttcatattatgtaataactggtacagcttgggcatcaaacaatcagaacttgccctggacagtatggcataatggtgtatacacaatagaattgccagatttagcagataaatatacaggatacccagttaaacttgaatttcagataaaaaacaagtacatttttagtataagaaggcccttttgctgtatatatatatattttttacaaattttgcatgggtcattctttaacaaaaaattgtttgttgtttatctgaattcaaatttaactgggtatcttgtattttatctgccaaccctaaccactgaatatattaaccctcataattaggaagatttcagaaattctgtaagaggagattgctttaaaactatgattgaatgcgactgaaattaaattagaaaatcgaataaattctggagagaaggagggagttttatgtaagtatttaagtggcaaattagaattttttaacatgaagaataaaatacagaaggaagaattgaaagagagttggtgggattaaaatgaattgttaagataaaaacctggagaaataatgatatttaaatgtgaaaattaaaaggaaattaactatgtttaaagaaaatgagaagtctatgaaagtagagtcgaactttgaattaaattgtgatatttccaaagtcgagtttgtaagacaaagagcaacattgtcaacaaggaagtttgtaaattttaagttcatgttctttgcaagatgagtagcatatcaaaaattaaatgatgaatattatttgctattcttttaaatttgcatattttccattggaaccagataaactatttaagccaacttttttttgtctgaaatctgagtattttggttacagtgtttatataaacaaatgagggattagagtagaataattgtgttgctgttttcacaggttagagaatacttttcatcattctgaatgtagttcaattgtaggtaaggataacagctttcagaagtgataggataagtcataacttgatttaatcatcttctatagtggaatttaattggggtggaaatgttacattttaagacaaattattcactaaatataaaagctctgtgttagtgtctattaaattagaaagacttttacagaatatatatacattaacattaatgaaaattaacatgtattcatgaggatagcaaacttttgaaaacactacgtgcttgtttcttgggatatatcattggatataacaaatgcccgtgtctttgtaaagttagggaggaaaggctggcaatgacaaaaaaaaaaacactattaccaaagtaaattatagacatgaacatatatacatatagagacagatgggatggatggatggatagatatagatagatagtaggagtaggtaaatcaggagtgccaaagaagagggagttgcaattataaatgtaatagttaaggtaggcttcataacaaaggtgagaactgagcaaaaacttgaaggagatcagaggattgcagttatttgtaggcgcagaaaagagccagatcaaagacttaagataggaactccttgaggtgtttgaggagcaacaaccaggcccatgcaatttgcatggaatatatgagagggatacattaaattagagtgataacagaggagagagacagatcatgtaggatgttgtagatcttttgggagtcatgggagggttttgagcatgtgttgatccatattttaaaagtgttaccatggcggtttattgatgatatactggggattaggaggaagattagaaacgggatttgagttaagatgaaattatcaagggaatgcattctagatagagaaaaggaccgggaactgagcctgaggcaccatatcactaagaggttgtggggaacaggggaagccatcaaaggagactgaaaaagaatgactggtgagataggaaaacctggagtacagtatcttcaaaggcaagaaaaggcattatgtgaggattaaggagtaattaataatgtcaaatgctgacgattatccaggtcaaggaaaatgaagactgaaaactggtcatggatttagcatgaggaaattgaccataacaaaagcagttttagtggaggggaggggttaaaagcgtgtctagagttagtttaagagagaatggaaagtggggtggggatgggggtaataaagaaatgggggagtagcttaagggacagtgtggtcaaggggtttttcttttattattaatggtttataacaccatgtttgtgtgctgatggcaaagatctagtaagacaaaatatggtgatgtaggaaagagatctcgtgtgcaaggaagaagaatcacttgttattcttcggcttatcaaactgcagaataggggctcagggcctggaaactaagaattttttcttagcgtttttagtttttgctttttttcttttatttgattattttattttttcttttatttcttttattttttcttttattttcttgttttattttatttgcttttttcttttatttctttttatctgtcacccaggctggagtgcagtggcgtgatcatggctcactgcagccttgagcttctgggcccaggcgatccttccacctcagcctcctgagtagctgggattataggcatgcaccactatgcctggctaatttttaaatttttttgtagaggcggggtctccctatattgccctggctagtctcttaactccagtgctcaagtgatcctcccacctcggcttctcaaagtgctgggatttcaggtgtgagctaccgtgcctggcctggattttgtacttttaatgggctgtaaaaaaatgaagaatatgtgagaccattgtggcccacaaagcctaaaatatttactgtctggccctttacagaaatagtttgtacagccctaatttatgataacttggaaagcagtgtgttggctgcagatactggtagatgggtggactagtggtgtgaatctgtggaagttatgttctgattatgtttcctcgtttgtatcatacacatttatcttacaattccaaggtaggaaataagttaaacaatgctgcaatcaaatttggtaacccttacctttcttgtgaaggggcacttgggcacttcctttcctttcctaattcattggaggaagaaagagaagttgggaagataacaattgatagcaagcttcttaaaacaggctcctgtttcttggctggatgcttccttttgtatattttagcaaatggaggaaatttgagcatagagtataagcatttgggatttataatttgggacttcagttttcatatgtattacaccagtagaaaaaaatacgaattttcttttcatgttacataatccaacagtgacttatttttatagaagcttctctactgccaaattcattttatacagtcttaaaaaattatcagtaaacaagctatatttgtgcataggaaataaatgcttattggttaatttatataatgctaagataagtgtgtgggtatgtaaagtagcacagtcattatggtaaacagtgcggaggttcctcaaactgaaaatagaattactatatgatccagcaaacccactgctagatatgtagccaaaagaaagtaaatcagtatatcaaagcgatatctgcactctcagatttattgcagcactatttacaatagccataatatggactcaacatgtgtccatcaactgataaattgataaagaaaatgtggtatatatacacaatggagtattgtttagtccccctaaaatgaaatcatgtcatttgcagcaatatggatggaacaggaagtcattataagtgaaataaaccaggcacagagagacaaatattgcatgtcttcactcaaatgtcagagctataaaagttgatttcatataggtggagagtagaatggtggctaccacagcatgagaagagaagcagggagaaggggacaaagagaagttggttaatgagtgccaaaaagcaattagatagaaggaataagttgtagtatttgatagtaaagtagggaaattatagttaacaatttattgtatatttcaaaatagctagaagagaagaaatgttatgctcccaacacaaagaagagataagtgtttgaggtaatagatattctaattaccttgatttgatcattacacattctatacatatatcaaaataccatgtgtataccatatatgtacaacttaaatatcaataaaaaacttataagtatcaggccaactaaaaaaaaggaataaaaataaatacctaaaacaaaatggagagaattttcatctgtttccaagaaggaaacctggcttaaaaaaaaattaaaaaatacagtcaaatcactattgtttagcttaatcaattgatggaaattattaaaggcaattggacaattaattccagtaataaatatcctaatcaagttaatgtatattatacattcaggagactgaatcctaatttagtgtaggtatatcttgaatgagtctttattagaaatttctaatatggcacatgaaattatgagtttattagttgtaactctttttgaatttaatgaatacttggacacaagtgaataaaaagcacgtgaaaattaaaaaaacaaaaatgaatcttagcttatgaagttattttcttttcttgcttttagttacaatttagaaagcagtatatggaatgtaggaactccatcaaggggacctctccagagatatggacactctcttgctttatatcaggtatggctcctgctttttaaattttaatcagattttgtttttgatagtttaccacaggctaaaaaatactaaatctcagatttatttcaaatatttaatgagaacaatagattatatggatcatgataacttgagataccacatactcttatgcttttagtaaaagaatagattttagaacaatcccccacatgacatgtaaagaaatgaagattgagtttttgtctatttatgcctagtcaatcacttaaaaaaattatggcgaaatacatgtaacataaaatttaccattttaactatttttaagtatagagttcagtggcattaagtacattgacattgctgtgtaaccatggctaccattatcttcagaacatttttcatcgggcaaaactgaagcaataacttctcattcccctcttcccttatcctcttgaaaccaccaatctacttttctgtctctgtgaatttaactgctctaggtacctcatgtaaatgggattgtacattatttgtccttttatgactgatttgtgtcccttagcacactatcttcaaggatcatccatgttgtatcatgtgtcagaatgtccttccttttgaagctgagtaaatattccattatatgtatataccacattttgtttatccatccatctgttgatggacacttagatagcttccatcttttggccattgtgaataatgtttctatgaacatgtgtgtacaactatctgagtctctgttttcatttttttttggtgtatacccagaagtggaattgctaaatcgtatggtaattctatgtttaattttttttttttttagcactgccatagtgttttccactatggctgcaccattttacatttccaccagcagtgcacaagggttccagtttgtccacagccttgtcaacacttgttattttctgtttttgtttttttgataattgacctaatgagtatctcactgtgattttgatttgcatttctctaatgattaatgatgttaaatatcttttcaagtgcttattggctatttgtatatcctctttggagaaatgtctattcaggtctttagccagttttgaattgggttgttttgtttggttgttgagttggaggagctctttatatattatggtattaacaccttatcagaatatgatttccagatattttccccctttatgggctgtcttttcactttgttgagagtgtcctttgatgcacagaatttttaattttagtttaatttaattttaattttaatttattttttcttttgttacttatgcttttgtgtcatatgcaagaaatcattgctagatccaatgtcatgaagcttttcctctatattttctcataagagttttaaagttttagttcttaggtttaagtttttgttgcattttgagttaattgtgtctgatgtaagggtccattttcattcctttgcacgtggatagccagtttccccaacatcgtttgttaaaaaagaaactgtctttttcccattaaatggtcttggcaccctagctgaaagtcctttgaccatgtatatgagggtttttttttctggactctctattttattctattgatctatatgtctgtctttatgctagtaccgtactatttagattactgtagctttttaataagttttgaagttaagaagtgtgatacttcctactttgtttttatttctcaagattgttttggctattcagggtcccttgaaagtctatatgaattttaggattaagtcttctatttctgcaaaaatgttggggttttgacagggattgtattgacattagttatttttatgtatttgtgggattcataaatttagcatgattaaaatgacaggacacttgtttggttttcattttgaatcaacaaaatttcatgtattttgtggcctttggctaggctgtctaaatatgaatttatatgttttctgtgctgttgttaaaaaaaattggaaagcatgggagcagtataaagaacaaactaccacctgtttatccatgcatttgtgtgttttaaaagtaaaataaaagtatttctatgtatgaaaacatatacctacattttttgccttgttttattttttctttatttccctttttgtaacagccttactgagatataattgatataccatacatttcactcatttaaagtgtacaattcagtggtttttagtatattcagagttgtgcaaccatctattgcagatttatgtaagattacagagttgtgtaatcacttttagaatactttcattacttcacaaagaaactttgtatcctttcggtatcaccccacacttcctcgtcttccctagccttaagcagtcacaaagctactttctttctctatatattggtccatgctggacatttcatataaatgaagtcatatactatgtatgttatgactaccatatttcacttagcataatttcaaggtttatccatgttgtagaatgtatcagtacttcttcattcctttttatggctaaataatattacattttatggaaatataccgtgttgtttattcatcggttgaggacatttgagttgtttccaccttttggctattatgaataatgctactaacaacattgctgtttaagattttgtctggacatatgttttcatttcttttgggtatatacataggggtggacttactgggtcaaattcactttttgaagaactgacagaatgttttccaaagttgctgcatcattttacattcccaccagccatgtatgagggtttctatttctatacatccttgccaacacttattagtatctgcctttttgattattgccatcctagtgggttgaagtattatctcattgtggttttgatttgtatttccctgttaactaatgatgttgagcatctttttgtgtgcttttggccatttgtatattgtctttggagaaatgtctattcaagtcctttgcttattttaaaattaagttgtccttttattattgagttgtaagaattcttcatatgttctagatacaagccattatcaggtaaataatttgcaaatattttcacccatttcgtgtgctgttttcactttcttgatgttatctttttaaacacaaaaaattggactttatcttgataaagtccaatttaactttttttccttttattgcttgtgatttggtgtcatatttaataattcattgccaaatctcaggtcataaagacttaacccaattttttttttcttttaagagttttatagttttgattcttgcatttagttctttgacctattttgagttaagttttgtatatagtatgcagtaagggtgcaagttctttttttttttttttgcatgtgactatccagttctcctagcaccatttgttcacaagacattttcttttgtctttgaatggtcttggtactcttgtcaaaaatcaattggccatagatgtgtgggtttatttctggactctcagttctattccattgatttatcccagtatcactctgttttgattacttttttttttttttttttgagacagagtcttgctctgtcacccaggctggagtgcagtagtgtaatcttggctcactgcaacctccacttcctgggttcaagcgattgtcctgcctcagcctcctgagtagctgggattacaggcgcctgccaccatgcccagctaatttttttatagttttagtagagatggggtttcaccatgttggccaggctggttttgaactcctgacctcaagtgatccactcgcctcggactttcaaagtgctgggattacagtcatgagccaccatgcccaacctatcttgattacttttgctttgcagtaagtttttgagaagtgggagtactccagttttgttcttttacaagattgttctgatgttctgcatcccttgcaatttcatatgaattttggaatcaatttgtcagtttctacaaagaagccagctgagattttgatagggatcatgttgaatctgtagatcaatttggagagtattatcctcttaatcaatttggagagtattatcttaacaatgttaagtcttcagacccataaacatgggatgtcttttcatttatttatatcttttaaaaatttatttaaacaatgttttgtaattttcagagtataaggtttggacttcctttattaaatttattcataagtattttattcttttagatgcttttgtcaatgtaattattttcccaatttcatttttggggtgttcattacaagtgtatggaaatacaatttactttttgtacattgatcttatgttctgtaatattgctgattcatttattagctctaagtgctttttaaaaaaatttttaggactttctatataccagattgcatcatctgcaaatagaaatattttacttcttctttccaatctggatgtctttatttagtttttgctctagctggaacatccactacaatgttgaatataagtggcaaaagcaggcatgcttatcttgttcctgaccttagggaaatgtatctagtctttcactgttaggtataatgttagctgtgagtttccttaaatatcttttgtcaggttggaaaaatttttttctatttctagtttgttgaaataatgataatttacatcatttatgtaccatttatttccatcatatgcatttgaaataatttgtataatttaaaagttctacaaggatttaccaaaggtgaactgaaggcatgtggtgtctgtctatagccattagaaatggtaacagaggtgtactctacatgatgcacaaatgtgatatgtctttttggtgaagagcacgtgatgaaaacagtaaataactgagaatagcacaaagctactagggactcagatgattcaaatattgaagactatgagtaatattaatcaacaacttagtttgttatcttcagttatatgggaggagtacattattctttgttataggactacctcacccttaaattgtaagttctttattagcttattgcattttccattcttaaagcagtagtttagtgttctcttactgtatgacaattaaaagtatacttaattgactacataatgtgatagttaaaaaatatatttaaagtagctttttgaaagctttgctgtttccccccctttttgtatataaaagcattagttgtcattattcatgtgttctcattactttttacaaatgagaacaatgccttatgcatgttgtgaacaattactaaaattttatgtaaatttaacctttatttttaattaatatgtgttaagatataacattattttatctattaatatatgtattttaatttacaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctaataaaatcttcatatgaattta

SEQ ID NO: 998 - DNA, 78002 bp, Homo sapiens; identical to SEQ ID NO: 997

SEQ ID NO: 999 - DNA, 855373 bp, Homo sapiens
agttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagtaagtgccttcgccggaccccgaacctccagccctgcctcgctcccgtcgcggccttccccgcccccctcgcggcctcccccgcccccgtcgctgcctctgatcccccggccgtgagtgaacctcagcgcgcggcgggagcgggcgagagtggggcccgcgccgcgccccctccagccccggggcgccccgggagagctcgggcccgcgcggagccctgaccaacggggagctaggcatttctcgagcgttccagatgtccgcagcgacttctgatccgctgctcagcacgaacattttcacaatcagttatgatgcccagcaccattttcttgggataatatttaaaaatcagaaattgtccaagttacttatgaaatacatgcgcattgtgaaaaattcacaaaagtgtaaaggttcagttatgatctatgagtgcctctctctttccccatcctcttctctctagaggtgaccccttctaacatttatttagtcatcatagtgatgttaataagtagagtttatgatggacttgctaagtgccaaacactcttctaagcgctttatgtcaattttctcatttattccctacaacaactctgtgagttgctagaattattatgctggatttacggagagaaatcgaggcgatacattgaagtaacttggccaggattacacagtagtaagggccgagttatgattccaaatcagctggcacattctggagccagtacacactccagaatgtgtacttttaacgaatttgctgtgttgtatttgctaggacaatcttgaattgagaaatacaaaggtgactttaggttagatagaaggacgtttttatgtggtgaggataatggatttttttctgatcggttaattcactgtcagcttttgtgcgggaacatcgctttggcttgtttgaagctcaaggagcctaagaagtttgcttgctaaggtgaaggtactttcttcgtactggttggtgtttattacattcttgcctgatataaaaagcaatgggtcacagtgtaggggagtagcaaaagtcacttaatattggggcaggcttctaacaacatgcaggtaacagtcattaagaaagtcagcttcttagtcttctagatacttaatatgaagtttgctggctggtttgtggctcttgaatattgtagattactgatattgttaggctgatagccaaaatctaggtgaaatttctcttgggctctaaggcaaaggtaagactggttcaccttattaatgtattctaggacaatttcctggaattttaaacacagcatactttcctttttttttttttaaaaaaaaacttactattactgattaaaataaatgtcccttaaaactcaatgtaaaaatgtatatttttaaaatggcactttaaaattttaggtagagtctatgatttaaattaactagtaggttttggaagtgaaatcttaaagtgaagttttatgaaacttatgcaataggttgaaatttttctagggtttatactttaaaggtagtatagtaatgtagttttaaaaatactttttaaaaaaattaggagagatgctgattaaaagtttaaaaagtgtttcaagatgaggaaagagatcttaatgaattctgcttgttagttgtttttttttgcttgtgttcttaaacgtttgctatgacagtagaattcagcgtctttacctagcaagagagaattttgaacatgtaaactggtagtcagcagtgaaaaagcctcatccattttttacattttttttacataaatagggagagtgcctgatttatatgtagggatattggcttttgtgtgggtgggtttgctccgtttgtctaaagaggacaaaatttgctgcagtcctgagaagcttcattttaaagtagcggaacttgttaatcagctggatcagcagcctgtgacctcactagcagatgttgtcccagttaaaaagatcacagatcaagttaaaactagcttaaataacattgagaggtggtgttcataaacaaaatacattagtgagtagaagaagaatagatatttgatgtagatattgttaaataacaataaatcctgagctaatcactgagtattcatcttttccttggaagctattatttcctaggactcattgtactctattgggtaaatgcttttgcatttctctgtggaatacaagctattaattagagtaaatataactggtgtaacgatctgtgtttttattatgtatactcttggggataaagaacacattggtatttaatgttaaagagaaggattatgtatagtagaaaagaattcttcttggtaaagtacatgcaaataaacctatgaaaggtttatttgaagatagtagcttgttttacctggcatttgaagtaataacacagtgggaaaggctttaactagaaaatctcacttcactaactatcttgaaaatctttttctaaactgaaggatagcaaccttacaaacagacattaaaaatgattgatcaatcttggtaagcaggtgtcaaaattaattggttggctccatggtaacttagctttttttctactatagggatttcgccagggaataaaaatgttcttcaaatgtttcttgaggatagaagattgatagttgggggaagaaatgcagaagcaaatatagtatcaaaagtggtacttcagttctcttagcattgattccagtcttctgttttcatttgaaaagaataaagcactcagaataacaagccattccttccttacacaggtaaaacaaaaggaacattgatttttcacccaaagctagactaaaggacttgggattgagaataggaaaatatatttgaaatataataatcaaagatacagactctaattcaagttgtatttatttgaatagttcagtgtaatgttaagcaagaaaatattctgctataatctatttgaatgacgttctcttttagaagggagcccttgagaattaattttgtagagtagagatttatataaatttatataaatataaagagtattgctctttatattagtcaaatataaaggggtatatttttacccctcttaggttagtcaaatttggatacttcatttcacgcatttaaaatggaagtatgctgggtgccgtggctcaggcctgtaatcccagcactttgggaggccgaggtggaaggatcccttgagcccagaagtttgagaccagtctgggcaagatagtgagacctcatctctacaaaaaatattttaaaagtagctgggcatggtggcacacacctgtggtcacagctacaagagagagtgaggcggaagaattccttgagctcaggaggttgaggctgcagtgagctgtaatcacgccactgcgctccagcttgggtatcagagcgagactcttcttaaaaatttatatatacatatatgaagcattctatttgtagtgacagcaaaatgaagatgtaatgatataatgtcaggaattaggttgttattatagacaaaaacgggcagaataaagtgtgtaaactcttcccctaagctgttaaaaatatatgcatattgcctggcttggtgtctcacgcctgtaatcccaactctttgggagaccgaggcgggcggatcatgaggtcaggagatcgagaccatcctagctaacacagtgaaaccccgtctctactaaaaatacaaaaattagctgggtgtgatggcacgcacctgtagtcccagttactcaggaggctgaggcaggagaatcacttgaacccaggaggcggaggttgcagtgagcataggtcgcgcaactgcactccagcctgggcaacagagcgagactccgtctcaaaacaaaacaaaaataaacaacaacaacaaaaaacaaatatatatatatgcatatgtaaatacatatatatttggaatcctttttacttgtaaggaaactgacagtaattataaacttaaactgaatgttccctgtccctaagacttctttatttcaaagttttattttaatggataatttatatccatggattatttttacattattaaagtgtataatcacacagtaggaatttaaaataatttaaattgagtgtttcttagattctaaattgataaggtaagttacttgtagaagcatagtagcatggttttcaagaacacgtgtctgcatgatttggcccctttagctgattagactcaggcctcctttcctctgccctgactggccttttgaagttccttgaaagtgtcacattccttttggccttagtgcattttatacacgtaactgtgaactctttcctctctggtctttgcttgggtgattactgatcatccttctaatcttagcttaaatactagtttcttttttttttttttttttttttttttttgagaccgagtctggctctgtcacccaggctggagtgcagtggcgcaatctcggctcactgcaagctccgcttcctgggttcacgccattctcctgcctcagcctcccgagtagctgggactacaggcgcccgccactacgcccggctaattttttgtttagtagagacggggtatcaccgtgttagccaggatggtctcgatctcctgacctcgtgatccacccgcctcggcctcctaaagtgctgggattacaggcgtgagccactgcgcctggccacttaaatactagtttctaaaggaggcttgtctgactcttcacactaggttaccccttatatactgccctaatagcactatttttccttcttagtattgtcaaaaatgaggtgtttaattataattttgatagttatttaaacaaaatttttaagagattgaggtataattgtcaaacagcacaatttaaaatgtacaatttatttaaattatacaatttgataagttttgtcatatgtatttgcatctgaaactgtcaccacaatcaaaatcatgaaaataccaatcacgctagaaagtttccatgtgtttcctttgtaaaccctcccttttctagttgccaattcctgtcccagggcaactattgatctgctttctctcactatagatttgttggtattttctagaactttttgtaaatagaatcatacattatatacttcttttttgtctggcttctttcacacagcgtgtttattttgagattcattcatggtgtgttagtagtttattctactgccgaatagtgttccagtgtctggatacaccataatttgtttatccattcaactgctgatggacatttggattgtttcaaatttttggctgttccttataaagctgctacgaagtttcatgtggaaggctttttatctttgtatggtcatatgctttcctttctcttggggaaataacctgagaatggctggatcatatgggtagatatatgtgtaactgttaaagaaaccgacaaactgttttccaaagtagttgtatcatttatgttcccaccagcagtgagtcagtgttctatctagttaatttcacatccataccaatacttggtatggttagtcttttaaatttttgtgattctaataagtgaatggtatattattgggttttagtttgcatttcccgaattactaatgatattgagtatcttctcatgtgcttacttgccatccgtatatcttctgtaataggcatttattcaaaccttttgcatgttaaaaaaattttcttactgatttttgtgagttctttacattttctggattactagcttcttatgaggtatatcatttgcatatattttctaccagtctgcggcttgtctatgaaaacaatgcaaagagaatgaaatctcttgacagtatttttcaaagaatctaagttttaaattgattaattccagtttatcatttttttcttttatacttttcatgttgtgcctaagaaaagtttgcctaggctgggtactgtggctcatgtgtgtaatcccagcgctttgggagcctgagacaggaggatcacttgagtctaggaatttgagtgcagcctgggaaacaaggcaagacactgcctatacaaaaacatttgaaaaattagctggtcgtggcggtgtgcgcatttagcccatctacttggaaggctgagatgggaggatcactttaacacaggaattggaggctgcagtgagctgagctgtgattgtgtcactgtactccatcctgggcaacacagcaagaccatgtctttaaaaaataaaaaataaaaaaaaaaagaaaactgcctaaaccaagttgatgaagattttcttcattttttttctctagaagttttgtaattttagattttacatttatatttatggtccattttaagttaatttctatatatggggagaggtatggatctaaattcagttttttggcatataggtatttgttttagcactatttgttgagaagagtattctttctctgttaaagtagctttgcacctttgttgaaaccattcatatatttgtgtttctatttctggactctgctttgtttcttgatctctttgtctatttgtatgtcagtacaacaatgtcttgattattgtttctttgtaagtcttgaattctgggagtgtttttcagttttgttcttttccaattattttggctactctgagtcctttgtatttccatatgaattttagaatcagcttgtcagtttctataaaaagcctactaggattttgtttgtaattatgttgagtctatagatcaattttggggaaaatgaataccttgtcagttttgagtttcctacatggtatatctgtttatttatttagttgtttaatctgtcagcagtgtttttaaatttctagtcaatagatcttgcacctcttttgtcagatttttccctaagtagttaatatttttggatgctattgtaaatggcattttttaaactttcacttttgattgttgctattatactgaaacacaactgatttgtgtatgtttgattttttatcttgcaatcttgccaaacttacttattacttgtggtagatttttgcagattccttatggctttctacttagatgattatattgtttacagacaaagatatatttacttctttctttacaatctagatgcctttttttttcttgccttatttcactggccagaacctctattacagtaatgaatagaggtgatgagagtggtcaatcttacttaagatttagggggagatatttgatctttaaccatgaagtatgatgttatctgtaagttttttttttagatgccttttatcacactgagaaagttcccttctattcctagtttgccaagagtttttaccagtgatggaaactggattgtattaaatgcattttctgtgcccattgagataatcatatgattttttcaagtttgttaacatggtgaattatgtacataatttttgaatgttaaaccaaccttacattcctaagataaacttcctctgacacaatatgctttcctttttattttaggttggatttggtttgttaaagttttatttagaatttttgtatctgtgttcatgagagatattagtctgcacttttcttataatatatgactagttttggtgacaagataatgctggcctcatataatgagcaccatgggactctcctgatcatttgctgaaagagtttttagggaattggcattatttcttcattagtgtttggtggaattcaccatcgacaccctctaggcctgaagttttctttaactccaaattcaacttttattaatatacattcaacttatttaatatacagaaggctatatgactagaatcctttaaaatttattggccagaatattgtctatcttggttaagtatttttttgggcgtgtgaaaataatgtgtattcttctattgatgggtggagtgttgtatacatttcagttaggtcaacttggttgatagtcttgttcaagtcttctacaaccattctgattttctgtctgtttttaccacttattgagagaagggtatcttcagttataattttgtatttacctgtttgtccctgcagtcttatctgtttatccttcatgtattttgaaactatgttattaggtgcataaaattttggattatgtcctcctgataaactgagcctttatcgttatccaatgaccatttgttgaaaagactatccttttttcattaatgtctttgtacctttattgaaagttaattggacgtctttatgtatatttattttttgactcttttctgttccattgatccatatctctatccttttgcaaattcctcactttattaatgtatgtatgtactttattaatgtatgtatatgtgtatatatatatatacatacatatatttgagatggagtctcactctgttgcccaggctggagtgcagtggcatggtatcagctcactgaaatctctgctcgtcaggttcaagcggttctcctgcctcagcctcttgagcagctgggattacaagcatgtgccacctcacctggctaatttttgtatttttggtagagatgaggttttgccatgttggccaggctggtggtctctaactcctgacctcaggtgatccacccacctcggcctcccaaaatgctaggattagtatatttttacagtaaatcttgaagttagataatgagattcccccaactttatttttatttttgaaaatttacttggttcattttgtttttcatatacattttagaactgtttgtcaattaaaaaagtcttgctgggatttttattgagattgtgttgacttagtaaatcattttgaggagaattgatatgtaaataatattgaattatctcgttcttcattgcagtatgtttttttcatctatttgggttttcattgattttttacaacagttttttgtagttatcagatacagattctgtgtatatatttttagtgttttttttttttttttgagatggagtcatgctctgtcactcaggctggagtgcaatggcatgatctcggctcaatgcaacccctgcttcctgggttcacgcgattctcgtgcctcagcctcctgagtagctgggattacgggcgcccatcatcacgcctggctgattttttgtattttttgtagagatggggtttcgccatgttggctaggctggtctcgaacttctgacctcaggcaatccgcctgcctcagcctcccaaagtgctgggattacagatgtgagccactgcgcctggtcatattttttgattttataccaaaatattttatgttctttaaggctattgtagttggtagtatttcttttaatttcaatttccagtttgtagactttaaaaaaataatcagggaaatctttctttggtgatatttcctcgcccatatctctttattttttatttttgtggttacgttataggtgtatatatttatgggataaatgagatattttgatacaggtatacaatgcctaataaccacatcagggtaaatagggtattcattacctcaagcatttatcctttctttgtgttataaacaattcatactaattatactttctacccattaaccatccccatttcccccactccaatacctttcccagcctcaggtaaccatcattctactctatctccatgaattcaactattttaatttttagctcccagaaataactgagaaaatgcaatgtttgtctttctgtgcctggcttatttcatgtaatgtaatgatgtccagttccatccatgttgttgtgaatgacaggatatcattcttttttatggctgaatagtactcccttgtgtatatgtaccacagtttatttatccattcatttcttgatggacattttggttgcttccaaattttggctgttgtgaatagagctgcagaaaacattgaagtacagctgtctcttcaatatactgatttcctttcttttaggtaaatacctagcagtgggattgctgaatcatatggtagctctatttttaattttttgaggaacctgcaaactgttctgcatagtagttacactaatttaccttcccaccaacaatgtaagagggttcccttttctctatatccttgccagcatttgtttctgtctgccttttggatatgagctatttaactggagtgagataatatcacattgtagttttgattttcatttctctgatgatcagtgatgttgagcatctttttatttaccttttgacattggtatgtcttcttttgagaaatgtctattcagatcttttgcatatttttgaattggattattagattttttttcttacagcattgtttgagcttattatataatctggttattaatcccttgtcagaatgatagtttgcaaatattttcttccattctgtggatcgtctcttcatgttgttgattgtttcctttgctgtgcagaaactttttaactcgatatgatcccatttatccatttttgctttggttgcctgtacttgtggggtattactcaagaaatctttgcctagtctccaggtgtcctggagagttttcccaatgttgtagtagtttcatagtttgaggtcttagatttctaagtctttaatccattttcatttgattgttgtatatggtgagagataggggtccagcttcattattcttcatatggatatccagtattcccagcacaatttattgaggagactgttacttccccagtgtatgtgcttgacacctttgtcaaaaatgagttcactgtaagtatggatttattctgggttccctattctgtaattgctctatgtgtcctttttttttctcttttttttaatgccagtaccatgctgctttggttactatagctctgtggtataatttaaagtcaggtaatatgatgcttccagtattgctctttttgcttagaatggctttggctattctgggtctttttggctctgcatacattttatgattttttttctatttttgtgaaaaatgtcattggcattttgatagggattgccttgaatctgtagattgttttggatagtatggacattttaacaatattgattcttccaatccatgagcatgaaatatctttccattttttttggtgtcttcttcaatttctttcatttttcccctgcctagaggtttgtggaactttgaacttcagcgagatgatttaaggtatctggcagaagaaatttctaagcagcaaagcattcaagatgtgacttgggtgctgttaaaggcattccattctcaaagggaaacagagcataaaaatttgggaaatgtacagcctgacaatgatagaaaagaaaatcccattttctgaggagaaatttaagccagctgcagaaatttgcatgagtaacgagaagccaaatgttaatttccaagacaatggggaaaatgtccccaggccacgtcagagatcttcggggcagcccctctcatcacaggcctggaggcataggaggaaaaaatggttttgtgggccaggcccagggttcctgtgctgtatgcagcctagggacttggtgtcccttgtcccagctgctctagctatgactaaaaggggccaaggtgcagctcaggctgtggcttcagagggtgcaagctccaagccttggcagcttccatgtggtgttgagcctgcgggtgcacaggagtcaagaatcgaggtttgggaacctctgtctgcatttcagaagatttatggaaacgcctggatgtccaggcagaagtttgctgcaggggtgggactctcatggagaacctttgtatgtcagtgtggaagggaaaagtggggttggagcccccacacagagtccctactggaacattgcctagtggagctgtgagaagagggccactgtcctgcagaccccagaacagtagatgctcctacaccttgcaccatgtgcctggaaaagccgcagatgttcaacgacagcccatgaaagcagccaggatgaggctgtactctgcaaagccacagggtcggagctgcccaagaccatgggaacccacctcttgcatcagcatgacctagatgtgagacctggagtcaaaggagatcattttggagctttaaaatttgactaccctgttggatttcggacttgcataggccctgtaacccctttgttttggccaatttctcccatttggaatggctgtatttatccaatacctatacccccattgtatctaggaagtaactagcttgcttttgattttacaggctcataaatggaaaaaacttgccttgtctcagatgagaccttgggggtgctgaaatgagttaagactttgggggactgttgggaaagcatcatttgttttgaaatgtgaggacatgagatttggaggggccaggggcagaatgatatggtttggctgtgttcccattcaagcctcagtttgaattgtatctcctagaattttttgatgtgttatgtaaaggaattacccagcgggaggtaattgaatcatgggggccagtctttcccgtgctattctcgtgatagtgagtaagtctcaacaatatctgctgggtttatcaggtgtttctgcttttgcttcttcctcatttttctcttgccactgccatgtaagaagtgcctttcacctcccaccatgattctgaggcctccccagccatgtggaactgtaagtctggttaaatctccttttcttcccagttttgggtgtgtctttatcagcagtgtgaaaatggactaatacacttggtaatttataatgaatagagatatattggctcatgattctggaggctgggaagtctaagatcaagaggctgacatcttgtaagggctttcttgctgcatcatcctgtggcagagggtaaatagagggtcaagggataggcaaaagcattcaaatctcatccttttataaggaacccattcccctgataatgaactcactcctgaggtaacagcgttaatgccctcatggtttaatcacctcccattatgccccacctctcaacactaatccagagccttcactcagtccagcaccaactcaaaagtccaaagtctagggtctcttctaaatcagatgtaggtgagactcaaggcacaattcatcctggggcaaattcccttccagctgtgagcctgtgaaatcaaaacaagttgtttacttccaaagtgcaatggtgagacaggtataggatctacattcccgttccaaaagaaaaaaaggggtaacaggccccaaataagtccagaacccaacagaacaaacaatgttaaatctgaaagctagagaataatcttttttgactttatgtttcgccttctgagcatacttggatgaggattgggctcccaagacctcaggcagcccagcccttaggctttgctgggctgagcctacatagcagctctcatgggttggaggctcatgcctgccgctcttatagtctgaggctgcacatgggtgactctatagttctgaggtctcagaggcagccctgctcccatggccctattaggcattgctctagcaagtactttatgatgagtctgctgctgtagcatcctttcagatctacattgaggtagccgcatctccacaacttgtgcagtctgtgcacctgcagaattggcaccacatggatggataccaccaaggtttatttcctatacttttcagagctgcagccagagacacaccctggtttgcttgaacagtgactggggaggctaagggaagctgtgccagaatgcagggagcagatacttgaggcagcacagggcagtgaatgctgaggtcccatagatgcctttctggaaactgtgatctcaggatcctagatgggaggggcagcccaggagacctctgaaatgccttcaagatctctttctatcttgatgaatagcacgtgacttccttttatccatgctaatccccttatgcaagggttccttggccacacccttgcatgctttgcttttttgttctttacatatacaaactgtgacttttccaaatcattactttctgcttcccttttcataatatgttttgtttttaaatcattctaccttctcgcatctttactatatgcagttaaaagtagccacgcagctctttcaatattttgcttagaaatttcttccaccagatatcctagtgaagtggctacattgtctggggtatataccctggggttcatcatcatgcaccaggaaaatttagggcatggacacacacaaggggtttaggagtagaggtttaataggtagaagataagagaaggagaaacagcctcctttataaagggaggggtctctgatcggaaaggactggctggtggcaaatgtgccgagttttatagtccagtttgaggaggcagtgtctgatttctgtaggggtcacagattggttagatcaggtatgaagtttacatagtgcatggggaaggctggttgccccaccataatcttcttatgaaaatggatttcccagttgatcagcatcatcttgtctgctccttacaatacacatggctggcagagaagagaggatggagccaccattttgaaaatgtctagtccttagttcctgtcagcattcacccatgcaagctctcagcttgcaggctgctccttgttagaaaatgatttggggctgcttttcattgaaaaggaaagccttaccaagcactcccatgcccttgttctctgactaagtaattcctttctaactcccattatactagcttattgctcttaaattctgccttccatgaagcactcagatatgggcacaattcagccaagttatttgctgcttcatgtcaaggatggctattactccagtttgcagtatctctttcctcctttctgtctgagatctcctcagagttccctttactctccacatttctgccaatattctgatcataagcactaatgtaatctctacaaagttttaggctttccctgcagttctcttctgagccctcatcagaatcatccttaatgttcttttcataccaatacaagttttttctagccttttttttttcccaaactctcccagcctctacttattgctgagtttcaaagtggcttccctattttcagatatttgataaagcagtgttctatgcttcaataccagttttttgtgttattcagttttgtgctgctataacagaatacttgagacctagtgatttataatgaataaaaatttattggcttatgattctgttgggaaggccaagattgaggggccagaatttggcaagagctttcttgttgcatcattgcatgacagaagagcaaagagagggtgaagagagaaagagaggagggcaaaagggggtgaaatcatccttttataaggaactcattcctgcaataacagcattaatccattcatgagggctatgctctcatggcctaatcatctctcattaggttccacatccccacactgttgtatcggggattaagttttcaacacttttttggagggacacattcaaaccatagcagagactctgcttcatgtcaaggatggctgttattccagtttgcaatatctctttcctcctttctgtctgagatctcctcagaattgcctcacaattaaatattctgttttaggaggcaatcaacttgttttggttcagcacacatgacctagctcacttttcaaaaaacagagctttactgagttacaatttgcacctcaccatattcaccttttaaagatgtacagttcacttatgtttagcatatttagagagtggtacaaccatcaccattacctaattttaggctgaagagccaaattgtataaacaaattggtatctgtgacttgttaaaaaataatttctagggtatcttatatagtcagtataaaatcaaactaatctgtactttagatgtataaaaatgaatttttataatgatgttttatcataacatcattatatcagtattttaccatcctgagttatcaaagcatattataatttccaaaaatatagaaataaactgaggtaggcaaaactttaagatggcccttttgacttttatccctggtattactgtcatgattatgttatgtcatttgtcaagagggagattatttgggttttcttactctaatcacatgagccctttaaaagcagagtatttcccctgggtgctagcagaagaggaagctaaagactcaaagcataaactggatttgacatgctaatgcttgtttgaagatggagggagccatgcctgaaagtactagagaaagtggcctcttggtgctgagagcgagcaacccctggtcagcaactggcaagaaagttgggacctcattcatataactggaatgaactgaattctaccaacagtgaataagcctggaagtggatgcttttctggagcctctggataacagcctagctcaactaatacccatctgagtctatagggacttctgtcctatagaactgtgagataataaatggatgttcttttaaatttctatgtttatggtaatttgttaccagcagtaaaaacaaatttaggggcatatttagcaatacatcgttgaaaaaagttattctggctgaatttcaatgatactgagttaaccagaaaattaaattaattctttaaacatgatggtcaattgagttttattatctttaacagtaataatacaaggtgattgtcatttattaatttaagctttttataacaccttgtgtacctgtctttgatttctttggtctgccatgaatggttagaattaatgctcaaaatgtttgccataaggttactaattgctgtctggatccacgaaaggaagatgctctggcattttagatatctgatttatttgaccctatttgatgcacagtatacttccagtctaccatttgagccaaaaagtgaataggagaactattttacagatagcataaagttatgaaatgatcagtagatgtgatgaagtttagccaaaaggggaagagattgatcttatcattagatagtagattaatttgaaaataatgattaccatgtgcaagagaagtattccctgattaaaaaatgtttgagttgtatagttatctcagtagctgaagggaatgttgaggaaaaaatgtattaatgagctaaaatcttatttggaaatatccttgttagaattatagagctcagaatcagctgatgttgtagtccatttgtattgctacgaaggaatacttgacgctggataatgtgtaaggaaaagagatttgtttggctcatgattctgcaggatgtacaagaagcatggcaccagcatctgcttgtattgcggggctcaggctgcgtctactcatggcagaaggcaaatgggagctggtatctgcagatttcatatggcaggagaggaagcaaggggtgggagcggccaggccctttttcataaccaactctctcaggaactaatagagtgagaactcactctttactgtgaggatggccccaagccattcatgagggatctgcctccatgacccaaactcttctcagtaggcctcacctctgacattagggatcaaatttcagtgtaaggtttggaggagtcatatattcaaaccatagcagttgagaattaggcctcaaagtcagatagataatggttaaaatatcaactatatcaatactgaattggagaacatctttttcttgtgtggccataatgggctaatatttcacctcaaaattaaattacccactcatttatgggccaagttaggcaactgctgatctgtattgcaaggtaggacaacagtagtggaagatagtagtcagaatgcatttcctgtgcctaaaatagtctgacagtgaatgatctgataaagaagttaggaaaacagttccatttacaatagcatcaaaaaacaaaacaaaaaaaacccaaaaaaaaaacttacgataagtttaaccaaagaggtaaaagatctatatgtagaaaactagaaaacattaatgaaagaaattgaaggtgacacaagtaaatggaaagatactttgtgtattcatgaagtgaaagagtattgttaaaatgtctatattacccaaagtaatccacagattctatgcaatcctatcaaaatagaattagaaaaaaatcctataatttgtttgaaaccacaaaagaccacaaatagctaaagcactgttgagcaaaaagaacaaagctagaggcattacactagctgactggtctttgaaaagttaatggaaaatgcatattatgaaaaaactgcgtggatttcaaattttttttgcaccaaaacaaactcataccaaattgttataacaagtctgaatgggatcaagtttgaggcactaaggaggataagacattggtttgaaaagggcccctatcagagtaacataaattctgctaaaattgaagcaagagcaaacatcaaatttatggtgaagcttgggtggaagaaggtgaaattattgatgctttatgaaaagtttaggaggacaatgccccaaagtaatcagcagtttataaatgggtaactcattttaagaagggatgatatgatgttgaagatgaagcctgcagcaggagactattcacatcaatttgtgaggaaaaaatcatcttgttcattctctaattgaagaggactgatgtttgacagcagaagcaatagccaacaccatagacatctcaattaattcaacttactcaattctgaatgcaaattaaagttcagtaaactttccaatctatgggtgccaaaaccactcggaccagattaactagagataagagcagaggttttagtggaaattataaacaagtgggatcaagatcttgaagtatttcttggaagaattgtaacaggtgaagcatgactttaccactacaattctgaagacaaagcacaatcaaagcaatggctaccaggaggtagaaggggttcaatcaaagcaaaagtggactggtcaagagcgaaggtcatggcagcagttttttgggatgctaaaggcattttccttgttgactttctggatggccaaaatataacatctgcttattatgagagtgttttgagagttagccaaaactttagcagaaaaacacctgggaaagcttcaccagagagtccttcttcaccatgacaatgcttctgttcatttctttcatcaaacaagggcaattttgtgagagtttctatggaaaatcattaggcatccaccttatagtactgatttggctccttttgagttttgtttgtttgtttgtttcctaattgatatggtttggctgtgtccccacccaaatcttatcttgaattaccacgtgttgtgggagggatctggtgggagataattgaatcatggggccaagtctttcccatgctgttctcatgatagtgaataagtcttatgagatctgatggttttataaagaggaggtcccctgcacaagctctctctgcctgctgccatccatgtaagacatgacttgctcctccttgccttccaccatgattgtgcatgctccccagccacgtggaactgtaagtccattaaacctctttcttttgtaaattgcccagtctcaggtatgtctttatcagcagcatgaaaatggatgctaatacactaatcttaaaatgttttctaagggcacctatttttcttcagttgataatgtaaacaagactgcattgacatggttaaattcctaggaccttcagctctttagggatgtactaaatgactggtatcattgcttacaaaagcttcttgactttgatggaacttatgttgaaaaataaagtttatattttttatttttatctgtttttttttccatgaacttttagtcatctcatagttattaaaacagcgtgatacctgcataaaaacagacaaattgacccatggaacaggatagagagcccagaaataaattcacctgtctgctgtccactgattttcaacagaggctcgaggaatacacattggagaaaggacagtcttgtcaataagtgattctaaaaaactaggtatccagatatagaagaatgaaattaaacccttatctgatcccttatagaagaatcaactcaaaatggattaaagatttaaatggaagatctgaaactaaaacaactagaaggaaacataggagaaaagctatgactttggtctgagcaatgacttcttgcatgattccaaaagcacagacagcaaaagcaaaaatagacaaatggtattgaatcaagaagcttctatacatcaaaggaaataacagagtgaagagacaacctacacattgagagaaaatatttgcaaatcatacatcagataagggactcatacccaagacataaaatgaactcaaatcattcaataacaagaaaacaaataacccctatttaaacatgggcaaataatctgaatagacatttttcaaaagaaaacatacaaaaggtcaaaacatatatgaaaacatgctcaacattactaatcatcagggaaatgcagatgaaaaccacaatgggatgtcatctcatacctcttaaaatagctcttataaaaaagatgaaagataacgtgttggtgagtatatggcaaaaagggaagtttttgtacactattgggggaaagtaaattagtacagccattttgaaaaaaaatatggaggttcatcaaaaaactgaaaatagaatcaccatatgatccagcagtctgagtatatatccaaaggaattggaatcagtatgttggagagatgtttgcattcacatgttcattgcagcattgttcataatagccaatattgggaaacaacctaagtgcccaccaacggatcaatggattaaaaaaagaggtatatatacataatgaaatagtattcagcctataaagggacaaaatcctgtcatttgtgacaacatagatgaaactagaggccattaggttatgcaaaataagctaggcttagaaagacaaatatcacctgatctcacttacatgtggaatctaaaaatttgaatcaattgaagtagagagtagaatgggggttaccagaagctgtgggtggtggtcagttgggcagggaaaagaaaaatattggtcaaagggtgcaaagtttcaattaggaagaataagtgttctattatttcgttggcgttctattgtacaatgaagtgactaatgttactaattgtgcattgtgtatttcatatactacattgctaatagagtggattttaaatatttttgctgcaaaaaatatgtatgtggggtgatgggtatgttaattagcctgatctgctcagtctgcaatgtatacatgtattgaagcatcacattttaccccatgaatatatacaattattatttgtcaataaagatgaaatgaaaataaaaaggaattaataagctgataaatagtattttaactagaaaatctgtttttaaaaaagatttctatgtgaaaaaggcttacaaaggccaccctgcataaagactatccctgagtggatctgactattccttgtaggctggttatgccaggactaaacctatattctgtgataaacaggatttattgtttcagagatttcgtaaattaaaactatcacactttcttatttttataatgtgttaagttatatatccatagtcaaattatatatccatagtcaggatagacaacaacatcccactagatttaattttagtattgtctaatatttgtgctggttttcctgcatttattagtggccaaccttgtgttataaacagcccagcatgcttttaattaaggactctactttcagctagaatgagatattgacaaggcatatggatatgtggcaggcatctagacaagtgattggcaaactttttctggaaagggccagatagtagatattttaggctttgttggccagatggtctctgttgccagtactcaactctgtcctcgtagtgtgttagcaatcttagataatacttaaacaaactagtgtagttgtgttccaataaaagttcatttacacaaacaggctagtagtttatgtagtactgatctagatgaataagtcagtatggttctcagttcaagaagaggaatgatagaaagtttaaaaaaaagttgtttgaaacttggaatatgtattagaaataatattagaaatagtagttatgtaagagcctattttactttctttagggagttgaactatgtgctacctaatttctggagagcactacacaattggaatgtaagggtattaggagtaagaagtaaaaaaaaataaatggaaaactaggtgtttatggttagagtatggtcctggagtgcaagacttctgaattttagaagaacagttctagactgtaaagaggtccaaagtatgtaatgggaatgctttgcccaagtggcatgcaggtaaaggttcttggagtttaagaagagatcatgaaactgaagaaggagaattgttctttctttattatagaagtagcaggagatttctcccctttacgcatgtcttttggtggtgagaaggaattttccatttcttttaccttgattggtgacatcctcccatgcttccagtggactggtattggcaaggaggaaacctttttgtagtaagtggaggaaaaggtgggctcttggtaagatctttagtgctaaggataaggaattcagggattgtggtgagtagtttccttttaagtttgggaaattgtactactgaagttgaataggacgggacagggtgtgtagttttcaggtactcctattgtttagcttaggtagggaggcataacagttccttcacatcacttataagagggagataaggattactatggtagctcctacaatatatgtttctttggaggaagggggatatatatttttaatttttgtgggtacagagtaggtgtatatgtttatggggtatgtgggatattttgatacagtcatgcaatgcataatcacatcatggaagatagggtatttatctcaagcatgtatcctttgtgttacaaacaatccaattatactctcagttattttaaaatggacaattaaattattattgactatagtcaccctgttgtgctttcaaatactagtctcattcattcattcattctatttttttgtaccccttaaccatccctacctcctcctcactttaccactacccttcccagcctctggtaaccatcttcctactctctatctccatgggttcaattgttttgctttttagatcccacaaatcagtgagaacatataatgtttatctttctgtgcctggcttatttcacgaaacataatgacatccagttacatccgttttgttgcaaatgactgaatcacattatttttatggctgaatagtaattcattgtgtttatgtaccacatttctttatctgttcatctgttgatggacacgtaggttgcttccaaatcttggctattgtgaacagagctacaacaaacatgggagtgcagatatttcaatatattgatttcctttcttttgggtatatacccaacagtgggattgctgaatcgtatggtagctaaatttttacttttacgaggaacctccaaagtgttctccatagtggttgtactaatttacattcccacaaacagtataagagggttcccttttctccatatccttgccagcatttcttactacctgtcttttggatataagccattttaactggggtaagatgatatctcattttagttttgcttttcatttctgtgatgatcagtgatgttgagcaccttttcatgtacgtatttgaaatttgtatgtcttcttttgagaaatgtctgttcaaacctttagcccatttttaaaattggattgttggctttttttcctgttgagttgtttgagcactgtatatattctggttattaatcctttgtcagatggatagttcgtaaatattttctcccattctgtgggttgtctcttcatgttgctgtttcctttgctgtgcagaagttttttaacttgatgtgatcccatttgtccatttttgctttggttgtctgtgcttgtgggttattcctcaagaaatctttgcccagtccaatatcctggagagtttccccaatgttttcttgtagtagtttcatatgcttaactacctgttattatgctagacattttatttgaaaattattgatagaaataatttaaggcccaggataatgttatctttctttagagagtaccatgtatcttctgttaggagacttggcatattggcagttctggcagcaccataagccgattttaagacttgggagttttctgctgctcagatgactcatagctaacctacagttgaggtaaaggctggttaacttctggtacaccactattttaatagcaagtcattatgtcccaagtcaaagtgccctgttgtttctttgaacccctatgttttgtgggttattgcttccaacttttgtcctcctctccccttgaggctactaaatgcactctcaaccttttggcagtctcttctaaataagcaaatctctcagaacaaaagcatctctgaatgcctgcctcctcttaaagaatttgcaacttctggatcttggctttgtacattttatcattttgttacttgtaagattttaaaattgtcctttaactttttaagttgtcttcagtggagagtttttctgaattactgcacttagtattaatattattggaagtgaaaaatcagggcaagttatttaacttgttacttaaaatgtgcttcagacttctcatctgtaatatggagttattaattatttactatcttataggttttttgagatttttaaatgaggcaacacattgtgtttatagtggtacctgacatgtagaaaatgcttaagttattattacatttatttgagaatataggaatttgttgctcttcaaagattttccaagcatgaattagccactttattacaaaagtaatttgcagggattatgaaagatttgcaaatgacattaacattgactgacatttctgtcaaccctgatttaggtaaattaaagtttttcccccctaatgtatttaaggctctatactataaggaaaatttaattttatctaaaagtagataatggccctgatatgtatatgtgtgtgtgtgtatgtttatgtgaatatgtaaaaactgattagctgtgatgtgtgtgtgtttgcatatataagtatagtatataaatgttaaatgggaagacattttaattctttaaaatatggtctcttgataaaataattgggctggaagtaaaaaaaacaaaatgaagcagaattgagatttttgttttaaagatttttaatttctgaaaatagagtttttccaaatatctttttcttttttatgcataaaatagaagatacaattttttttatttgtcctgttttaaaaattgagttcttggactagatgtaaagtagacaggagaaaatgataataaaaaatatatttatagcagaactctttcaagtttggtgacacctattttagcaataccagtacatgaagaaaaaatatagcttacatgctaactccccaaagtggaacatacgtatactttttctctattccatagatttgtatttgatcttccttctgcctcaacctaatttttgtgcagatgaagtttaacttactctattttgcatcaacattgaatccttcagtactatgttcagtctttcagtgtcttttttcgcttcgtaaattgaaatggtcatgatatattaagatttaaagaaatccaaaataagtatcttttgagatgcagagaaaaatacagcactttgaaattttcctaagttgtaaataaatcctcctttttgaaaattgttatgtcccgttcctttggcttaatgacttttaaattttcttatcctgctatatgtcttaaagttattttaaggtaattattttcattattttattttctcttccaggttaacagaaccttctggatatttaacagatggcccaattaactataaatataaaactaaatgtacttggctcattgaaggctagtaagtatacagtctgagtcaaattaatgtattttattcttaaatgataaaggtgatcatattaatgtcagagcattagagtataattactttatcatttagtttgtttattattagataatatttacaacttctagacatcacatttaatgtaaattacactacctcttcacttgtgacagtagtttaatttttatatatattttgtttttgagttatgttattgtggtattaaattgagtaggcatttttttggtttattttgaacatcttgttatgaaatttgaagacttagaaattataaaagtatttcttgctgagctatgctattcatataatttagcattttagttcaaagggtatttttaaaagaacattttgtagaagagagagttaattattcatttagaggtattttcagtaagtagggcttgaaacaatctatctatttaaatgtattgtgaatggagcataaaagaattgatatgaattatttttgaactgttttgtaatttctaaagagtatatttggaaaattttgtatttaaatttttctaacttaaaagctgttcattctctgctgtgcacctgtagttacattttgtttatttgttaacattatatcacattgagaattttgattaaaatttaaatagttttttagtgcctccaacttaagggttctgtaaaaataagaatagtggcttcttgagtgttgatttttaaaaatcaactttatttaagtaccatttgtatacaacaaaatgcacccatttttaagtgtacagttccataaggtttcagtgatgtatacagtctatgtaacctctgccttcaatcaagagaaagattttttttttttgagacagagcctcattctgttacccaggctggagtgcggtggtgcgatctcggctcactgcagcctctgcctcctgagttcaagcaattctcctgcctcagcctcctgagtagctgggactagaggtgcatgccgccatgcgcagctaatttttgtattttcagtagaaatgggttttaccatgttggccaggatggtcttgatctcctgacctcgtgatctgcctgctttggcctcccaaagtgccgggattacaggcgagagccactgcacctggctgaacattttttattgactacatttttagaaaacaatgatacatacatatgtcctgttaatagattttgaaagttacattttatttgtacaaattagatatgatggcttatcaatctttcaccctgataaggatttatagcaaaattatctataaacagatttctaataaaataccctatctaaagtttcttcactctgtgctttgtatattatataataaatattatgtatttattcactctgtgctttgtatattttaatttgaaaaatatttcatattcattttcagtccaaatgcagtgttaagattaagattcaatcattttgctacagaatgtagctgggatcatatgtatgtttatgatggagattcaatatatgcacctttaatagctgtacttaggtgagtaattatatttaatcagttgcagaaaagtgactgtgtaattgcttctttaaatatatattgatatgtactgcaaaataaatttagtaaagatattgatagttacatttcacagatgattataatactttgttatgtgctgtaactgtcaatttaggtaataattatgtaaatattgatataacataaataagtactatattggaaatatagatttctttctaaatattttttattctcattgtatttagtttattctttcaaagtgccttgaatatgttttcagaactatctggatatattagcgtgagttctagctgacaaataaatagacaagttttgttttttaatagttgtttttttattttagtgaaatggtaaaattttaaattctgcataaaagggttaagttatgctttgtgcaatgattaataaagatggagtttctaccaattgtcaaaatgtgagagttttatttgtttcaaaatattttattgttagtcgtaaggtagattattaattttaaaattatagcattgtatcaatttaaaaatcttttcttgtgtatgtttagattattataaaaagtttcgtgaataggagaaaatctattagacacagaaaaaattatgaacatgtatagattttatatataatttaacatgattgttgataagttactcattatattatttacttttgctatttatacaatatctgttatatgttctgtcattgctggaaatttaagtatggataaaagcttattggtcccttcaaaatattttctttccaatttttctttttattattcatgtggcaaatattctatttcattctattctaatacattttattttgttctattttatcaggaatgtgaattattattttggacaaaaatgtaacgacttgtatttccttaggagcttaggtacttattctatgatattgctattgcttacatttttgagtcatttgaacattagaaaaaggatagccataagcagcccttcatctaaggacaatagagagaaaatagagtggagccttgcaaataattaggttgtaagataatttattgtaacaattaaatttgatcctcagttcatacatttatttttagcaatttaaacatcactttgctatctttactctatttttatgataccgttgactgaccatcatttagatgtgtgcctgttcatttgtttatctagtaattctaattactttgtattaatactcatccattagcattcttaccaacattttcttgttattaaaggaagataattagcaggtgagatttagtatatggctgtgaagatggaattagtgatttctcattagcaagtgttcttgttagccctcctaagggaaatggaaaactcatgtttattgatattgaatatccacttgatgttaagcactaggctaggcagtttaaatgtcatctaatcctcacaaagatctcgttgggggagtactaagtactattatccccattttacagttgagaaaattgacattcagagaagttatttgcttctaatagatggtagagctaggattaggacttgaatctcaatctcctgatttaaaagcatatgctgtttgtacttcatcttgctaagaattcagaatctaatatgtttgaattacttcaattgtataaatatttattactcaacatttaattacagagactgtgtcacaggcttagagtacatagtaaggaagaaggcataggctatcgcagtggctttagacaccaactacctgcagttgggctagaacagatttcctaggttaagagcacagtcctctacaacaagggtctcctctccaccccagatccccgtaccagtccatggcctgttagcaacagggctacacagtaggaagtgagtggcgggcaagtgagcaaagcttcatctttatttacagctgctccccactgcttgcattactgcctgagctccaccttctgtcagatcagcagcggcattagattgtcataggagtacagaccctactgtgaactgtgcatgtgagggatctaggttgctcattccttatgaggttctaatgcctgatggtctgtcactgtctcccatcagccccagatgggaccatctagttgcaggaaatcaagttcagggcttccactgattctacattatggcgggttgtataattatttgattacatattacaatgtaataataatagaaataaagtgcataataaatgtaatatgcttgaatcatcccaaaatcatcctcccccggtctgtggaaattttgtcttccatgaaactggtctctggttccaaaaaggttggggattgctgctctataacactgctgtcatttcagacactagctgcaagcttggtgctccccacctactctgaccatctggctacatatttaggggttcctactctgtcctaaaagtttgataattcactagaattatcatagaactcaggaaagttctacacttatgactatagttttatcatgaaggatagaaatcagagccagccaaataaagggatgcatagagtgaggtctgggaggatcataaatgcaaagcttctgggtcctcagaatgtgttacccacccagcacatcaacatgtatcaccaacagggaagctcatctgagcttcaggtgtccagagttttattgaagtttcattatgtagccatgagtgattgaatcattggccatgaggctgaactcaaatctccagcccctcccatccccttctctctcgggaagttaggctaataccatatggccccaacattttaatcacatggttagtgtttctggagtggccatcccctattctgaattatatctttagcttaaattaattaggggcccaccatgagtcacctcattggcataaattttcagggctcaccatgaataggaagacactcccatcactcaggaaatttcaagaatttagaggttatgtcccaagaactggggacaaaagccagccaaattctttagtatgcagtagtcatgcattagtgggggtatgtaaacagatttttcacacagcctagttagtgttacaatcaggttatgaaggagttctatataatttcaaaataaataactaatccttcatgttgactttcatcgtgagtaaaagtatgaagtatgggggtcagataggacattctagagagagaaaagcatatatacaaaggtatagacacattaaagagcattatattttagggcaatagttgaaagttttgagtaacttgattgtaggaactgtgaaggatacgtaggagtcacattaccccaaaacagcaatcagtgacatttacttagtgctcattttgtgccaatgtacaggagttctttatatgcattagtttatttaatcctcaaaataacctttaggtaggtattaatattgtaattttacaaatgcagaattgagacacagagattttctgtgagtggcccgaaggttgcctagctggtaagtcagaatatgaatcaaggttatgtaattataggtcctaatcccttaatcactgtaatattgcttgcttgtacaccacactaaagaagttgggcttttattctgtaggcaagagtttttagaatgtggagaatgcattggaatggagaagtgttatttttttttttttttactgtgtgctggacaattgtgtgttggacgttgttgtttggaaaatcatatatagtaataatttgaggcctagaaagattatattcttgcagagactacctggggacactcgcaatccatattcaactcaatccaaactcagatactgaggtgattcatagctcagctgcagtgcagtcctttggagggcctaactttaggtagtttgctttcacttccaaccattggagtcccagttcaacgtgaaggccttgtgtttcactttttctttccttcattctgtaaaatccctgaaattaccaccgagttttttttagcccttcaaatcttacctccagccttgaaatcagcaaatgccaatagggtaaatgacctcaatgcctgggcaggccttcaagctgatttttttgtttttatataatttgtcattttactagatttcagttggtccgaatttcctggtgtattatacagtaagtggaaactctcttttatttattgtttttaaaatacttgtaaacaaaaaaccaaacagatctattcttttttgtttgtttgtttttttgagacggagtctcgctctgtcaccaggctggagtgcagtggtgtgatctcggctcactgcaacctccacctcccaggttcaagcgattctcctgcctcagcctcccgagtagctgagactacaggcatgcaccaccgtgcccacctgatttttttgtatttttagtagaaatggggtttcactgtgttggccaggatgttcctgatctcttgacctcgttatccgcctgcctccaccttccaaagtactgggattacaggcatgagccactgcgcctggcccagacctattctttttatctttttcagagagcgctcagagactagctgtatctattataaagacctatttttagtaatactcacctttatataattttattacaatgaacaatatgtatgtataacttaagactggtgtcatagggtttgtattgttttgagagtctcattttaaaatcatttgttgcttcacaaacataacctagtagatgtaataataattactaaagcgttaaatcaagagttgattactttttaacttgtttgcatttgagaatgtattttctaaatcaattatttgactataatatttcatttatgtgtcaaatatgatttgaatgggggaattcagttcttagtggtacctaaacataattttaactgtttaaaggaattgaccgtgtcgagttatataatttgtttgttagcagcttcttttctttcaccaattgcatgttttcatagatttagagaggttagaacatataactaaatgaagataggtaattttcctcatgaacaagtatccttaaaaagaagtacaagttaccagtttaaaactattttgtacatttatatctcccccaccccaagtttttgtttgtgtgcttatgggcttatgtgagcaatattctgtcttggaatagttatatattaatgcaatttgcatagatatgcaaaattagaaaaacattaaagtctatatagttttaaattttttgaagtaaatattttaaatcacctagataaatgtattggaaatgtacagctataactagaatgtaattgtaattgcttaactgatgtagagtgtcttccagcttcatcggatttttaaaccaatcagaatgagtaaaggtacagggttttattagagtagcaaggtgactttaagtgaagttttatacgaattaagtggaagactaccctgtagtattatgacaggatggatagcaggacaaaaaggagaaatgagacattgccttacaaatagtgataagaaaaaaaatggggtacagtggcatgagagtagattttagtgtattggcagcagtagtagaactaatttagtgagaaatggatagggacttcttttagatgtattctccttttagttgcccattctgacgtacaagcattactgatcctggtaagaatatttctgagtaaattttatgtgcttaacagtcttatgtatatctatacatacaatattcagttttgttctcttttagtggtttgatagtccctgaaataaggggcaatgaaactgtgcctgaagttgttactacatctggctatgcactgttacatttttttagtgatgctgcgtataatctaactggtttcaacattttctattcgtaagtattttttaaaaattccttcttttaatgattcttgtaatttaatgtaaaagaggttttttttgtttatttttattaatgtcttgtataccagaagcaggctaccgtgttaaatttcaaattagtaggcaggatcccttcttaagtgacataaaatcttaataatatgccacaaaacgtgatctaaacctataagtttggttgaaaattaattatgaaattgacaattgttttttggcaagtgattaagtaaacaagtactagtgtagctttactggtagcaacagatgtggtgagactgcagggagttgtgaactgcctttcagtgctctaaggtatatcacttgtaatttgaagaggattatgggagctaagtttttgtagtccctattgcagagactgtactgaaagctatgcatacattatgtcatttaattaccttcaattctgtcaagtgggtatatttcccattgacacatgaggaaattgtggcttaagagttaagtggctataccactatctcctctaaaataagaaaagtaatattcattgagaatctattatatgcctgatactttatatacatttttatatctagaagactgagggtgaagtaatgagagatgctttcacaggaatggctagagaggaagtctatatattatttttttcttttcttcagaatgtagaaattggtaaccagagaatttttcaccagaaatattataaatatccttgaatcagcaatttattatggaatttatttatcctacaacgtatccaagtatgtatgcaagggagaacaaatatatagtagaatataatcacatggtggctcacgcctgtaatcccagcactttgggaggccgaggcgggcagatcacgaggtcaggagatcaagaccatcttggctaacacggtgaaaccctgtctctactaaaaatacaaaaaaattagccaggcatggtggcgggcgcctgtagtcccagctactcgggaggctgaggcaggagaatggtgtgaacctgggaggcggagctttcagtgagccgagatcgcaccactgcattccagcctgggcgacagagcgagactgtgtctcaaaaaaaaaaaaaaaagagtcttaaagctaaatatgataaacataccttttcttcaataacagtgtatgggtgatagcatgctcttttatattatacaaccaagttatatcttgacttctcatatagttttgaattttcatgaatttaatttttttctgtaaaatatacaatcaaaacattgagtacttaagtctttacaaaacattttgcctggaaccgtacagatcctgcagatgttgagcatgtagtcgttagacatttggagtcttggtatcaaagtaaatctgttgaataaaataagaccaactgcaaataaatactaacaatttcataagagtaagagggtacagagtaaagaattaaaactacattgtgaaattctgttacatttataagcacataggacacagtataaaaattataaagtttatgatgtatcaaccaaaattctttttcaattaccttgaatctgaatatatatgaattatattttacagaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtaagcatgtgtggtgtgatggcttttgaaacattgattcatatatgtaatagattaatacaaattccacacgtttgtttcgttatagtttgcacacccaagccttatatatttacttttatttttagaatgttcagattaataatcaacttcttaataatttttttgtcacaaatagaattaattggcaaagattttgtctccatactactttgaagatcaaatgaagttatatatgaaactgaattgttaggtgtgtgataattatggtcttctgtaatttgttgttgaatctccccaaatttggtgacttcactgaatttaatgtggtgcattcaaatttgatttataagggtaatataaatagtatactacaaaaataaatgttcaaagggactgcagtatatgaaacttatttcttaggaaaggctgacatcttgtggctattttaaaaagaactagactatttttaaaagtattttagctgcctattgcagaagtcagatacctaggaaagaatttctaagtaatttttataaatatctatcatcaaagattaagtttagactacagtgaagaatgttggcttatttatctgtatataaaataataaatattgtcattatgaaattaagagatatgcttatacatatacctacccacctagagcttactttttgctagttacatttacctatgaagagcttcctttgtgccaacatattaatcctgttgaaatagggaaatttgactcaataattacataacctgaagtacttgattatgtattattataacacagtgtaataaatagtagcaatagttcccaagttaaaaaccaaagagaacatactcttcatgaagttgtattcattattcctgagatgaccttttcaaaaaagtgttgttgggtatgttgagtacttacttagaggaattattttaggctttgtgtaaattatgcctgtcttaagctcatgttagctcattaaaaaatattaggtatgtcaactgcacaaaagatctatgatttcttattaaatcgaatttggttaccaattgcaattatgtcagatgcaaatttctaaatgttttgtaattacagggacatgtattttaagtgactcttttaatcatttatgacttttcttccccccaaaagtgccttgagatgtaattttattttcatttctgtcgtgaaactaaaataactgtcttttctatagagacagtggtgtatccatattatatttgatttaaggcctgagaaatagaaatatagctcatatacacagtatttttcaaactggtcttcaattgctattagtctccacctcatttcagcagtcttaaaagcaaatgaggaatacatttgtataacattctctgtgaacaactctgccccttttctgttttttacttactttcattagtccttctttgaaatgctttattttgtgtaagtcttgtaatatagatctgattcaaagtattaagaatttttttctggcctttgttttttggccttttcatatcctattattctcatctgtaatgtcccaaatcataagaattcctgaatctaatatgtctataagcaaatggaaatgaggaagcaaatactgggtatgttcacttttaaagcaaagttatattatcagtagtctaagaactacttgtctgtgtgtgtgtatgtgtgtgtgtatgcatatatacacatatatttataactacatatatattttatatggagaatagtgtgaaagtgctttgtaaattataaaacgcagaaataagacaattttataccattttcttaataattaaggaaatgatttctgaattgatatgtttgaaggaggccttgtaaatgagataatatggtgttttcaagacaaattatgtgcagactggttactttgtgcctcaaactgatcctgattctgtatttaaggaagcatagctccaaagaaggtaggattgtgagcaaactcatttaggggaaaatgatgtttttatttcagatatatatagaatgggaaggaatcagtgaggtaagaagaggagatagatttgcttctaggacaaatggggaatgatcaaagaatgagagacatgtgaaaatgcggactgccgaggcaatctttatgaggttcaaaatctggtagttttatacaaggtgttatttggaactggattatttaggttagagtaacagattgttgttacctccattatattttatcctttgttgttgcttgactacttattctgtttggctgtatgcctaatgtatattttttaaaaatgagtgttaccctctagaaacttgggttttattaagataacacagaggaaaaacctagctttatattaagtcctttttttatttttatttttatttttttattatactttaagttctagggcacatgtgcacaacgtgcaggtttgttacatatgtatacatgtgccatgttggggtgctgcacccattaacacgtcacttacattaggtgtatctcctaattctatccctcccccctccccacaccccacaacaggccccagtgtgggatgttccccttcctgtgtccaagtgttctcattgttcaattcccacctataagtgagaacacgcggtgtttggtttttttgtccttgcgatagtttgctgagaatgatggtttccagcgtcatccatgtccctacaaaggacatgaactcatcattttttatggctgtatagtattccatggtgtatttgtgccacattttcttaatccagtctatcattgatggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacattctctccagcacctgttgtttcctgagtttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccctcacccactttttgatggggttgtttgattttttcctgtaaatttgttggagttctttgtagattctggatattagccctttgtcagatgagtagattgcaaaaattttctcccattctgtaggttgcgttttcactctgatggtagtttcttttgctgtgcagaagttctttagtttaattagatcccatttgccaattttggcttttgttgccattgcttttggtgttttagacatgaagtccttgcccatgcctatgtcctgaatggtattgcctaggttttcttctagggtttttatggttttcagtccaacatttaagtctttaatttatcttgaattattttttgtataagatgtaaggaagagatccagtttcagccttctacatatggctagccagttttcccagaaccatttattaaatagggaatcctttccccatttcttgtttttgtcaggtttgtcaaagatcaggtggttgtagatgtgtggtattatttctgagggctctgttctgttccattggtctatatctctgttttgataccagtaccatgctgttttggttactatagccttgtaatatagtttgaagtcgggtagcaaatggaaaacaaaaaaagcctgaggttgcaatcctagtctctgataaaacagactttaaaccaacaaacatcaaaagagataaagaaggccattacttaatggtaaagggatcaattgaacaagaagagctgactatcctaaatatatatgcacccaatacaggagcacccagattcataaagcaagtccttagaggcccacaaagagacttagactcccacacaataataatgggagactttaacaccccactgtcaatattagacagatcaatagacagaaggttaacagcgatatccaggaattgaactcagctctgcaccaagcggacctaatagacatctacagaactctccaccccaattcgacagaagatacattcttctcagcaccacattgcacttattccaaaattgaccacatagttggaagtaaagcactcctcagcaaatgtgaaagaacagaagttataacaagctgtctctcagaccacagtgcaatcaaactagaactcaggattaagaaactcactcaaaactgctcaactacatggaaactgaacaacttgctcctgaatgactactgggtacataacgaaatgaaggcagaaataaagatgttcttgaaaccaatgagaacaaagacacacaatctctgggacacattcaaagcattgtgtagagggaaatttatagcactaaatgcccacaacagaaagcaggaaagatctaaaattgacaccctaacatcacaattaaaagaactagagaagcaagagcaaaaacattcaaaagctagcagaagacaagaaataactaagatcagagcagaactgaaggagatagagacacaaaacccttcaaaaaatcaatgaatccaggagctggttttttgaaaagatcaacaaaattgatagaccattagcaagactaataaagaagaaaagagagaagaatcaaatagatgcaataaaaaatgataaaggggatatcaccacagatcccacagagatacaaacaaccatcagagaatactataaacacctctatgcaaatgaactagaaaatctagaagaaatggataatttctcgacacacacaccctcccaagactaaccaggaagaagttgaatctctgaatagaccaaaaacaggctctgaaattgaggcaataattaatagcttaccaagcaaaaaatgtccaggaccagacggattcacaggtgaattataccagaggtacaaggaggagctggtaccattccttctgaaactatttcaatcaatagaaaaagagggaatcctccctaactcattttatgaggccagcatcatcctgataccaaagcctggcagagacacaacaaaaaaagagaattttagaccaatatctctgatgaacatcaatgcaaaaatcctcaataaaatcctggcaaaccgaatccagcaacacatcaaaaagcttatccaccatgatcaagtgggcttcatccctgagatgcaaggctagttcaacatatgcaaatcaataagcgtaatccagcatataaacagaaccaaagacaaaaaccacatgattatctcaatagatgcagaaaaggcctttgacaaaattcaacagcccttcatgctaaaaactctcaataaattcggtattgatgggatgtatctcaaaatcataagaggtatttatgacaaacccacagccaatatcataccgaatgggcaaaaactggaagccttccctttgaaaacgggcacaagacagggatgccctctctcaccagtcctattcaacatagtgttggaagttctggccagggcaatcaggcaggagaaagaaatagaaggtattcaattaggaaaagaggaagtcaaattgtccctgtttgcagatgacatgattgtatatttagaaaaccccatcatctcagcccaaaatctccttaagctgataagcaacttcagcaaagtctcaggatacaaaatcatgtgcaaaaatcacaagcattcttatacaccaataacattcaaacagagagccaaatcatgagtgaactcccattcacaactgcttcaaagagaataaaatacctaggaatccaacttacaagggacgtgaaggacctcttcaaggaggactacaaaccactgctcaacgaaataaaagaggatacaaacaaatggaagaacattccatactcatggataggaggaatcaatattgtgaaaatggccatactgcccaaggtaatttatagatcagtgccatccccatgaagctaccaatgagtttcttcacagaattggaaaaaactactttaaagttcatatggaaccaaaaagagcctgcattgccaagtcaatcctaagccaaaagaacaaagctggaggcatcacgctccctgacttcaaagtatgttaagtcttgagttccttcctaacatttctcttttgcttaacctacctggtcttgtgtgtcatttttttttctttggtttttctttttcttggagataggatctcactctgtggctcaggctagagtgcagtggcatgatcgcagctctttgcagcgttgaccttccatgttgaaatgatcctcccaactcagcctccggagtagctggcaccacaggttgcacaccaccattcccagctaattaaattgttttttttttttagagatgagatctttctatgttgctcagactggtctcaaactcctgggctccagtgatcctcccaccttggcctttagagtagctgggactactcgagggcacacaagtttgttgtataatatttaattttgtcataaagtatagttgtcaaagataatgatatatacatattaaatatatgactaaaagtatagggacctgtgtagactcatctgcttctatgacagtaaaataaaaaaaatagacttcatagtttgaggttcacaggaaaattgagcagaaggtacagagaattcccatttacctcctgccccaatgcatacacagcttctctcattatcagtatctcccaccagagtgtatattcattacagttcatgagctcacactgacaaatcattatcaaccaaagtcatagtttacattagcattcactgtcagtgttggacattctgtgggtttggacaaatgtatcattacatgtatccaccattatagtatcaacagaatagtttttttaacctaaaaatcccctatgctctgcctattcattctttcctctccctacccctgccaaccactgatctttttactgtctccacaattttgccttttcccaaatatcatatggttgtaatcatacagtatgtagctttttatgattggcctttttgacttgacaagatatgtttaagtttcctccatgtctttttatggcttgatagctaattccttttcagcactgaataatattccattatatggatgtaccacagtttgtttatccattcacctactgaaggacatcttggttgcttctgtaaaatttgtttaaattttagtaagtcacctgagggaaaaaggcaactttgaaaagaactgatctcttaaaatggcttccaaacattgggatagaagagcaatttttataacacatgaaaagcaagatataagaaattgaattcatgttcatgtgtaaagaacacaatagaacagtaattttcaaagtactctgttttatataacttttaaaaaatctgaggaggctgaggcaggagaatcacttgaacccaggaggtggaggttgtgagccaagatcgcaccattgcactccagcctgggcaacaagaatgaaaatccatctcaaaaaaaaatctgaatgatgggaggtctttggttgaaagcaacagaaacaatctggcttacttgagcagaaaagtcagttattggaaagtatgcagagacagagactgctgtctcctagcattcattatagaattctcattgtaatagaattctcatttagctcagcacatggccttccatctacataccaaatttctcatgctgccttgcagctagtatggctatgttactgtattagtctgttttatgctgttgataaagacatacccaagactgggcaatttacaaaagaaagagatttaatggacttacaattccacatggctgggggggcctcacaatcatggcacaaggtggaaggcatgtctcacatggcagcagacaagataagagagcttgtacagggaagctccccctttttaaaaccatcagatcttgtgagtcttatttgctatcatgagaatagcaagggaaagacctgcccccatgattcagttacctcctactgggtcccgcccaaaacacatgggaattcaagatgagatttgggtggggacacagccaaaccatatcattctgccactggcccctcccaaatctcatgtcctcacatttcaaaaccaatgatgccttcccaacagtcccccgaagtcataactcatttcagcattaactctaaagtcctaagtctcatctgagacaaggcaagtcccttctgcctgtgagcctgtaaaatcaaaagcaagttagttacttcctagataacaatcagggtacagccattgggtaaatacagccattccaaatgggagaaattggcaaagcaaaggggccacaggcctcatgcaagtctgaaatccagcagtgcagtcaaaccttaaagctccaaaatgatctcctttgactccaggtctcacatccgggtcacgctgatgcaagaggtgggctcccatggtcttgggcagctctgctcctgtggctttgcagggtttagtcccacctcccacttgctttcaggggctggcattgagtgtctgtggcttttccaggcacatggtgcaagctgttggtggatctaccattactggggtcttgaggacagtggccctcttctcacagctccactaggtggtgccccagtagggactctgtgtgggggtccaaccctacgtttcccttctgcactgccctagcagaggttctccatgagggctctgcccctgcagcagacttctgcctgggcatccaggcattttcatacatcctccgaaatctaggtgaaggttcccaaacctcaatttttgacttgcatgtacctgaaggctcaacaccacatggaagctgccaaggcctggggcttccaccctctgaagcaacatccagaactgtaccttggccctttttagccatggctggagtggctggaatacagggtaccaagtccctaggctgtacagagcaggggggccctgggcctgagccatgaagtcatcttttcctcataggcctctgggcctgtgatgggaggcgatgctgtgaagaccactgacgtgccctggagacattttccccattgtcttggtgattaacattcagctcctcattacttatgcaaatttatgcagccagctttctccttataaaatgggattttcttttctatggcattgtcaggctgcacattttccaaacttttatgctgtgtgtcccttttaaaactgaatgcctttaacagaatccaagtcatatcttgaatgctttgctgcttagaaatttcttccaccagataccctaaatcatctttctcaagttcaaagctccacaaatctctagggcaggggcaaaatgccacgaatctctttgctaaaacaaaacaagagtcacctttgttccatttcccaacaagttcctcctcatctccatctgagaccacctcagcctggatttcattgtccatatgattatcagcatttttgtcaaagtcattcgacaagtctctagggagtccacactttcccacatttttctatcttcttctgagcctttcaaagcgtttcaacctctgcctgttacgcagttccaaagtcacttctacattttcgggtatcttttcagccgcgctccactctactggtaccaatttactgtattagtctgttttcacactgctgataaagacatacctgagaccaggcaatttacaaaacaaagagatttaatggacttacagttccacatggttgtggaggcctcacaatcatggtggaaggtggaaggcatgtctcacatggcggcagacaacagaagaaagattgtgcaggtaaactcccctttttacaaccatcagatcttgtgagacttacttgctatcacgagaagagcacaggaaagacctacccccatgtttcagttacctcctactgggtcccttccataacgtgggaattcaagatgagatttgggtgaggacacaaccaaaccatatcagttactaagtttagattggtaggatgtgagtagaaaatctgtatgcaaatattagatcattcagatattttcctatggctgataaatggcaacaactataataagtagcactggcccattcatctctagaatgttcattagagagaaataagcttttcccttcttttagcaacttattttgcttcactcaacctgttctctgaataatacaaaaggatattgagtagctcacaagagaaatgagaagactggataaactattgttggaaagaggccagatacaaataaaggctagcctacagcaaagatgaagccaatggaaagtttgagtaggatattcctgtcattgccacaggatcctgggttactaccactggcaccctttcagtaggtactgcatgctacaggaatggagagaaagaattgtaaattgcctttacatctttgcatcacttattaagactgagtcctgcttaatagtatctgcttggctaaacctaggtcttgtccataccgtggctgcctagagatatgaaatagggaatttaacttttctgttatatgtagtgaaagaggttctctttctggacaaaatccacacaataaaggattctcccaaacacaggaaaggggattcaaatgattgagattcccaaacaaataaaaaattcaaataatatatttttagctatagattgttaccataattaacaaggaatgggctaatttgttctctcatgtctactcagagaaactttgtaatgtggactagatgtaggggtagacaggttaagagacaaaccagcaagcttcagcatacaattttttcttaatgtattacaacagattttttttcctattctacagagaacagtgaaaaacaggtcaccatcatttatatgtaagagagttgcttaactgttatcaaattgttcctgttccttttctattccagaatgtcctgctcaatcctattgctcgattcttttaaatgtcttcaggacatttttatgtttttagtattcctttttaattcaattcagctacagttctcatataaggattgaagttggctgttttaaactcttaaattattgattgaaatacagtatctggaaatgtaaatcatgtaatttaatagttttgttgcgtagtgcctctgatctttatttaaagtcacactttattgtaacttactccagtttctcagatgctctttgtccttcactatctcaagacctttcttaattccaaagttcttcctagaaaacccttaccccattcatattctaagtccaggtcagatccccctgtaatatgctgtcataagaccctatcttttaaatttatatcatttatccctgtttataattatgtgcttgtatgattctttgattatctttcccagtggaatataaactccaagaagttaagaatgattatgttttgatcatctttgggtttccagaacctaatatagtgcatggcatgtactagccacttgcatttgttgttgttattgaatgaatgaattagaaatgtattagtttactagtatagtgatatgtagacattcaactagagatgttttataaggttattactctaataaactatgttatttacttcctgtataattacttctgaacattgagataagcaattgaatttgaacattttttaaaatgttattttatcaagcattggttcttggaatcttggtcttattttgtttcaatcctttggttttagattttaacatttgccattgggtggcagtattgactaccagaaaactcacttaaactctggcattcaagttgtagaaacttggtagttttgtttgacttagaaaaatgtaaaaactttcaactcaaactcatgaatattttatctgaagtattttatctgggttagtcatataacatataaggacatatttagttattttaggatagtatacacatgagattataggttgccttgtagaaattcataaagtagcttacattttcctttagaaatataataataatgaacacggtcaatctatttcttctcttttaactttgaggagggagaagtgacaggtaatgcgtttaattccgttaaattcttcccacttagcaaaaacagcagatctgacttttttgtgagagctaataaaattaaatttttactcttaacctactaagaaagttgactgtttgaaaataaaagcagcattaaaatgtatatatgacagccctttttcatgaattcatttatttatctttttcatttattaatgtaacagtttctttttttgagcttctattaagtgctagagactgctctaggtccttgggatacatcatggaacaaagaagacaaagatccttgtggaacttacattcaagctaggagagacagaccctaaataataaatatacattatatagtatgttagaaggtgataagtacaatggaaaattaaagtagaacagagaaagaggaatagaaagatctgggggttacatttaaaatatgatgatatgcttaggttttatggagaagttgacatgtgagaaaagactttaagcaagcaagagagttcaaccatatagatatctaggggaagaacattctaggcagagacctgtcagttcaaagaccctaaggcaagagcaagccaggtgtacataaggaccagtaaaaaggccattgtggctggaattgaattactgatggggagattagtcagatatgaacttagaagttacacaacaagggagatggttggggatgtggaattaaggggttgctggaggggatggagattcctgaaggatggagctatatcagctaaatattcttagctttgtagaccatagtgaggattttgactcttaccctaagtgaaatgagggagccattgaaggattttgagcagaagattagtattatgtggcttagttttataaagctcctattggtttccacctgagaatagactgtagtagcagtataccagttcagaggctactgctataatctaggtgagagatgatgatgatggtagcttggacaggttggtagctatggaggtggtgacaatggcttgaatactgaatgtgattttaatgcaggattaataggatttgctgatggtctagatgtggggggtgagggaaagaagagtcaaagatgactaaggtttttggtttgagcaaatggaaagacagagttgtcatcaactaatatgaggaagattttaggaagaatatttggttatggtatgccaagttagagatatctttgagatattcaaaaggagatagtgaggaggcagttggatatatgggtctggaaattgatggagagagatctgtactgtagatataaatttggaggtgttcgcttaaatattaaattggaaaccattgatgaaattggatgagattaccaggaaagttagcatagagagagagaatcgaaccaaagactgaactgtgggtcccaacaaaattcagagtatcctgtgctaggcatataaattcctttcttagataagcttgccttatgttgaactatttataaccacttattttgttgcctctgactttataagattttgttgcctctgactgcataggacaatgtaaaatgaacaaatcctgctctcaatatagctaattctacgtttgtcattttcagctgatcagaaccaaggtcttaaatctttcttgggattttttttttttatagtgtgtattgccctgtccatactcttaacatggtttatcaattttcttcaaagcataatatcttagctcaggctgctataacaaaataccacagattaggtcgcttaaacaataggcatttattcctcacagttctggagaccagaagtccaataccagggtgctatcatggtgagggccaccttcctggccctctcactctgccacataaagaacgaacaagatgactgcctttttgttctatccttatatgacagagagaaggagaggaggagagagcgagagcaagagagagccagagagagagagagggagagagaacgcacgtgagagtgcgaacttgtgagagctggagagagtgagcaagctctctggtctctccttgtaaggcactgatctcaccatgaggaccctaccctgataaccttatctaaatctaattacctgtccagagccccacctactaatactatcacgttgggagttagggtttcaacatataaattttgaagggacacaggcattcagtcaataatatgagaattttttttgtttcttttttttttttttttgagacagagtctttcactgccgcctgggctggagtgcagtgggctatcttggctcactgcaacctccgcctcccagtttcaagtgattctcctgcctcagcctcccaagtagctggattacaggtgcccaccaccacgcccagctaagtttttgtatttttttttttgagacggagtctcatgctgtcgcccaggctggagtgcagtggcgcgatctcggctcactgcaagttccgcctcctgggtttacgctattctcctgcctcagcctccggagtagctgggactgcaggcgcctgccaccatgcccgtctaattttttgtattttttagtagagacggggtttcatggggtctcaccgtgttagccaggatggtctcgacctcctgacctcgtgatccgccttcctcagcctcccaaagtgctgggattacaggcgtgagccactgtgcccggccaattttttgtatttttactagagacggggtttcactacgttggccaggctggtctcaaaactcctgacctcgtggtctgcccgccttagccgcccaaaatgctgggattacagacgtgagccaccgtgcctgggccatgaaaattcttagcatgaatatttcttaatgttatttcaatttatggaggaactattctctattcacaattaaagttatcttgggaaagtcaattaactatctggttataaatttcattatttatacaaagagattatttgcccttgtctgagtcttgggatgataacttgatcaaagtgaattgaaatagtgtcttgctgtttatgcttgactggctgataatacagtagcagtttcctttttagtaagtagacattttgtaatagtttgatttagtaaaatcttctgtttgcaatgaggttcagtacattttattaataaaaaaattgaatttgtgattaatatttatatattaggcaactatttacatattctgtgagcattatacatgcaccagtctaataaaatgggcagtttaacttttgtacctagaagaaattttgacatacatgctttcattattttataatttattattttagatgtttttgaaatatgattttgacagttacgattattcaaaaatctggtctttaaaatttttgaagttagtcttttctaagcatacatattttgataataccaggagttttcaaaatgtgtggtgcaagggttatataaggagatgggttggggtaggatggaagataagtgactcttccttttctgcctcaaccatagtgtcatcactttgcaatattttacatattgagattccttgtaaaactttgttttaagccttctgcagcccaaaaagagtaaattggaaaccattgatctttaaacaagagggcaatttgtttccatgccacaatagcatcattgaccgaaactgtaagagccaagtattcttggaacagatctagtataatgattaccactcacacaattcattgtcttataaaattaacagattgtcagaatagttgtggatatttaaaatagacaaaagttaatacctggcctttggagattgattttatgggtctagaacatgtgtagaatactttggatactgtaacaaaatcaaatttttaaaatggtgttagaagagagaacacttgcattgaaatcttgttttgacttttattggagaacttcagattcagtacatactaaatcataagactatatctggaatgattacaacaagctacatttacccctcttgctctaaaaatctttattcccaccatatcttccacttcttattaacaatccagtttcttctgggaaattgccttttgctaacgtagcatagtcttgctgggatgaaaaaatccaggtacctgtctattctaagcttgatttttctccttgaaaaactctctgaatttctacatattttttcaatacagtcccattttcccttaagctagccaaattaatttctgtgactcacatgtaagaaaacaaactgaagtaccaccttagagatactgttagggtgtgttttttttttctggttattagacttctttaaaatacccaaaattatatcagcaacctgcatttgatagaattcagagttagcaatatttatttaatgtgttcagttgaaaactgcaaaaagaaaataaatatagttggctctttaaacatgtaccacttcaacattaaaatgaatgcttttttcgtagtagtatagatgaaatataaattaagggtatgagccaaaattacatcaaaaagtctaaaatcctggagtaagattattttttgcttactttcccttttacttattttttattgatacataatatttacatatttatggggtatatgtgagtatttgttatccgcatagaatgtgtaatgatgaagtcagggtatttggggtattcttcactttgagtatttatcatttctgtgttgggagcatttcaagtgctcttttctaactacttagaaatatacaatatgttgttgccaactatagttaccctacactgccattgaatattataatttgtatcttctaactatatgtttgtatccattagccaatgtctgtcctcccccactacccacaccctgtccagcctctggtatccatcattctattctatacctccatgagatcaactcttttaactcccacgtgtgagtgagaacttaggatatttgtctttttgtggctagcttatttcatttaacataatgacctccagttccatccatgttgctacaaatgacatgatttcattcttttttttttttttgtggctgactagcgttccattatgtatatacactatattttcattatccttttgtctgttgagggacacttaggttgattccgtatctttgctactgtaaatagtgctgcagtaaatatgcaggtgcaggtatctctctgttacagtgattttgtctcctttggataaatacccagtagtgggattactggatcatatgatagttctattttaagttttttgaggagtttccatactgtttaccatagtggctgtactaatttacatccctaccaacactgtattaagagttcccttttctgtgtatccttgccagcatctgttatttttagtctttttaataataaccattttaactaagatgatatctcattgtggtttttgattggcaaattccctggtgattggtgatgttaaactatttttcatgtacctgttggccatttgtaagtcttcttttgagaaatgacttcatgatctttgctcacttttaaataggattatttgtttactgttcagttgtttgagttccttgtatatcctggattttaggtccctgtcagtaacatagttttcaaatattttctcccatcctgcaggttgtcttttcactttgtggattgtttcctttgctgtgcagaagctttttagttgaatatagtctcatttgtctatttttatttttgttgcctgtgcttttgaggtcttagccaaaaaatctttgcctaggtcaatgtctcaaagcattttgcctatgttttcttctagtagtttgatagttttgggtcttagggtttaagtctttaatccattttgagtttatttttgtatatggtgagagataaggggtgtagtttcattcttccacatgtgaatatccagtattcccagcacaatttattgaagagactgtgctttctccaatgtatgttcttggtgtctttgaaatcagtgagtataaatatgtaggtttattctttcactattatgtttcattgatctatatgtctggttttgtaccagtaccatgctgttttggttactatagccttgtaatatattttgaagtccagtggtgtgataccttcagccttattctttttgcttaggatttctttggctattggcctcttttttggttccatatgaattttagaattgttttttctaattttgtgaaaaatgactatggtagtttgcattgactctgtagattgctttgggtagtatggtcattttaacaatattaattctcccaatccatgtacatgggatgtctttccatttgtttgtgtcctcttcaatttctttcttctgtgttttgtagttttcctatagagattgtccacatgcttggttaaatatatttctaggtattttattttttttgtagctattgtattgccttcttgatttctgtctcagctagttcattatttgtgtatagaaatgctgcagatttttgtatattggttttgtaacctgcaactttactgaattcatttattacatttaagagttttttggtggaggctataggttttctagatataagattatatcatcagcaaagagtggcaatttgacttcctctttccagtttggatgcattttctttctttctcttgcctaatttctctggctaggacttgaagtagtatattgattaggtggtgaaagtggacatctttgtcttcctccagttcttagagaaaaagcttttggtttttctccatttggtattgaagtggcatcatttggggaaatagccaaggtttgttgtctcgcactaaggaaatcgaagacgtggacacacaatgagtgggtttaagagcagaaagtttaataggcaaagtaaagaagagaaaagctcccctgtgcagagagagtggtgttctgaatggatctccctctttgaggccagatgcgttttttttttttttttttttctttctaagaatctgactctgtcgcccaggctggaatgcagtgatgcgatcttggctcactgcaacatcctcctcccaggttcaagtgattctcctgtctcagcctcctgagtagctgggactacaggtgtgcgccaccacacccaggtaatttttgtatttttagtagagatgaggtttcgccatgtttcacctcctgacctcaggtgatccacctgccttgggctcccaaagtgctgggattagaggtgtcagccactgtgcctggctgtggttggttttatagaggggcttttggaggcggtgtctgatttacatagggcccagaggatttgttggaccaggtgtaccatttgcatagtgcactaagaggctggccatcccaccctaatcttttattacgcagatggggtcttttcctggccagtgtagacgcctgcacacatggcaacaaaagggaagggaaaatctccatgttgaatatacctggcttccaggtatcccttttctgttggcacagcttccagcattccagcttgcttatctatgcttgcagcttgatttttcaggctgctttttgttagaaaagaaatgattttggggctgtttttttttaaaaggaaattccactgagaactcttttacccttactaactgcctgaataatttctttttaactcctgtaacagtatgatattaactgtgggtttgtcgtatatgtccttttttatatcttggtatgttcctttcatgcttagtttgttgagagtttttatcgtgaagggatgttgaactttatcaaatgctttttctgcatctcttgagatgataatatggtttttgttcttcatgttgctgatatgatagatcacatttattgatttgcatatattgagccatccttgcatccctgggataaatctcacttgatcatggtttattatttttttaatatgctgctggatttggtattttttgagtatctttgcatctgtattcatcagggatgttggcctgtagttttcctttttttgttactttaatatttgggtttggtgttaggttaatcctggccttgtaaaatgaattagggacaattgtctccttttcctttttttttttttttttggactagcttgaggagaattggcattaattcttctttgaaagtttggtggactttggccgtgaagccgtcctgtcctggactttcctttgttgggagactttttattactactttgatcttttcagtttttaatggtctgtttaggttgtctaaatattttttcttgattcaatcttagtaggatgtatgtgtctaggaatttgtggattttctctatgttttccagtttgttagtgtatagttatttataataatctttgataatcttttgtatttctgtggtatcagttgtaacgtgtccttttacatttctgattttgttgatttgggttttctaatttttttttgttgttgttgcttaatctagcaagtggtttattggtagaccacatcttttcatgttgatcctttgtattttttttttccacctctatttcatttagttctgcttttatctttattatttatcttcttctagtaattttgagtttggtttattcttacttttctaattctttgaggtgcatcattagttcattttaaacctttctgcttttttgacgtgggtacttattgctgtaaacttccttcttagcattgcttttgctgtatccaatagcttttagtatgttatgttttgattttcatttgtttcaaaaagtttttttattttctctttaatttattctttaatcctttgatcatttaggaacatgtttttaaatttgcatgtatttgtacagtttccaaagttcctcttttcattgatttctagttttatttcattgtggtttcacaaggcatgattttgatttttaaattttttttgaagtttttttattattatactttaagttctaggacacatgtgtacaacttgcaggtttgttatatatgtatacatgtgccatgttggtgtgctgcacccattaactcatcatttacattaggtatatctcctaatgctatccctccctgctccccccaccccacgacaggccttggtgtgatgtttcccttcctgtgtccaagtgttctcattgttcaattcccacctatgagtgagaacacgcagtgtttggttttctgtccttgcgatagtttgctgagaatgatggtttccagcttcatccatgtccctacaaaggacatgaactcatcattttttattgctgcatagtatgctatggtgtatatgtgccacattttcttaatccagtctatcattgatggacatttgggttggtcccaagtctttgctattgtgaatagtgccgcaataaacatacgtgtgcatgtgtctttatagcagcatgatttataatcctttaggtatatacccagtaatggaatggctgggtcaaatggtatttctagttctagatccttgagggatcgccacactgtcttccacaatggttgaactagtttacagtcccaccaacagtgtaaaagcattcctatttctccacattctctccagcacctgttgtttcctgactttttaatgatcgccattctaactggtgtgagatggtatctcattgtggttttgatttgcatttctctgatggccagtgatgatgagcattttttcatgtgtctgttgactgcctaaatgtcttcttttgagaagtgtctgttcatatccttcgcccactttttgatggggttgtttttttcttgtaaatttgttggagttctttgtagattctggatattagccctttgccagatgagtacattgcaaaaactttctcccattctgtaggttgcctgttcactttgatggtagtttcttttgctgtgcagaagctgtttagttagatcccatttgtcaattttggcttttgttgccattgcttttggtgttttagacatgaagtccttgcccatgcctgtgtcctgaatggtattgcctaggttttcttctagggtttttatagttttaggtccaacatttaagtctttaattcatcttgaattaatttttgtataaggtgtaaggaagggatccagtttcagccttctacatatggctagccagttttcccagaaccatttattaaatagggaatcctttccccattaattgtttttgtcaggtttgtcaaagatcagatggctgtagatgtgtgatattatttctgagggctctgctctgttccattgatctatatctctgttttggtacctgtaccatgctgttttggttactgtagccttgtagtatagttggaagtcaggtagcatgatgcctccagctttgttcttttggcttaggattgtcttggcaatgtgggctcttttttggttccatatgaactttaaagtagtttttttccaattctgtgaagaaagtcattggtagcttgatggggatggcattgaatctataaattacctttggcagtatggccattttcacgatgttgattctccctgtccacgagcatggaatgttcttccatttgtttgtgtcctcttttatttcattgagcagtggtttgtagttctccttgaagaggtccttcacatcccttgtaagttggattcctaggtattttattccctttgaagcagttgtgaatgggagttcactcatgatttggctctgtgtttgtctattattggtgtataagaatgcttgtgatttttgcacatgattttgtatcctgagactttgctgaagttgcttatcagcttaaggagattttgggctgagatgatggggttttctaaatatacaatcatgtcatctgcaaacagggacaatttgacttcctcttttcctaattgaataccctctatttctttctcctgcctgattgccctggccagaacttccaacactatgttgaataagagtggtgagagagggcatccctgtcttgtgcccgttttcaaagggaatgcttccagtttttgcccattcaatatcatattggctgtgggtttgtcataaatacttcttattattttgagatacatcccatcaataccgaatttattgagattttttttagcatgaagggctgttgaattttgtcaaaggccttttctgcatctattgagataatcatgtggtttttgtctttggttctgtttatatgctggattacgcttattgatttgcatatgttgaactagccttgcatctcagggatgaagcccacttgatcatggtggataagctttttgatgtgttgctggattcggtttgccaggattttattgaggatttttgcattgatattcatcagagatattggtctaaaattctctttttttgttgtgtctctgccaggctttggtatcaggatgatgctggcctcataaaatgagttagggaggattccctctttttctattggttggaatagtttcagaaggaatggtaccagctcctccttatacctctggtagaattcggctgtgaatgtgtctggtcctggacattttttggttggtaagctattaattattgcctcaatttcagagcctggtctattcagggattcaacttcttcctggtttagtcttgggagggtgtatgtgtccaggaatttatccatttcttctagattttctagtttatttgcgtagagatgtttatagtattttctgatggtagtttgtatttctttgggatcggtggtgatatcccctttatcattttttattgcatctatttgattcttctctcttttcttcttcattagacttgctagcggtctatcaattttgttgattttttcaaaaatccagctcctgctcctggattcattgatttttttgaagggttttttgtgtctctatctccttcagttctgctctgatcttagttatttcttgtcttctgctagcttttgaatgtgtttgctcttgcttctctagttcttttaattgtgatgttagggtgtcaattttagatcttttctgctttctgttgtgggcatttagtgctataaatttccctctacacaatgctttgaatgtgtcccagagattgtgtgtctttgttctcattggtttcaagaacatctttatttctgccttcatttcgttatgtacccagtagtcattcaggagcaagttgttcagtttccatgtagttgagcagttttgagtgagtttcctaatcctgagttctagtttgattgcactgtggtctgagagacagcttgttataacttctgttctttcacatttgctgaggagtgctttacttccaactatgtggtcaattttggaataagtgcgatgtggtgctgagaagaatgtatcttctgtcgaattggggtggagagttctgtagatgtctattaggtccgcttggtgcagagctgagttcaattcctggatatcgttgttaaccttctgtctcattgatctgtctaatattgacagtggggtgttaaagtctcccattattattgtgtgggagtctaagtctctttgtaagtctctaaggacatgctttatgaatctgggtgttcctgtattgggtgcatataaatttaggatagttagctcttcttgttgaattgatccctttaccattatgtaatggtaaaggataccattcttcgaagaagaaaggtagcttctttgtctcttttgatctttgttggtttaaagtctgttttatcagagaaaaagaattgcaacccctgcccttttttgttttccttgagttttcttttgtgtcctaacatatagtctatcctggagaacattttatgtgctgatgagaagatgtgtattttgtagctgttgattgaaatgttctgtaaatgtctgctaggtccatttggtctaatgtgcagtttaaatccaatgtttctttttctgtctggatgatctgtctaatgctgagagtagggtgttgaagtccccaactgttattttattggatcaaataacactggtgccaagaaacggtgccagggagcccaagacaggcactcttagactgccactgtcacccctacggcccaaagattggcccagggccaatttctccctttaaatgtattaatttcttcctttaaatgtaataatgtttgctttatatgtctaggtgctccagtgatggctacatatttgtttagaattgttatatccttttgctgaattgatccctctatcattataaaatgaccttctttgtctctctttattgtttttgacttaacatctgttttatctaattagagttactcttgctcttttctagtttctgttttaatggattttttttctatccctttattttcagcctctatatgtctttacaggtggtatgagtttcctgcagttggatcatgtttttctttttttttctttttaaaaaatccattcagtcagtctgtgttttttaagtggaaggtttaatttgtttacaatcaaggtttctattgatatatggggacttaattatacttaatttttttgtgtataaaatgagaaggttgtcttaataataacaaagttactattatgaagcatttattatagtattaaatattaagcattttacttagaatctcattttatatttagaaaaatcttatattctaggtggaagctccacaattaaactgaagcttagagaaattaggtaagtttgcccaaggtttcacagctagtaagtaggaaagctagatttgactgcatagctcatgctgttactcctttacagcttaaggtgcttttcattcatccatccattgattgattgattccataagtgtatactgaggctaatcattagtaattgttggctatgttaagtacttttcattgtattttattatgatgggaagtcactgaaggattattagtaggggaatgataggagtagaattatgtttttaatcattctggttgcattctggatagttgaatgttataggaaagggataagtatggaaataagaagaccaggttttagactattgcagtagtccagttgagagtgggtggtggcttggactgaaatggtagttgtagagacagggatcagtggttggggtatcgtggggtgctagaatttaaaaattcttataattagtaagatacagaccagacaccaatcaaaatggatggtggccattggactagagtaagatcttgatgtgccgtgttgtgccaggcattacccctctagttatctattgtagggaggtttgaattatctcaagtgaggagtcaggggaacagggacagcaagactgataacgtgcgatgctgaggtacatctacttaccaacagtcattgaaacttttatactttaacatgtggaaagactgtaatccctgcatacctaattaatattcagtttgtttgtgggttggttgtatggggtgctggagaaagaggcaacttaagaatggcaccaaagtttttgccctgagcaactggatgaatggaagtgccgtttactcagctggcaaacactgctgaaggaattggtttgggaggaaacgatcaaggttttagttttatacatgtgaagtttgagatgaccctctatagatatccaagtggaaatgtaaagtagtagtttgaattcatgagagattgtggggctggacatatacatttgggatatatcagagcacaattctactctgtatgattatgtagtagctttttcccttaaaaaatctctcagcagcccgacactaatgcttaaagttacagtgttagaaattcatttatactctttggttttttaaaactgtgcataacctgcggagaagattctttttgaaattgcactataaggtgaatttgtttattacaccctttaaaaaacagctgagatatactaccttgagaaattgtcatactgattgagaaaagtaatgcagagagagttatggggatatattgcatgagatactaaagtatgaagtggtagaataatttttatggatatatttttataaaaaaggagtcttgcacatatagtatgttcttattcataagtgggggctaaaaaagttgatgtcatggaggtagagtagaatgatggttaccagaggctgggaaaggtttcggggagagagggatgacgagaggttggataatgtatacaaaaatatagtcagacagaggtaatatgttctagtacaataacatagtagggtgactatagttaataatttattatatatttcatagctagaatatttggaatgtttacaacacaaatgtgttcgaggcaacagatatcctaattaccttgttttggtcattacacattgtatacatgtatcaaaatattacatgtagaccataaatgtgtataattgttcagtatcagaaaaaaaattttaaaaagtggactcttgcttagatgtccttaagtgtagatattagtattagctgtttaatgggtggggaagtctttttgtcgttgtttgtgttttaaattaatattcagttaattagtatacattttaagtcattttggttatagaatacagaaagcttcaaattaagacatctaatttttttcttaaatctttgaattatatttataaatcttgtcattctatttataaatggattaatttagagtaaaataaagacaacatatagattgggctacagacctataacatcctggaactgcattccctgcattcttgcctccttgcctgttcctctatcttcagatccgggactgcagcatcttgctttgatagtcacattgcttccttctgcagtcaaatctccctctcttataaggacacctgtaattatatttagagccaatttagataattcacgataatctctcccaaatttcaaaatccttaatttaatacatctgtaaagttccttttgccatataaggtaaaatccaaagcttctggtggttaagacctggatacctttgagggctattattcagtccactggaaacttgttctgcagtattttgctttaatgcagatttgataaatatattggtgatttaaaaatgtacccaattttcaagatttttttcatgccagtgttctctatcaaactcttttccaagtaatacccacatattacttggctgctttcaactctgtgcctttgggtggtggcctgtttttaatgttttatttagaaataattttaaagttttagaaaagttatacaagaataagaatagtacaaagactatctgaatgtccgtttcccagattcacctattaacattttactctattttctttggtataactgacttacatgttaaaataaatctatatttccttttatgaaaatagatacaacatttataccaatagatgcattatatataatttctatatgatttcatgtcttttcagttaaattagaggttggcaaacttttctgtaaaaggccaggtagtaaatactttttctttgcaagttacatggctctgttgcaaccactcagctctgctaaagcagccatagacaatacttaactgaatgaacatggctgtgttttaataaaactattaaatgatttctaagttactgtaattaaattaaaaaagaggttcctttaatatctctgattactaaggaatagttcacagtcttttctcactcagaaataatagttttctatagctgatttaaaatattatcattatcaaagagataatctgagatacttcctagtttgtacctgaaaaatacagagccatacaatgtaagcattgaaaaaaatcttgaagatgaatcaattaatacctgggtgagtgaacacatgaagacatgaaaactgtatgggtcaatatttcttaaatcagactctgcttgggagttttaaaattttgttattaaatgacaatctaaaactttttgatataagcaaattgaagattaactgcctgatctcataattgagtaatgccactgtattgtaatgccagcagttgtgttgacaatttaaagttgggattaagtagtatccctttaattactgtaggctaaaaacaatacaactaaagtgtactaatacttttgtgacaagtgaagggtaaatgattatatgccatagtatatgaatttaaaagatttgtaaaaagtaggttgaagaaaaatggtgggagaattatgttgtcaaaataatgtaggtgtgctaaaattatgtaaaaaaggcattatgagaattaatatcatttttaacttgggacccattattttaaacaaaacaatattatcatattcagtaaatattagttttataaatttacttatatataatttataaatgtatgtttgttttatgcttataaaagaaatttaaacataggagtttatgtctagtatttgagaattttttagtttcattaaaattaaaatactttgtgagccctaaagtttgatgaaaatatattccctttaggagaattccttctattatgtttgagaaacactgatggggaaaccaagacttatgagtaacatcatgaatatggaaaggaaaaggctgtgttttcaactttatagtatttgaaattattctgcactaatttaataatttttattttatgatgcataatttttttttctttttgaggactccactgaagcaaactttggttgtccttaataatgctaaaaaaaatgtaatcttttttatgtttgtttaatagttaataatttttaaactttaatttttaaatgcttttacttccactattttaaaaaaataaatatttattataacccttggtggtagattattatatccatttgtgtagatggaggcttgatgatgaaagaggtaaacatacttccctgacagaactgatatttgagtacattgttttctattttaatactcttgtagcatactaaaataaatctgacattttatattatttaaataattctttaaaattgtgaaatttatttgaacatccaagtccgattgtgagtatatgacttttttcgcctctaagcattacattttctgtgagtattattcttgtaagttatatttcagataatttatgtatatatttgttaatatgataaacattgaattcttaaattctcttaatccatatgttgtatttctataatctgagggctttgtttaatctagtgtgttgtttcattttttttttaataggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaagtaagtatttattttcagattcttgctgttttttaagctggatttttatccaaaatgtcttttttttttaattgttgtccgagagtaaaagtggttatttttgtggtagtgtctatttgctagtgagactgatttgtgaatacatgaactcagtatgtccatagctgtcattgcacatagaagtatgcttcatgtagaaatgttattacttctctagagtacttttaataaattctgagtaagaaaatattaacttcaaatacaggcaggccttgcctataatggataaaatgaatcaaatgaatcatgccacctttttttttaatgaagtataatctcatatataaaaatcctctcaatttgttctgtaaattttagtgtacctgaactttactttgtatgtgctttacaaactttcattgggagaacagttctagtattatgagagagatgattgatttactgttggctcaatagagattgttctctgcatgattggataaggggaatcatatggatggcagctttatctgatttctttttcagctaatgattgtattttatgaactgtttagtaacaatacaaaaggaaatagggagaatcatttgatttttaatgttgcttccaggggtagtgttcatattatgtaataactggtacagcttgggcatcaaacaatcagaacttgccctggacagtatggcataatggtgtatacacaatagaattgccagatttagcagataaatatacaggatacccagttaaacttgaatttcagataaaaaacaagtacatttttagtataagaaggcccttttgctgtatatatatatattttttacaaattttgcatgggtcattctttaacaaaaaattgtttgttgtttatctgaattcaaatttaactgggtatcttgtattttatctgccaaccctaaccactgaatatattaaccctcataattaggaagatttcagaaattctgtaagaggagattgctttaaaactatgattgaatgcgactgaaattaaattagaaaatcgaataaattctggagagaaggagggagttttatgtaagtatttaagtggcaaattagaattttttaacatgaagaataaaatacagaaggaagaattgaaagagagttggtgggattaaaatgaattgttaagataaaaacctggagaaataatgatatttaaatgtgaaaattaaaaggaaattaactatgtttaaagaaaatgagaagtctatgaaagtagagtcgaactttgaattaaattgtgatatttccaaagtcgagtttgtaagacaaagagcaacattgtcaacaaggaagtttgtaaattttaagttcatgttctttgcaagatgagtagcatatcaaaaattaaatgatgaatattatttgctattcttttaaatttgcatattttccattggaaccagataaactatttaagccaacttttttttgtctgaaatctgagtattttggttacagtgtttatataaacaaatgagggattagagtagaataattgtgttgctgttttcacaggttagagaatacttttcatcattctgaatgtagttcaattgtaggtaaggataacagctttcagaagtgataggataagtcataacttgatttaatcatcttctatagtggaatttaattggggtggaaatgttacattttaagacaaattattcactaaatataaaagctctgtgttagtgtctattaaattagaaagacttttacagaatatatatacattaacattaatgaaaattaacatgtattcatgaggatagcaaacttttgaaaacactacgtgcttgtttcttgggatatatcattggatataacaaatgcccgtgtctttgtaaagttagggaggaaaggctggcaatgacaaaaaaaaaaacactattaccaaagtaaattatagacatgaacatatatacatatagagacagatgggatggatggatggatagatatagatagatagtaggagtaggtaaatcaggagtgccaaagaagagggagttgcaattataaatgtaatagttaaggtaggcttcataacaaaggtgagaactgagcaaaaacttgaaggagatcagaggattgcagttatttgtaggcgcagaaaagagccagatcaaagacttaagataggaactccttgaggtgtttgaggagcaacaaccaggcccatgcaatttgcatggaatatatgagagggatacattaaattagagtgataacagaggagagagacagatcatgtaggatgttgtagatcttttgggagtcatgggagggttttgagcatgtgttgatccatattttaaaagtgttaccatggcggtttattgatgatatactggggattaggaggaagattagaaacgggatttgagttaagatgaaattatcaagggaatgcattctagatagagaaaaggaccgggaactgagcctgaggcaccatatcactaagaggttgtggggaacaggggaagccatcaaaggagactgaaaaagaatgactggtgagataggaaaacctggagtacagtatcttcaaaggcaagaaaaggcattatgtgaggattaaggagtaattaataatgtcaaatgctgacgattatccaggtcaaggaaaatgaagactgaaaactggtcatggatttagcatgaggaaattgaccataacaaaagcagttttagtggaggggaggggttaaaagcgtgtctagagttagtttaagagagaatggaaagtggggtggggatgggggtaataaagaaatgggggagtagcttaagggacagtgtggtcaaggggtttttcttttattattaatggtttataacaccatgtttgtgtgctgatggcaaagatctagtaagacaaaatatggtgatgtaggaaagagatctcgtgtgcaaggaagaagaatcacttgttattcttcggcttatcaaactgcagaataggggctcagggcctggaaactaagaattttttcttagcgtttttagtttttgctttttttcttttatttgattattttattttttcttttatttcttttattttttcttttattttcttgttttattttatttgcttttttcttttatttctttttatctgtcacccaggctggagtgcagtggcgtgatcatggctcactgcagccttgagcttctgggcccaggcgatccttccacctcagcctcctgagtagctgggattataggcatgcaccactatgcctggctaatttttaaatttttttgtagaggcggggtctccctatattgccctggctagtctcttaactccagtgctcaagtgatcctcccacctcggcttctcaaagtgctgggatttcaggtgtgagctaccgtgcctggcctggattttgtacttttaatgggctgtaaaaaaatgaagaatatgtgagaccattgtggcccacaaagcctaaaatatttactgtctggccctttacagaaatagtttgtacagccctaatttatgataacttggaaagcagtgtgttggctgcagatactggtagatgggtggactagtggtgtgaatctgtggaagttatgttctgattatgtttcctcgtttgtatcatacacatttatcttacaattccaaggtaggaaataagttaaacaatgctgcaatcaaatttggtaacccttacctttcttgtgaaggggcacttgggcacttcctttcctttcctaattcattggaggaagaaagagaagttgggaagataacaattgatagcaagcttcttaaaacaggctcctgtttcttggctggatgcttccttttgtatattttagcaaatggaggaaatttgagcatagagtataagcatttgggatttataatttgggacttcagttttcatatgtattacaccagtagaaaaaaatacgaattttcttttcatgttacataatccaacagtgacttatttttatagaagcttctctactgccaaattcattttatacagtcttaaaaaattatcagtaaacaagctatatttgtgcataggaaataaatgcttattggttaatttatataatgctaagataagtgtgtgggtatgtaaagtagcacagtcattatggtaaacagtgcggaggttcctcaaactgaaaatagaattactatatgatccagcaaacccactgctagatatgtagccaaaagaaagtaaatcagtatatcaaagcgatatctgcactctcagatttattgcagcactatttacaatagccataatatggactcaacatgtgtccatcaactgataaattgataaagaaaatgtggtatatatacacaatggagtattgtttagtccccctaaaatgaaatcatgtcatttgcagcaatatggatggaacaggaagtcattataagtgaaataaaccaggcacagagagacaaatattgcatgtcttcactcaaatgtcagagctataaaagttgatttcatataggtggagagtagaatggtggctaccacagcatgagaagagaagcagggagaaggggacaaagagaagttggttaatgagtgccaaaaagcaattagatagaaggaataagttgtagtatttgatagtaaagtagggaaattatagttaacaatttattgtatatttcaaaatagctagaagagaagaaatgttatgctcccaacacaaagaagagataagtgtttgaggtaatagatattctaattaccttgatttgatcattacacattctatacatatatcaaaataccatgtgtataccatatatgtacaacttaaatatcaataaaaaacttataagtatcaggccaactaaaaaaaaggaataaaaataaatacctaaaacaaaatggagagaattttcatctgtttccaagaaggaaacctggcttaaaaaaaaattaaaaaatacagtcaaatcactattgtttagcttaatcaattgatggaaattattaaaggcaattggacaattaattccagtaataaatatcctaatcaagttaatgtatattatacattcaggagactgaatcctaatttagtgtaggtatatcttgaatgagtctttattagaaatttctaatatggcacatgaaattatgagtttattagttgtaactctttttgaatttaatgaatacttggacacaagtgaataaaaagcacgtgaaaattaaaaaaacaaaaatgaatcttagcttatgaagttattttcttttcttgcttttagttacaatttagaaagcagtatatggaatgtaggaactccatcaaggggacctctccagagatatggacactctcttgctttatatcaggtatggctcctgctttttaaattttaatcagattttgtttttgatagtttaccacaggctaaaaaatactaaatctcagatttatttcaaatatttaatgagaacaatagattatatggatcatgataacttgagataccacatactcttatgcttttagtaaaagaatagattttagaacaatcccccacatgacatgtaaagaaatgaagattgagtttttgtctatttatgcctagtcaatcacttaaaaaaattatggcgaaatacatgtaacataaaatttaccattttaactatttttaagtatagagttcagtggcattaagtacattgacattgctgtgtaaccatggctaccattatcttcagaacatttttcatcgggcaaaactgaagcaataacttctcattcccctcttcccttatcctcttgaaaccaccaatctacttttctgtctctgtgaatttaactgctctaggtacctcatgtaaatgggattgtacattatttgtccttttatgactgatttgtgtcccttagcacactatcttcaaggatcatccatgttgtatcatgtgtcagaatgtccttccttttgaagctgagtaaatattccattatatgtatataccacattttgtttatccatccatctgttgatggacacttagatagcttccatcttttggccattgtgaataatgtttctatgaacatgtgtgtacaactatctgagtctctgttttcatttttttttggtgtatacccagaagtggaattgctaaatcgtatggtaattctatgtttaattttttttttttttagcactgccatagtgttttccactatggctgcaccattttacatttccaccagcagtgcacaagggttccagtttgtccacagccttgtcaacacttgttattttctgtttttgtttttttgataattgacctaatgagtatctcactgtgattttgatttgcatttctctaatgattaatgatgttaaatatcttttcaagtgcttattggctatttgtatatcctctttggagaaatgtctattcaggtctttagccagttttgaattgggttgttttgtttggttgttgagttggaggagctctttatatattatggtattaacaccttatcagaatatgatttccagatattttccccctttatgggctgtcttttcactttgttgagagtgtcctttgatgcacagaatttttaattttagtttaatttaattttaattttaatttattttttcttttgttacttatgcttttgtgtcatatgcaagaaatcattgctagatccaatgtcatgaagcttttcctctatattttctcataagagttttaaagttttagttcttaggtttaagtttttgttgcattttgagttaattgtgtctgatgtaagggtccattttcattcctttgcacgtggatagccagtttccccaacatcgtttgttaaaaaagaaactgtctttttcccattaaatggtcttggcaccctagctgaaagtcctttgaccatgtatatgagggtttttttttctggactctctattttattctattgatctatatgtctgtctttatgctagtaccgtactatttagattactgtagctttttaataagttttgaagttaagaagtgtgatacttcctactttgtttttatttctcaagattgttttggctattcagggtcccttgaaagtctatatgaattttaggattaagtcttctatttctgcaaaaatgttggggttttgacagggattgtattgacattagttatttttatgtatttgtgggattcataaatttagcatgattaaaatgacaggacacttgtttggttttcattttgaatcaacaaaatttcatgtattttgtggcctttggctaggctgtctaaatatgaatttatatgttttctgtgctgttgttaaaaaaaattggaaagcatgggagcagtataaagaacaaactaccacctgtttatccatgcatttgtgtgttttaaaagtaaaataaaagtatttctatgtatgaaaacatatacctacattttttgccttgttttattttttctttatttccctttttgtaacagccttactgagatataattgatataccatacatttcactcatttaaagtgtacaattcagtggtttttagtatattcagagttgtgcaaccatctattgcagatttatgtaagattacagagttgtgtaatcacttttagaatactttcattacttcacaaagaaactttgtatcctttcggtatcaccccacacttcctcgtcttccctagccttaagcagtcacaaagctactttctttctctatatattggtccatgctggacatttcatataaatgaagtcatatactatgtatgttatgactaccatatttcacttagcataatttcaaggtttatccatgttgtagaatgtatcagtacttcttcattcctttttatggctaaataatattacattttatggaaatataccgtgttgtttattcatcggttgaggacatttgagttgtttccaccttttggctattatgaataatgctactaacaacattgctgtttaagattttgtctggacatatgttttcatttcttttgggtatatacataggggtggacttactgggtcaaattcactttttgaagaactgacagaatgttttccaaagttgctgcatcattttacattcccaccagccatgtatgagggtttctatttctatacatccttgccaacacttattagtatctgcctttttgattattgccatcctagtgggttgaagtattatctcattgtggttttgatttgtatttccctgttaactaatgatgttgagcatctttttgtgtgcttttggccatttgtatattgtctttggagaaatgtctattcaagtcctttgcttattttaaaattaagttgtccttttattattgagttgtaagaattcttcatatgttctagatacaagccattatcaggtaaataatttgcaaatattttcacccatttcgtgtgctgttttcactttcttgatgttatctttttaaacacaaaaaattggactttatcttgataaagtccaatttaactttttttccttttattgcttgtgatttggtgtcatatttaataattcattgccaaatctcaggtcataaagacttaacccaattttttttttcttttaagagttttatagttttgattcttgcatttagttctttgacctattttgagttaagttttgtatatagtatgcagtaagggtgcaagttctttttttttttttttgcatgtgactatccagttctcctagcaccatttgttcacaagacattttcttttgtctttgaatggtcttggtactcttgtcaaaaatcaattggccatagatgtgtgggtttatttctggactctcagttctattccattgatttatcccagtatcactctgttttgattacttttttttttttttttttgagacagagtcttgctctgtcacccaggctggagtgcagtagtgtaatcttggctcactgcaacctccacttcctgggttcaagcgattgtcctgcctcagcctcctgagtagctgggattacaggcgcctgccaccatgcccagctaatttttttatagttttagtagagatggggtttcaccatgttggccaggctggttttgaactcctgacctcaagtgatccactcgcctcggactttcaaagtgctgggattacagtcatgagccaccatgcccaacctatcttgattacttttgctttgcagtaagtttttgagaagtgggagtactccagttttgttcttttacaagattgttctgatgttctgcatcccttgcaatttcatatgaattttggaatcaatttgtcagtttctacaaagaagccagctgagattttgatagggatcatgttgaatctgtagatcaatttggagagtattatcctcttaatcaatttggagagtattatcttaacaatgttaagtcttcagacccataaacatgggatgtcttttcatttatttatatcttttaaaaatttatttaaacaatgttttgtaattttcagagtataaggtttggacttcctttattaaatttattcataagtattttattcttttagatgcttttgtcaatgtaattattttcccaatttcatttttggggtgttcattacaagtgtatggaaatacaatttactttttgtacattgatcttatgttctgtaatattgctgattcatttattagctctaagtgctttttaaaaaaatttttaggactttctatataccagattgcatcatctgcaaatagaaatattttacttcttctttccaatctggatgtctttatttagtttttgctctagctggaacatccactacaatgttgaatataagtggcaaaagcaggcatgcttatcttgttcctgaccttagggaaatgtatctagtctttcactgttaggtataatgttagctgtgagtttccttaaatatcttttgtcaggttggaaaaatttttttctatttctagtttgttgaaataatgataatttacatcatttatgtaccatttatttccatcatatgcatttgaaataatttgtataatttaaaagttctacaaggatttaccaaaggtgaactgaaggcatgtggtgtctgtctatagccattagaaatggtaacagaggtgtactctacatgatgcacaaatgtgatatgtctttttggtgaagagcacgtgatgaaaacagtaaataactgagaatagcacaaagctactagggactcagatgattcaaatattgaagactatgagtaatattaatcaacaacttagtttgttatcttcagttatatgggaggagtacattattctttgttataggactacctcacccttaaattgtaagttctttattagcttattgcattttccattcttaaagcagtagtttagtgttctcttactgtatgacaattaaaagtatacttaattgactacataatgtgatagttaaaaaatatatttaaagtagctttttgaaagctttgctgtttccccccctttttgtatataaaagcattagttgtcattattcatgtgttctcattactttttacaaatgagaacaatgccttatgcatgttgtgaacaattactaaaattttatgtaaatttaacctttatttttaattaatatgtgttaagatataacattattttatctattaatatatgtattttaatttacaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctaataaaatcttcatatgaatttagtcaaaatggtgagttatttgagattgaaattataagctgataattaataatttttaatataagcttttttgattatgttagattttgtcctttaatatttaagcttacctttttaaccaaatgaggggaaatattacttaatagtctcattttctaagatttgtgaattttttaaaaaaatatgtgaaattccagtaggtggtgctatttctttggattttatttatgaacgaagtactgaaactatcccagtctctttactatgcattgcatggtttcaggattttttattttttagcattctatttctaatcttactgctatatctttatgtatgtattacttctttaaagtcagcttctcaaggatagtctgctggcttctataagagattattatctgttatgtgaaggtgaaggtgtctagggcaatctacatgtgagtttttgtactatacctttactccattttgtttttctggtacttcatttttttgaattatttataacatttttaaaacagtggtaaccttctttattgtttttagtttgtttacaaatatatgccctatggtggttattcagattcaagaaaataattcttttctggctctggccagtatgatgaactcaaattcttggctcttttgtgtatggacaactatatatacaactatttagagtccttgtgcagtcttaatgagaaaactcatttgcagaccaccattagcaagagagtacttgtatgctcagaggaagactccccttcgaaatactccactgtttcccttgcagtcctttcaagtgatggctgtttttgtttacatattctcagtacagctgggtcaaaagtgggttacatatcccctttacttcttattgccatttccactctattctcaattcctcctcctttaaattgcctggctttgactcttacatcatcagaatatatcacctattacttcaccttcctgcactcatcctttgctctcagatggctgtgttttatttcttgaggaatttagcttctggcttactgtcactgtgtccagaatacataaggcaaatatttttatgttgtaaatatgcacttaagtacttctcctacctggcctgtcaatttcttgatctaccaaagattttgttttccatcctccttgagccactctctccattgttacgttctagaccttgttattccagtacaatgagtccataatttccatatgaaatatcttacttttcaagtcccactgatctctccagcttactgtttctaatgcccacactctgacaattctttgaccttaccagagcctttagtctgttgagactatcagtttttccactatctctcactctttttttgtccatatttctaaccctacctttttaatccatacttctagccctacccatacttctaaacgtacctagctttaaatttcataattactgttctcaagttgtttttttttttttatgatatccggtacttactcagctgtaagtttataattactcatgtcaagttggcccttaatgacatctggaacttctgccagtgtagcttggtctcgctcccagctctcctggatgactatttcataccttttcctctctcctcaagtttcaaacacttccttctctatcatcactcgcaattgatgaccttagttcttattttactgagaaaacagaagtaatcaggagagaatggctattgatgagaacacgttggagggtgatggttaataagcaatgctacattgaataagcttgcttacatacattattgtcataacaaactcatgacaacgttgaggcagatgtgtggctgagttattccaacttttgaaatgggcccaggagtttttaagcaagagttaacagatgttctatgtagaagggcagttttcttttctgattttgttattaatttttggttttattatagtgctcaggaaatgttggtcttatttctactttttaaatttattgaaattttctttgtgcctcagttttcacaaatatttgataggcacttgagaagaagataaatccaataatatcaaggtatggagtttgatattatttatttataaaatcgactttattgattatattgtttaggccttctgtactgacttagtattttttgttcttgatttatcttgctgtgaaagtggaagtaaaattttaaagtgttagtgtatttttcatatttctccttatatattctggaatttatgttttatagaagttgctattacaaatattaataattgttatgtgcttattgtaaattgtattacttactattataaagtggtttgtttaatgttttcttgacctgaattctacctcatctgtcgttaatattgcccttgttttgtttttttggtcagtcttttcctagtatacctttgctcatccctttattgttattattgtttagtgttttagaatcactttaaaaaaatgtatttcttgcatacgagagagttgaattttgctttgtgattcctgttttttttttgtaaattttctgtacatgtcttgtattttcaaaagtcattcttgcttttttgttgatttgtttttaattatagctcttctcacgtttagggccctccttccccttaactttattttatttttttgtggggatgggtgtggtaagttttgagatctgcttccattagtttcctctatgctacttgtttctcattgccctttcagcatttttgtggctgcttctgtttagctgttttggtttcacttgatttttgtacgttcatacctaatctagactttatgaggaattttttttttaccctcataatttctctggaaatgtaattttcttttcctttcacttcatctactttccccatgttttccttttgttttctatttcttttccagggagaatgggggagattcagaactaaactgttaccacatttgtccttgaaacacaggttttgacttttgaaattttaaaatgagtacttaacttagtctaaagttaagcaatactcttattctttgatcaacctccaatttataggatactgttttccactgttttagttatttttgttttgtttcaaacacaatgataattatatcattttataatataaataaattaaaaataaacagtaagtatatcatttatttacaggggtcagcaaaaggcatctataaatgaccagatagtaaatatcttaggctttgttggtcatacagtctctgtcacaactaattaactctgccttgtagcctgaaagttgccatagacaatagataaacaaatgggcatggttgtgttcaataaaaatttatttacaaaaacaggtggtgggctagatttagcctttgggccttactttgcctacacttgctcttaagagaaagagtatgcttctagggccctagtaaccctgatccaacttaaattaaaatttggcatatagtttttttttggacattatatatagggaaaattcatgccccaaagtagcctgatatctagtaaatggcccaaagttcccagggggaatagttgtttcgtatatgtggaaccaaggctgaaatagatgctatctatctgcctccacggagcatatttttaaaaactcactttttcattgaggatgtacactttcaatgatcttgactttacatagatactctctaatcttatacctacatgggtccaccttcaatgttggccattaaaatggaatctctaggccacctgattagtatatgtcatccttactgaatatagtttataattcacagttggcagaatatatttcgtgtgcttcatcgtttcctttattgaacgtttgtcccactcagccatcagacataatggtggttatgctttccaaggatggctaggaaagtactatgggtttattctgatcaactattagtgataaatattgatataggttgttagctgatatattaatctcctggtaggtttttgtttgatttgggataatctgattacagaatgccaattttgttttagataatctaaacatatttttatattgagtttcttttggcttattctacaaccaaaatactatgtctaaataaatttatctgcagggtatttttggcttgatttttgtcttactaactgcattacttgtcaggcatacttaagaatgtagtgtaagatgaaaatgggaagaatacatgattgatgagttttataagaataatagataaaccatgggcagtttcacattctgtgaattattgaagtacaaagcaaaacccaacaaattttttataaaattatttcttaatagaaaaattaatatcttactttacttattcctaaggcattttgaatttgctgcttacatgttgaaagtatgtggtgtcataaaataatctatagtactttcaaagaaaagagtacaaaatgatgggtaaatgtagtttaaagatgctgtcagaataattaaattcaccacactgtcttccacagtggttgaactagtttacattcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcatttcttcatgtgtttgttggctgcataaatgtcttcttttgagaagtgtctgttcatatccttcacccactttttgatggggttgtttttttcttgtaaatttgtttgagttctttgtagattctggatattagccctttgccagatgagtagattgcaaaaattttcttccattctgtaggttgcctttcactctgatggtagtttcttttgctgtgcagaagctctttagtttaattagatcccatttgtcaattttggcttttgttgccattggtttagtgttttagacatgaagtccttgcccatgcctatgtcctgtgaattgttttggctgcatgttgtaaataaactttatggaagaaagaacagaaagaggatagttaggaagttgttaacggtaatctgggccaaaaatgatgatgagaattagtcgatctgttggattttttaaaaaagtagagccaatagtatttgctgagggtttagatgtagagtgtgagataaaagagaggaaccaagggtgattccaaaattttgggcctgagcagctggaaagatgaaattgccatcaaccgacatgtagtagattgtgaagcaggtttggggcaaaggtgttttaacgatgaggagttcagtttggacatgttatacgtgagatagccactagatgtcaaagagaaaatgtcaagcagacagttggatatatatgttgctataggtactcttttttttaaaaaatttatattctttttctaagaagttttagagcaggaattctgcagtatacctccttatgtgtacactttctagtaaagtgccatattcttactggagtcctagagagaaagatctgggctgaaggtgtaaatttgggagttcttgggagttcttaaagccaagagactagatcagatcactaatgaagtgggtgtagataaaaaggagaataaaaggattgagctatagggtccccgaataataagaggtaggggagaaaaggaagataagcaaggaagagtacggtgaagtgtaagccaagtgcagaaagaatattaagtgggaaagtaatcaacggagccacattctgctgatgcctcaagtacaatcattactaaggattgatcattgaatttagcactgtgcagtcattggtgatcttgataggaacagtttctgtgtagtgatggggtgaaagtctcacaatattggatttaatagggaatgagagaagtagaagtggaaatgatgggtggaaccagctctttcaaggaaatgtgtttgaaaaggaaagcacaaagtgagcagaaactggcaagaaacttaggatcctttttagcttggatttttacagaagcagacaatgagacaggatttcagtgaaataattctatttgggaaagtgtaggtaacactgttaggggagttgatacaaggacgagaaggcagccatttaaaggtccaggctttaattgacacataatctctgaaattttctttaactattaaccctgtcagttgtcagttgatgtgtcccatggactatgtctccaaaacctacccattcttagtagagaacctatccatttttgctagagatggggtttcgccatgcctgtctcgcactcctgacctcaagagatctgcctgttttgacgtcccaaagttctgggattacaaagtactgtgtcatccagtgtggcttgattaatatgaaaatgtttatagagataagacaacagaatacttaagaaaatagctagtgtgaagcatacacaaataaatcaggaagggagctgtgttttttttttttttttggttttgtttttttgttttttttgtttttttttttgtttttttttttttgagacagtctgactctgttgcaggggctggaatgcagtggcacgatctcagctcactgaagcctctgccacctgggttcaagtgatcctcccacctcagcctcccaagtggttgggattataggcatgcaccaccacacccagctactttttgtatttttagtagagatggggtttcgccatgcctgtcttgaactcctgagctcgagtgatctgccttcttcgacctcccaaagtgctgggactacagacatgagccaccgtgcctggccaaggacgggaaattttttgtgagaacatcctagagtacaacttctaaaagtgatgtcgggttatcaagtgcttaggtgtgacagtgacaacaagacttatattcaaaattgttggaaaaatccagaaaatgtttaatgaagaaatcagcttgcagtaaaggttccacatgcttttgtttgtcacagagtggaagtggccttcataattgtataatgatgaaaagacttcttaatccacagctttatttactgcatttttcattttctggaagtagttttattttcctctaagctcctgtgtccttttgtttttaaatgaatatgacacatgctacaatttgaatatgtcccctccaaaattcatgttgaaacctaatccccattgcggtagtattaagaggtggggctttttggtgtgtgattaagtcaggatggctctgctgtcatgagtggattagtgccttacaaaaagtgctggagggagctagctgggtcctttttgccttccatccttccaccatgtgaggacacagcattcttcccctctggaggacatagcaaacaaggcaccatctggaagcagagcgtagctctcagcagacaccaaagctgccagcaccttgattttgaaattcctagtttccagaactgttagaaataaatttccattgtttattaattacatatatgctgttttttataggtactctttttttttctaaaaaaatttatattctttttctaagaagttttagaggaggaattctgcaacatatctcctgtgtgtatactttctagtaaaggggcatatattaaatgcttgataaatatttgtggatgaataaatacgattttcatcacactttccttaaaagtgtgaatctgtttcttgactttgtttttagtatattaaccaaattatttaaattgtgtactatacgtaattattattctccttctagtggtgactcataacatgctgtgcttgatgtcctctatttgtctctccacatctaccttttatttttttccatcctgtttccatgccctctggcttccaggtaggctgagccagtggtggtagatctgatggtgggagatgagtggggttgtggtattttattccaccaactttctccctgctggataaccttgggttagttgtgttgctttattgaaggctgaactgtcaggtgtcctcatatagctattttctaggaattctggaaacactccctcctcttgcttttttaaggccaaggggtggtaaagtcttcctgttgtggtaggtctcaggatattgccctggtcatacctttataaatagcctttattagatactttataattgttttgatcatattatttatttcctgtcagcaccctggctgatatagtagctactattggctttttagagattcaaatataacttttgaccaaaatgatccttcatatgttcttattctggaagttgagaggaagaagtgtcttgtgggaggatttcacactttattagtggataaaaatgttggcagaagtataaacatttcagaatagcatggaattaggtccttcagtccatttctatgcttatttttgaatttttaaattttaatgtcacatggtcatctttaatgttgcattttctcttaatgtgaaagattaatatatttatcatctttcaagagtagctgttccagttttttaataagcagaacccttatttatgtatttcttcttatttattcaagaaaacctttttgttggatattcttttaaatttctttttgaattatgctaactcagactcaacttttttttggttattatgctatcaacgtagaagtaatcattgtcttactagcaaaatacctccaaagtgtatttgatgggaggatatttatttttttaaaagcccatttgctgtattcctttaagttttctctttaaaatcatgttaatttaaaaaaattgttgatttttttcaacttctccattattctgaaatccagaaattcttattgtatatttgtttttaaaaatagctttatcacatatacatgtgcatgtcatctggtttgcttatttttgacctttataaaaaggttgtatttatgccattttctcaggctttctttgattttgtttatcacgattattaccaagattcatccatgtcattatatattgctgcagttaacttctttatatttctgtattttatttgttgtataactctaccacaatttatttacctatttccctgcttttgagcttttggatttggtatctagtaaaatttacccacagtagccattttgagacatatcctgataaactattgcattttaagagataaagaaaaaaatccttaggattttccagcagaaagatgaaatatcttacaagggcaagagattagactagtatcagatttttcaaaagcaacctacagatcaaggcaaccatggaacaaaattttcaagacacttcagaaagtatagaccaagggttttatgtcttgccaaattgtacctcaagtgtcaaggctatcaaaaataattttgaacatagaaaaactaagttaatactgtatgtgtgtgcccttacctgagaaatttatatactagggtagaggtttgcagatgttttttggtaagggttcagatagtaaatagtttaggctttgtatcctactaaattctgttgactctgttgtcactactcagttcttccattgaaactgtatacaaacagtataaattgcataaaagggtgaatgtggctatgtccaataaaacctgatttacaaaaacaattggtggagttaatgggctgtaattttccaatccctgtcctggagaatgagcttcacctaatgaacagataaatgggaacacttcaggtaaaagattgatggaaaacatttcccatacttaattttagagctaagactaaaataaaggtaggaatatgtgtagacaactaaatgtgcaaatgttacatgttttgtccaagtagaaataatgcagttaaaaatgggagaagggagaggaaaggggaaatcagagataagaacattgacagctgcatatgtaatagataggaatcaaaagatgccatttaacacttgatattccatcaaggtctattggacccaattttaatttttagtttgttttctgagcaggcctaactatttgcgaagactattattttatacattttattctttcttagaagtctttcaaagaacaaagagaacatttacttgttaaaaaaaatcagaataaaatattctgtctgtgattaccagatgggtctgttgcattcttttaaaaatgaaagatacactgtggaatttaaatgttgttattttctgtgttctaaagcattttgctatttatcattttaggaactaattcattacttatcaattatttccaactatgctaaaaattaacaataaaacagaagttttttagaaagatgatgccacagtgaaaaaaactgtcatcctttagttgtattattgcggtgcccgaagtattttattacctttaaagaaggcatacaagaagacaaagtaccatcattgtagtccgcttttagtttttgttgaacacagttgagaatttaaaatttttcattttctgcccatactagtaaaaagttgaaagatctttcgcagtaattagacaaataagaagatgaatgcaaagagacagataagaatgcaaagagacagatggtaaccctgtaaactctggtgagtttacactaaatctcagactatggatcttcaggaaatgatatcctaaatgaattttttcaaactcttagattcagtgagtgaacaatacatttttattttttattatgtttatatgccccaacactttaaaacaaagaggtttgctatatttaaattctttttggaatttgcaaaaggtagtttttgactgacacttttttcttgtgtaaattacttatgatgtgataaagcaactaaaaggaactattgaatcatgataaatgctgattactattgttctaggtatactgaggattaaaactgacagaacagataataaaattaggtaagaaagatgagaattaagggcactatgaaagatacatacacaaaggaaaacactaacaaagatataaacgttcttacctaccaaaagaaataaaagcaaagaaatatcaaataggaaaaaactcagaaatatgcattataatacatacacacagtaattatgacataaaattctgtgacagagttgagattcaccataatatcagtacatgggaatgggattaacttgtttattaaaagaaaacatttcaacttgctgcataaaacaaaacccaaatctatgcttgatttaggagacatttacaacatattgatgcagaaacgatgaaaataaaggaacagagaaagatttcataggtgaatgattacagtaagacagggaatatcaaaacattatacaagaataccttataattactaaaacccacaattcaccacaatgatatgatatatattagaagaatattatctatacaccagacaacccagcaaccacctatagaaaacagaaaccacaggcagtgaagagaaacagtgtcacttcagtacaaaacaggtcagtcattattgtcaatacacgataggataaaaaataagaaaatatctaaaaaaatctaaacaacataactaataaagttgaagttaaggatgtatagcgaacaatacagcccgattatagagaatgttgtcttctcaaatgcacatggaaaacccacaaaaattgactgaatatatatataaaaaattagtagtttcccaagaatggaagcattgaaaataaacacctgaatattaaataaaatctttctattgggtgaatggggaaatacaaggaaaaattacagaatttctgaaaaatagtgacagtaaaagcaacacatataaagatttatgggatacatttagagcagttatcagaagtatatttataacattaaacaactctattaatatgaatgaaaataaatgcaccacattcccaattcaaaaagctagaaaaagaatagctaaaccaacaagtaaagatttttgcataactttttatataactaggaggagaataaaaataaaagctgaaattaatgatgtaagaacagaaaaacagattaatttttttgaaaaaaacagagaagccagcagctcatttaatcaagaaacaagagagcaagcacaaatacacaaaacaagaaatgacaagggagaaataatattgataggatattaaaatagtagactatcttgtacaacaatgcaattaaatttgaaaatgttgaagaaatgaattatttcatagaaagtagcaatttttcaaattgaacccagtaaatataaaaaatttgtataaagcactttccttagaaaaagtggagaaagcaccaggcctagatgataccagagagtaaatttagcaaaatcttaatagctggatagtctcaatgctatgtaggttgttttagagaatgataaaggaaggaaacttccaaatttgttttataagggaagtataacattgccacttaaacccactacacagaaatggaaaatttacatatgtatatgattaaaaatgaaataaaacctttccccgttaaatatcaacacaaaattctaaataaaatgaacactccaacacattcttttcttaatgtgtgttgagttttattaatatattttataataagcatccttggatgcctgggtatacatcccatttaataataaaatacacattaatagataattaagtataattaagtgggatatatagccaagcatctaaggatgactattatgaaatatattaataaaactcactatattagtaggtcaaaggagaaaaatgatattattttcattggtattaaaaaaatcacatttctaataacgcttgagaaaatgggaatggatggctactgtatgaacataataaatatgtttcaatcccaaagccagcatcttatacttaataagggaaataagcatttctattcacttcaagaacaaaacaagcgtgcacactatctccagtgcaagattatatatatatatacacacacataaacacacacacaactatgtatataactatatatacacaactatgtataactatatatatatatacacacaactatataactatgaagtagtaatatatatacatgtactactttttgtgtaagggaagtaaaatatagttacacatgctaatttgagcaaaaatgaacacaggaaagataaaccagaaaacaagtatgttggttatttacaaggggtggtagagaatggtatggtaaagatatgacatgaaagtatatttacctgtgtttactcttttaaaaaaatagtcttgacttagaaacattgatttttagaatcatattaatcatttacatattgaacaattaaataaaaaaggaaaggaagaaaaaaatcataaaacaatgtaagctgaaacaaatgaacccaactatgtttcaaatgaataggataatcattctgaaacgggatgaaaagaactaatgcaagtgatttttgaacacagtatttgactatgtgctctcagtcgaggtttagatgcgaagaaggactgcaaacaaatctttgaggtttgttttttgaaggtttaggtgaagcaattctgaaattattttagatatatgtttagactaaaaaataagtaaatatatttttttgggaaccaaagttcttcatgtggaagacgagaactgcagctatgaaatggggaagtcaaggaagaatcctggcctggatggattgcaattggaggtatcagtatgagtttatggttacttagataaatagatacatggatatgtagatacataaataaataagttaatacatagatgtagattcttctgaaagggcccagaagctaagacaccccagtagtagtgagcacactgagcactcgtattcccagatctggtttgtaatatttcctatggaaagaaagcagggctccttggaggagctgattctatgactgtgacaaggaaagtaaagataagccaagtacatcttgttatatcaaattaaggaagcactcaagaaaacgatgggtcatgtcaaaagaacacaggaatcaccttctaggggatcccattggtaaaacatgggacaatttgagcattaaaataatttaagaaagaaatacattaaaaactattgaaaaaataggaatgcataagcttacactgagagtagacagacaggtacaaatacagaagaagggaagcctctacataggatgcagactgtcatagctggagttgaaaaatcattttgcaaaagtcatagtaaaagttgggatgggaaagaatcatcaatggatgttaaatctgtgggggtgggtatgaaatttttttatgagatatgcacggcatttaagtctcccctacagattgctgataaggtgcgggagaaaaatcgtaactacatagtagagaaacctgtcaataacttgtctgagtgatcaaaattaacatcacaaactaaggggaattggacactgtgtgcctttgtatataatacctacagaaagagacattacgtgtggtagagttctgcaaaccagttctgtaaaagttgaaatagtaaatattttgggctttgtggactatacagtctctgtctcatctattcagttttgccaattctgccattatagggtgaaagcaagccatagataagtaactgagtgaacagaatgaagagacattttatggaaagggggaaaatattcacaaattatacatctgataagagattaatatccaaaatgtataaacaacaacttaaaacaacccgattaaaaaatgggcaaaggatctaagtagacatttctcaaagaagacatacaaatgataagaaacactggcgaggatgtggagaaaagggagccctcatacattattggtgggaatgtaaattagtacaaccatgatggagaacagttcggaggttcctcaaaaaaactaaaaatagagttaccaaatgacccagcaatcacattgctagatacatacccaaaagaaagaagatcattatagcgaagagatatctacactcccatgtttgttgcagtactattcatcatagccaagatttggaagcaatctaagtgtccatcaacaggaatggataaagaaaaaatggtccatatatacaatggagtaccattcagccataaaaaagaatgcaaccctgtcatttgcaccattgatggaactggaaatcattaagtgaaataagccaggcacagaaagaaaactgcatgttctcacttatttgtgggagctaaaaataaaaacaaactcatggagatagaaaaatgatggttactagaggctgggaagggtcgttggtggggatgtgaggatgattaatgggtgcagaaagtatatatacaatgagtaaaatcctctatttgacagcacaacagtgactatagtgaacaacagtttattttacattttaaaataatacagtagaattggattatttgtgtcaaagaaatgaatagatgtttgatgtgattattatgcattgtgtgcttgtttcaaaatatctcatgtaacccataaatatatacatctatgtgaccacaaaaattaaaaataaaaaaatttataaagcaaaacataaaaatggccaacagatgtatgaaaacatgctcaatattactagtcatcagggaaatgcaaattaaaactacaatgatctatgatctctcccctcacacctgttagaatggctgtaaaaaagacaaaagataacaagtattggtgaggatgtggaaaagagggagtacttgtacactgtttctgggaatatttttttttttttttaacaaaaatgagcagcagagtaggtatgaccccacaggacatagcttacccacccctaccttacagtattgtgactagaaatgcctaacctgaagctaatcatgaagcaatatcagacaaacttcaaataaagaatatgccatctaaaaagagggatggatagctttattcttcaaaaatatccatgttatgggagacagagaaaggttgaaaaattgttccagattaaaggaagcttacaagacatgacagctggttgttgaccactggtgcacaacatggtgacaacaaatgcatgagaactggtgatcccagactggattctatgctggatgaaaaattaaaaaatgctatgaaggacattatgtactcagttcacaaaatttaaatgtatagatacattaaagtattgtacaaatgttaaatttcttaaagttgataattgcaatatggttatgtataatagaaagagggtgcttggttttttttttttttttttttcttttttctttttttttttgagatggagtctccctctgtagcccaggctggagtgatctcggctcactgcaacctccacttcccgggttcaagtgattctcctgcctcagcctcctgagtagctgggactacaggtgcgcgccagcatgcctggttaattttttaatttttagtagagatggggtttcaccatgttaaccaggatggtcttgatctcctgatctcatgatccacccacctcggtctcccaaagtgctgggattataggcgtgagccaccgcacccagctggttcttaagaaatacacaccaaagtattaaggacagtaagaatgatgtatacaactgggagagagggagggggagggggagggggagagggagaaagggggagggagaaagggagaggaagggagagagagagggagaaagaattaatgataaacgggaaaaatattgacaattagggaatctgaatgacaggtatatgtgtatggggagttctttggctattgcacttttgaaattatttgcaaataaatgtgaaaatagaagaagtagataaatgttttttcatatttggttatgtggaatatatgtttaactgaagattttaagaattcccttgaacttgctgtggcagtaaaggaaatgtcagtttgtccttttttgttatacttagaattacggcttttagggaatctacaaatctcagaggggaattatgtggatggttttactaacttggaccataaagctcttctgggttagtcctgtgggaaatttatttcactttagtttagcaatacctcataaactttctaagaatctcaatgtgagtctcaaggtgagtataatattaatgttttgctttagtatttttcatgctttaagaattttggaggtgtagttgggaagccataattaatgtcatttaatgttaacttttttccttttgatctaaaaatcattagattttttcagaaaggtatttttttaatataaatttattgatactatgagtttctcctctgctcttaatatcacatgtttttaaaaattctgtggtgaattttaagtgtaaattggacattgatttttagcacactggtgtctgaaaatagatccataaaacagatgtattaagtggtgggaattagggatttttaataggagaaatctccagtttagaaacaattcaatcataggaatcacagaaagcaaaattttattatgtgttgcaattaggcttggcatttgtggtagagtttcatttgtgcagacctttttaggaataattaagtaaaatgaaacagtatcaatataatgagtaaaatacagttatgccatgcacaatatttcaattaatcacagactgaatatatgatggaggtctcataagattattctggaactgaaaaattcctatccctggagatgatgtagctgtcaaaatgtcatagtgcaatgcattgctcatgtgtttgtggtgatgctggtgtaaacaaacctacttcactgccagtcgtacagaagtatggcacatacaattatatatagtacataatatttgatgctgataataaacaactatgttagtgatttatgtgtttactatactttttattattttagaatatactttttctacttacaagaaaaaaaaactgtaaaatagccttaggcaggaggtattccagaagaaggcattattatcataggagatgagagctccatgcatatgaatgcccctgaagaccttccagtgggacaagatgtggaggtggaagacagtgatactgatgatcctgactttgtgtaggcctaggctaatgtgtgtgtttgtgtttttgtttttagcaaaaaattttaaaaaataaaaagtgaaaaaataggaaaaagcttatataataaggatttaaggaaaaaatttttatagctgtaaaatatgtttgtgttttaggctgttattacagaaggatcaaaaagttaaaaaattaaaaagtttataagtaaaaatttatagtgggctaaggttaatttattattgaaggaagaaaaatattttaaaaaatttagtgttgactaagtatacagtgcttataaattctacagtagtatacagtaatgtcctaggccttcacattcactcaccacttacccactgactcatccagagcaacttccagtcctgcaagcttcattcatggtaagtgtcctatacaggtataccattttttattttttacaccacacttttaccataccttttctatatgtttagatacacaaataccgttgtgttctaattacctacagtattcagtacaacaacatgctgtacgggtttttcgttcaggagcaataggctgtgtcacacagcctaggtatgtagtaggctataccatttaggtttgtagaagtatactctatgatgttcacacagtgatgaaattgcctaacagtgcatttctcagaatgtatcctcattgttaaggaacacacgactttatcattttagcaaactgctttgccattgtgacaaatgctactgttaaaattgtatacgttttttttacttactaaatgtttttagttttgctaagtgaattattaaaccatatgcttttaagctatttaggaactacaaaaatattatacatatccttgaaaatttgcactgactatattaaaaagttttagtagatgtgcattcatattcagaaaattcttatttttctgtatctgcttaacattctttcactgatggatatatcagtgccttaaaaggcagccattctattactttatatattttaaacattttatttatttggaagaaatacgcactccctataatttgtacttataacattttttatttttgattattatgggcacataatagttgtatatgtttatgagatacatgtgatgttttgatacagtcatacaatgtgtaatgatcaaatcagggtaattgggacatccatcacttcaagcctttattattttttgtgttaggaacatttcagttctacttgtttagttatttattgcttttgcatcaacctaataaaaatatacaataaattattaactgtagtcaccctattttgctaccaaatattcattctatctgtatttttgtacccattaaccagcctcactttatcccctgctctctgctacctttcctagcctctagcaactatcattccactctttatagtccataaattcaacaatttttgtcttccacatgtaagtgagaatacgtgatatttgtctttctgtgcctggcttatttcacttaacattgcccttcagtttcatccgtgttgttgcagatgacaggatttcattcttttttaatggctaaataatgttctgttgtgtatatgcatagaattttcttctcattcatctgttgatggacacttaggttgctttcgtagcttggctattgtgaatagtgctgcaataaacatgggaacgcagatatctctttgatatacagattttctttcttttggatatatgtccagcagtggtattgctggatcatgtggtagttctatttttagttttttaggaactccaaactattcttcatagtggttgtactaatttatgttctcaccggcagtgtatgaggattctcctttctccacatcctcatcagcattattgcctgtcttttggataaaagccattttaactggagtgagattgtatctcattataattttgattgtatttatctgatgattagtaagtattttttcatatacctgtttgccatttttatgttgatatgattaggctttgtgtccccacccaaatctcaattgaattgtaatccccatactctccacaatccccacgtatcaaggaatagaccaggtagaggtaattacatcatgggagcagcttcccccatgctgttctcattatagtgagtgagttctcatgagatctgatggttttataagtatttcatagttcctcctgtgttcattatcctccctgccaccctttgtagaaggtgccttccttccccttccccttccgccatgattgcaagttccctgaggcctcctcagccatgctgaactgtgagtcaattaaacccctttcctttataaattactcagtcttgggcagttctttatagcagtgtgaaaacgggctaataacatatgttgtcttttgagaaaagttctattcagatcttttgcccatttaaaaataagatctttttttccctattgagttgtttgacaactttgtatattctggttattaatcccttgtcagagggtactttgaaaatattttctctcattctgtgggttgtctcttcactgtgttgattgtttcctttgctgtgcagaagatttttttagcttgatgtgatgcctttgcccattttttgctttggttacctgtgcttttgaggtcctactcaagaaatctgcccagaccaatgtcctggagtgtttctccagtgttttcttctagtattttcatagtttcatgtgttagatgtaagtctttaatccattttgattttattttcgtatatggtgagaggtaggggtctagtttcattcttctgcctatggatatccagttttcccagaatcatttattgaagagactgtcctttccccaatgtatgttcttggcacccttgtaaaaaacgagttgactgtaaatgtgtgaatttatttctggagtctctattctgttgcattggtctatatttctgtttttatgccagtacaatgctgttttgactattatggctttgtaatataatttcaagtctggtaatgtgatgcctcctgttttgttctttttgctcaggatggctttggctattctgggtcttttgtggtttcatataaattttaggatcattctttctgtgaagaatgtcattagtattttgataggcattatgtttaatctatagaacctttgggtagtttggacattttaacaatatttttccaaatccgtttttttgtgtattctcttcaatttctttcatcagtgtcttataatttcaattgtagagatctttcacttctttggttaagttaattcccagacattttatttcacttgtagctattttaaatgggattacttttttttggtttctttttcagattgtgcactgttgccatgtaggaatgctactgtttttttgtatcttgattttgtatccctgcaacattactggatatgtttatcggttccagtagtttttggagtctttaggttttctaaatataagatcatataatctataaacaaggaaaaacttgatttctttctttctatttaggatgtcctttatttctttctcttgtctaattgctgtagctaggacttccagtactgccttgaatacaagtggtgaaaggatcctgtctttttctagatattagaggaaaggctttcagtttttccccatttattatgatactagctgtgggtttgttgtatgtggcttttaaactattgaagtatgtttcttctgtacccagttttttagtttttatagtgaaaggattttgaattattgaatgcattttggcatcaattgaaatggccgtatgatttttctcttcattctgttgacaccatcaggtactaggcttttgtttgatgggagacatttcatcagtgcatccatcttgctatgtgttattgacctactcaggttttgaatttctccatggtttaatcttggtatgttgcaagtaatgtatctgtttcttctgttttacagtgtattggcactttgtctcctaatagtctctaatgattctttgattttctgtggtatcccttgtaatgtctcctttttcatctctgattttatttatttaggtcttctttcttttttctttgtctgatttaagatttgtctatattttcatcttttcaaaaataaacttcatttcattgaccttttgtattttttattattgatttaatttctgctctgatctttattattttatttcttctactaattttgggtttggtttgctcttctctttgtgttctttaagatgtgccattaggttgtttatttgaagcttttctatttttttaatgtaaggatttattactgtaaacttccctcttagtactgcttttgctgtattctttaggttttgatctgtttgtctccattttcgtttgtttctggaaattttaaaattttcttctgaatttcttcattgaccgaagtggtttttttagaagcatttccatgagtttgtatagttttcaaagttcctcctgctattgatttctagttttattctgttgtggtcagatgagatacttgatacttgatatgattttaattgttttgaatttttgagacatgttttgtgtcctaatgaattgtctatcttggagagcattctatgtgctgaggagaagaatgtgtattgtgcagctattagatgaaatggtctgtaaatgtctatttggtctgtagtgcagattaaggtctgatctgatgtttctttgttgattttctgtctggatgatctgtccaatcctaaaaatgtgctgttgaagtcccaagatattattgttttggggtcttctctctttttagatctaataatgtttgcattatatttttggtgctccagtggtacatatagatttacaattgttctatcatcttgctgaagagactcctttatcattatgtaataaccttgtctctttttgcagtttttttctcttgaaacctatttatgtgatacaagtatagctactccttcttgctttttttttgtttgtttgttgccattggcatggaatatcttttttcatccctttattttaggtctgtgtgtctttatgggtgaagtgtttcttctaggcagcatgtagtggggtcttattttttatccattcttctatgtcttttgtttggagaatttagtccgtttacattcaatattattattgattcgtaagaacttattactgccattttgttgtttgttttctggtcattttgttggtctttcttttttccttctgaattcctttgtataaaagtgatttttttttctggtagtatattttaatttcttgctttttattttttgtatatctgttttaggtttttgttttgtggttaccatgaggtttgcaaataaaatcttataaccagttattttaagctgatgacaaattaattttgattacaaggaaaagaaaaaaaacaaaacaaataagcaaataaaaaactaaaaaagctctatacattctttttggctttggactttttattgtctatatttatatctttttatacagtctacctgaaaaagttgtggtagtttttagttttgattggtttgttttttagtttttctactacagatatgagtgctttatgtatttcagttatagtattaagcgtattctctgtatgtttgtatatttactattgccagtgagttttatacctttagatgatttcctgttgtttgttaatatcctcttgtttcacattgaagaactccctttaacatttcttataagacagacatgttgttgatgaaatcctttggtttttatttttctgagaaagtatttctcctttatgtttgaaggataattttgctggatatatataactttctaggttggatgttttctttccttcagcactttgaaaatgtcatctcgctctcctggactgcaagtttcctactgagaagtctgctgccagatatgtcagggattctttataagttgtgtgcctcttttctctgctgcttttggatctgttccttatccttgacctttgagagtctgaatattatataccttgaagtaggtatatactcaaataagtatttgagtatatttgaggtatctgttggtgttttataacctcgtatctggatatttatatctttctacaagtttggaaagttctcagttattatttctttgaataaactttctagctcaatctttatttctacatactaattaaggccagtaactctttaggataacttttcatcttctttataaaccagaggttgtaaattttgatgaattaccacttattattattttaaaaaatgtctgtactttttgtattctatctaaaagacctttgccaagctcaaggtcacatttttctcatgcgttttctaggagatgttttataattttggcttttgtcctcagatatttgtgatccatttgagtgaattttcatatattgtgcgaagtaagggctgagatttttataaaaataggctgcgtccagtggctcacacctataatcccagatgctcaggagcctgaggtagggagactgctggagcccaagagttcaaggctacagtgaactatgattgtgccactgcactacagcctgtcatttagagacaggcaaaaccctgtgcctgaatgaatgaatgaatgaatgaataaatatccaattgttccagctttttccattgaattaccatggtatctgtgtagaaaaatcaattggccatatatgtgtgagccgatttttgtactctattctggtccattgatgtatattatggttattctagtatcacactctattgattactgtagctctctaaatctggcggtgtaagtcttccatctttttttccattttaaaaagttttgagctattctaggtccttcatattgcaatataaaatttagaatcaacttgtcaatttttgaaagaaggctgcaaagattttaattggggttgcattggatctagagaggggaaaattgagtctttaacaatatggagtcttgtaatgcatggacatggtatatcacttctttatttaggtctcttttgtttcagcagtattttatatttttcaatatactggtgttgtacatagtttgctaaattcctaaatatttcatatttttaatattactaaatggtatttaaaaaatttaaatttataacagctgattgctagtctatgtaaaaattcattttcaaatatgggtttggtcatgcaacgttgctaaacacacttattaatatctgtagcccattggtcaacaacttattttctatatagatgctcatgtggtgtggtaataaacattgttttactctttctttttcagtgtgtatgccttttactaattttctttgtcttgtatttttaggatcattagtacactactgagtagaagtagtgacagcagatattcctgccttttcccttattttagcagggaaatatgcagtcttagcaatgtgtttaacatgacttttatcaggttgaggaaatttacttttatttctagtttgtttagtttttttcatgaacagtgttaaatttcctcgaaatagtttttttttccacatcttttgagaaaaacttttgttttttcattttctgattttttaatatggtgaatggtattgattgacttttacatgttaaactgcaattgcattcttggataaagcttacttggtcataatatattatccttttcatatattgctgaatttcatttgctaaaatcttaaagacttctatgtctatattcataagagatattagagtatgtatttttcttgtaatatctttatatggttttgtaatctggctaatgttaaatgatttaaagcatgtttcatcttttttaagagtttatgtagaattgatattatttctgtcttaaatggttgatagaatttgatcagggaaactatctgttccaggactttgtgagaatgattttaattatgtatgtattttctttactagatatagagatatccaggttcaaattgtaacaaatgacagggttttctccctttttaaggtcaaataagattacactgtgtatatacagttgtccctcagtatatatgggggattgattccaggaccccataccaaagccagtgcagtcggcctggggaatccatatgtaggaaaaattggccctctctgtataggaaaagttggctccccctaaacacaagttttgcatcctgcaaatatggtattttctatttgcatttggttgaaagaatctatatataagtgagcccgcacgtaagtggactcataaagttcaaacccatgttattcaagcatcatcaatatgccacatgtttttcatctattcactccattggatggacacttaggttgatgagcccttaggttgattccatatcttggctattgagactaatgttacaatgaacatggaaatgcagatatctttttgacatgctgatttcatattctttagatgtatacccaatagtgaaattgctgggccatacggtagttctacttttaatttttaggaggcttcatattgttttccataatgggcgtacttcttcccaccaacagggtacaaggattcccttttctccacattcttgccaacacttgttatcttttgtctttctgataataacgattctaacagatgtgaaatgatatatcattttggttttaatttgcatttttctgatggtgagtaatgttgaacattttttcatatacctgttgggcatttgtgtatcttcttttgagaaatgtccactcatgtcctttgcccatgttttagtttggttatttgttttcttgctgttaagttctttgagttccttatatattttcatattaaccctttaacagatatatcatttgcaagtgtattttcccatttcataggttatatcttcagtttgttgattatctccttgctatgcagaagcttgtttgatgtaatatcatttgtctacttttgcttttgttacctgtgcttttggcatcatatccaataaatctttacccaatgaatgtcattaacttctcgactatgtttttttctagtagttttaccatttcgtgtcttatctttaagtctttaatccatttttagttgatttttatatatgatgtgaaatgagggtctaattttattcttctgcatgtggatatccagttttcctagaatcattaattgaagagactgtctttttcctgttatgtgtttaggcatcttcatcaaaagttaattgactataaatgtgtgaatttattttcaggtcccctgttctgtttcactggtcttgtgttagtaccatgcctgtacaatgttgttttcattactacagttttgtagtagattttgcaatcaactaatgggaggcctctggatttgttctttttgcttaaggttgccttagctctttggggctttttgtggtttcatactgattttaggatttttaaaaaattttttgtgaaaaatgtcattgagagtgtggtagggattgctctgaatctgtagatcactgtgggaagtatggatattataacaatattaatttttccagtctgtgaatgtgggatctttccatttatttgtgtctttttcaatttatttcatcaatgttttatagttttcattgtacagatctttcacctcattggttacatttatttatttatttcaagtattttcagtttttttaatgagcaataaaagaaaatgtttcggctgggtgcagtggctcctgtaatcccagcactttggaggccaagatgggcggatcacaaggtcaagagatcgagaccttccaggccaacatggtgaaaccccatctctactaaaaatacaaaaattagctggcgtagtggcacgtgcctttagtcccagctacttgggaggctgaggcaggagaatagcttgaacttgggcggtgggggttgcagtgagctgagattgcaccactgcacttcagcctggcgacagagcaagatttcatctaaaaaaaaaaattcaatagttaagcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagatcaccactctattttggatctcactgagtttctgtttaccttacaagtaatcagggtaattcattatgaaatatagtatttcacttaaaatactacggaagcaaaaactactataaaagtaaaaaataaaaatgactcaaatataacaagagttcttcattaggccatgatggagtaatttggaaagcatttcctgccataaacaactcaaaaaccagaaaaaatatatgaaaaatgcttcacagatgttggataacaagcagaagtaaaatatttatttctctttaaagaaagagaaatatttatttcgcactaaaaagtttatttctttctctttacttcctacatcttgtgtcatggccagggtattgcctacaagcagtatgctctggcaatcatagagcctacacttgtttctgtttcttttagagtcatagtcctatgctgtcacaggatcacagtgtaatgctgcttggtatctagtatccataaagcattttttattttgtttttttttttttctggtttctgagttgtttgtggcaggaagtgttttctaaattactccatcatggcctaatgaagaattcttggtatatttgagtaatttttgctatttacttttgcagtattatcctgagttagttcatgtattcatgcatctgttttcaccactgtcttttctcattaatgacctacttttgaaccagtggtttacttttttataaattgagaatatgataaagcacactaccaaattgaaaaaaaattcacgcatatgcaaataacaacagaggataagaacatatgttttctgaggtgatctatatgttgttatcttgcatgtttattgagaccagttggttccttagagcatatatacatttccaaatgcaaaacataagaagaatataatgagaatgtgactcaaattaatcttgcttttcaaatttgtctcctgtgtgggaagacaattgtttccttttaatttttcacctgaaactactataccacttatgaattccttgcctgaactgctagtgactgaacctagagaaacattgaggtagtacaagaatgcacattttggtgttagacctgtgtcttcgctcttacaattccaaagtttttttaaaaaagtttatcaagtagttaagtgaaatactgtatttcataatgaattatgccgattactggtagctgatcactagtagtgaacattatatttttaaaataaactttttattttgagataaatgtagttacaggtatataattgtaagaaataatgaaagtgattctgtataccctttacacagttttctctcatagaaacatcttgcacaaatgtgtaacatcctaagtctagatactgacatggatataatcctatgatcttacttagaaattcccagttttatttgtatttgtttgtgtgtgtgtgtgcctatttcattctgtgcagttttatcacacatgttgatatatctcccaccacagttaagatacagagtagttcttcaccccaaagatccttctcattgcccctttaaccacacatacctcctttctaccctggctcctcacaaccaccagtttgttctccattttataattttgtgattccaagaatgttttatatatggatcatttacatttaaggtaattttgatatattagtgactaagtctgctgttttattatttgttttctgtttttttccttttcttgtgcctctttttctctttacttgcttcctgtgggttatgtgaataatttttaggattcctttttgatgcacttgtatagtgttcttaatagtatctctttgtaaaattttgatagtatcttctgtataattttcttagtggttggtctgtgtgttaaaatatatatatttgacttatcacagtctactggcaccagtaatttaccacctcaggtgagatgtggaaaccttgctttcatttacgtcactttagctttacttttctcacttttaaatatcattatcttgagtatcggatggtgttataatttttttccatcatcatatattatttataaacattcatgagaaggataatctgttgtttgtattcatgtttctgctctatttgttgtcctgacttctttttttttttttttaattatactttaagttttagggtacatgtgcacattgtgcaggttagttacatatgtatacatgtgccatgctggtgcgctgcacccacttttctgatgctccaagcttccttcctttatctttctgtttgaagaagttcttttaaccattatttaaagagagacctgctaatgacaaattctttttttttttttaatttaagaattttttccctcttaattcctgaaggatagtttcactggaggtagaattcatactttacagttctttttctctccagcatttgaaaacagttgtgctacttcttttggacctccatggtttcagatgagaagtccattattattaaaattattgtttttctaggtaatttgtcatttcactctggctgctttcaaggtttttttccttgtctttagtttttagaagtttaattatgaggtgtcttggcatggatatctttgggtttaacctatttaagatttacttagtttcttgaatctgtaagtttatgtcttttacaaaatttggaagtatttggccatcatttcttttttttttattatactttaaattttagagtacatgtgcacaatgtgcaggtttgttacatatgtatacatgtgccatgttggtgtgctgtacccattaactcgtcatttaacattagttatatctcctaatgctatccctcccccctcccctcacccacaacagtccctggtgtgtgatgttccccttcctgtgtctatgtgttctcatcgttcaattcccacctatgagtttaaaaactctgtaagccccatttctttttcttctccttttgggattatggtgctacaaatgttggatcatttgttattgtcctaagggtctctgagactctgttcactgttttctctatttttcatattggataaattttatttatttttatttttaattttttgtttatttttataattttaacttttattttagattcagggggtgaatctcaatgcaggtttgttatgtggctgtattgcatgatgctgaggtttggagtatgattgatcttgtcacacaggtgtactgagctcagtacccaatagttattcaccccttgccccactccctctctcttgataaattttattgttctgtcctcaagtttaacaattctttcctttgtcatttccactccggttttgagcctatcccgttagtttttatttgttattgtagttttttttaaacttttttttttttgctgagatatttttgtttgtttcaagataatttgtaatagtagtgaggttgcagagaaaaaggaatgcttatacactgttggtgggagtgtaagttagttcaaccattgtggaagacactgtggtatttctcaaagacctaaagatggaaataccattcaactcagcaatcccattactaggtatatatccaaagaaatatattaataaattattctattataaagacacatgcacatgtatgttcattgccagcactattcacaatagcaaagaatcaatctaaatgcccatcaatgatagactgaataaagaaaatgtcgtacatatacaccgtggaatattatgcagccacgaaaaagaaagagataatgtcttttgcagggacatggttggagctgcaggccattatccttcacagattaacacaggaacagaaaaccaaatactgcgtgttctcacttataagtgggagctaaatgatgagaacacatggacacatagagggaaaaaatgcacactggggcctattggaggtgaattgtggaaggagggagaggatcaggaaagtaactaatgggtactaggcttaatacttgggtgatgaaataatctatacaacaaacccccgtgacatagatttaccaatgtaacaaacctgcacttgtaccccaaaacttataataaaagttaaaaatagttatagttacatgttggagtatttttatcatggctactttaaaattctttttagataattttaacatctgatccattcatctcagtgttagtattacttgattgtctcttctcattcaagtcgtgatttttcttgttgtcggtatgacagggagtttttgatcatatctttacattttgggtttcatagtgggagtctctgggttctattttaaatcttttatcttagcaggtagtcacctagtttgggttttgcattcaggtcttgtggtgagatctctctttgcagtcttaggccttgtggggaaggggagtgctttccctgcatatttactgtaagtagtatttggcaggtcccttttgctagggctgccagggtcatctggttttgtccattggactcgtgttcagtttggctaaggaataagcctacccaagtaaccttttgttctaaggatgggggttgagaagtgctgggcctcagtaaccttcttctgttgggtgagtgagtgtcatgagacacacattctccagtccctagccagtctgccttcgtctttacactttagattttttctttggttgtctcttacacagtttctaaggtctgtggggggagcagggaaaaatcagtctacactatcttgttccacttattaacttttaaacttttgatgtgttattcaatttttctagctttgaatttcctaatttgtaaagaagagatagcaataatataaccctccaaagattattattaaatgagataatgagatagttactgagaactgtgctctattagagaatgatgctgctgttgattgcaaggttgtttattgcaccattgtttctaagggcaaattgaaacccaaatgagtaacaaagtagagttatttaaataaattgtatattatcaacacaatgaaatttagctcttaaaaaagtaataaatgggacacagaatgatgccccaaatgtcttgttaagtgaaacagtagttgcaacatagtatttttagtacaaatatgtacacacacacacacacacacacacacacacacatatatataaacatatctatctaaaaaacatgtacatgtgttttatgtatacgaaaatattcagaactgtagtttgaaaatagtctgtatgtaacaaattgtgaaatgtacctctaggtagtgggctgggggaaagggtaacttttacattttatacctcttaattcaatattttttggtaaggatcaagtttatctttattaaaaggaaatgaataaaactatgaaaatcttttagttcaaatatatatatatatatatagttaagtggttaaagaatattaatcaaattatttctgataagttgtcttttacttcattttttggaaattacctccaaaatgtaatgcctgttagttacatatgagttccgcaaagtttcttaacatagattaagtaccagtggcttggatgacttttttggatatttctattttttatgatcattgtagaatcattttctttactaccttagaattttgtaaatgcaaagaatttttaagcattatcattttctattagttgatttgggtattttcaatgagctgactaggatgccacattttaggtggctggttagaggaatgatggagatgtgatctatatgcatatttaaaaacaaatgacagatttttatatagctgctttttataataaattttctaaggccaagaaattgtgggcttttcgtatgcatttcttaaaagcatcccttgcatatgattggtgtttttattagtgaaactgcattgggaaatgaatctattgtagatacagcaagcagagtgggattttaatatcggaaattagttacaaaagtgttagaaggactagagataccaaagggaagggatcacccagaaatccagaagtgctacatacctaggctggagcctatgatcacatttgccactgagcaactaaacataccagttttgctactgagcagggaatacctattaagccagcactgccattacttactgtaattgccttcctgttcctgctgctagaggcaaaatcagaatctttcctcttgccctttaatctcatactagtactcccattggtggaacctaatgtaacacaattgtcaagcgagtcttggaaattttattgtttaggttttcatcctctgcaatacaaaggactttataaaaaggaaagtggggcttataaccaacaaataaaggaccagcacagtactaaaaatgtgttcaattaattttagatttctaagggtagggatcatatcattttatctttataatgtcagtgactaactgtcacatagtaggctctcaaaatatttgttaaaaatttttttcagagctatttatgtaatataagaataaagttttcctttttctcttgcaaacacataaaatgttctttttagtatttcagagtttaacttcatctatggaaagaccagtgttactcaacttcaaacccagcacctaacctggcacatacttaataagtgtttcttgattaaattaatattagatatacaatgtttactcataaaaatatgtcattagaattaacttgttggtattttggtgatatattagttatatttaaaaatactacttgaaatttataatgtattttatttctgttacagcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggtgagtacacaaaataacacattttctatgttgccattattattgtaaatgattgactttaaaatggtttctgacatagaaatacttactttatatgcattcattgtaaatgctgatatcgtcttaatttcagatgagtaattttgtttaccagtatgacttcgatatcatctgttcagggatttgttcttctttgcactcatattttattgtcatctgtaaattttaaaaagcatttatttagtttcatcatctaacttcctgtgaaatacagagcttgtggcatttaggtaaattttcaccttttgttgttataaacaatgctacactgcacttcttgcactgatcttttcatgtacatatttaagagttgctctagggtgcatacttaaaagtgagatttttgtatctgagagtatttatatcctcaactttattacatgttgccgaagtgcttttcaagtcactgtggtaatgtgtatatacttccaccaacagggtatgtgtccctgatccttcatgttctcaccaacacttgaaaattgtgagaatttttacttttgccaaggtgatgggtgtgaatagtattttaatgtgcattttcctgattagtattgtaaacatcttcttatgtgttgatttcctattgtttcctgtttagtgaattgcctactcatatccataatattctctttatgtttgaaatattattaattaatttttcatttattggtttttttggttatagaagttttaaaataaaatttttgttctaatttttctttgtaaaatctgggaaatgacttttttttcttttaagacagtatacattcttttaaacttctagcattaagttactttatgtgatcaaaggaaatacacaggtttccatcaaatcatgatttgttctaccctcttcactttcatacatatatcctaatttctactttttaaaaaaatatagaattataacaccttttttcttttggtaattttgataattcttatttttagtctaataaaatgtagttttattctttatatttttatattcatttttattttgtataactcataaatagcatcttctgtacatttaatatttgtaaatttttctctgacattttgctatgttagcaagtggaattgtggtatagtgatgaaggtactatcagtctgttacacattttaaacatgtatttaatttaatttaatttatttatttgagacggagttttactcttattgcccaggctggagtgcagtggcacgatctcagctcactgccacctccacctcccacgttcaagcgattctcctgcctcagcatcctgagtagctgggattacatgcacacaccaccatgcccggctaattttttatttttagtacagatggggtttcactatgttggtaagcctggtcttgaactcctgacctcaggtgatccacccaccttgacctcccaaagtgctgggattataggtgtgagcaactgtgcctggccctaaaaatattttttcaatgctgtgtcataccaaaagggaagaataacttctgtatgaaggaggcagtatagttcacagtaataataatgggtatagcaatgctcaggtaagaagaatcttaatgaaagtgaatggataagagagcagaattggatattatttgtgtaaagtcaaaatgagagattcagttgttgctcactacttgaataaaattttgttaaattttccatgattttctacctgaaaactttacatagtgaaagttttgcctagatgaatattattgtcagccctggcaattttagtatgtgcacaaatggcactggatatttatatgtaaaacaatttactaaaataatttgtaaattattttaaacacctcattacaaatatgttgtagatgtatgatgctttaatattttaatgggtcttaaatttctttaaacacacaaagttatcagtgagcactaattgattttttcattatccttaaaatttgtagtattctttaagcttagatcttttttagcatatttgtcaagtttgctattatatatggattatgtcagtggtccccaacctttttggcaccagggactggttttgtggagacagtttttccatggacccagggaggggagatggttttggaatgattgaagtgcattatatttattgtgcactttatttctattatttttattacattataatatataatgaaacaattatacaactcaccataatgtagaataagtgagaatcctgggcttgttttcctgcaactagatggtcccattctgggggtgatgggagacagtgacaccgaaagtgttttgcctatgttcagtctactccataatctcattttggttgctgtcactgcagaaaactctgctccacgaagacaggatgctggaaatagaagcaggctttttggtgcttttgtggcaatctcaggatattctgccttgactttaactcacaatgtatagtgatttgaagttgtcttaaacatacttttaaggctactgtcatttgcgatctcatgcagttgatcctcttctagcatggacaaagtcgattcacctggcttactcgcaaatgggtcgcgtatccattccttcccagtttggggtctttttgaagttgggaagtaatgctgaaattcttttgtaagctgtaatagttgttcatgcaccagctgggagaaagatggtgctgggagaaaaaaatctcttctaatgtttgaaacatgtcagaaattcgagagtttacttgtcgcccccataattccagtttggcattgaatgcagccactttacctgccaacttgaatgcagttgttattctctcctgaagtgacagaatgagtttcttgagcaggttgaatatgtcacacaagtaagcaagttttgcaacccattctgtgtcactgaaatgtgctgccagtggtgactgtttttctaaaagaaatctctgcagtagcccttgtaagttgaaaactctgaccagtgacccacctttagaaagccacctcacttctgtgtataagagaagacatgcggccgggtacagtggctcacgcctgtaatcccaacattttgggaggccaaggtgggcagatcacgaggtcaggagttcgagaccagcctggccaatatggtgaaaccccatctctactaaaaatacaaaaattagctgggcatggtgatgtgcgcctgtagtcccaggtactcgggaggctgaggcagaagtgcttgaacccaggaggcggaggttgcagtgagctgagatcgcgccactgcactccagtctgggtgacagagtgagactccatctcaaaaaaaaaaaaaaaaaagaaaaagggatgacgtgtgtgctttgcacccatctcctcacagagctgtgtgaacagatgtgagttgagggcatgtactttaatgtggttgataattttcatcacatcttgctaaatattgttaagttcaggtgacatttttcgcctagccagcatttctctattgatgacacagtgagtagactcacattcagaagcaacctctttgacccaagcagtaaaaccagaaagctgcctagtcatggcagatactccatttgtgcgtatattgacaaaaaatgaccaattcagttttcctgatatgtaatcattcaaagatttgaatacttctgcagctgttgtgttggttgtcaacaaaagttcacataatagtctgggcatggtggctcatgcctgtgatgccagcactttgtgaggcagaggcaggtggattgcttgaacttaggagtttgagacaagcctggctaacatggtgaaaccccatctctactaaaaatacaaaagttagccaggcatgatggcacacacctgtagtcccagctacttgttggtctgaggtggaaggattgcttgaacctgggaagtggaggctgtggtgagccgagatcgtgccactgtcctccaggctgggtgacagattgagaccctgtctcaaaaaaacaaaaaagagagagagagagaaatgtgcacataacatatcctcgtgcacagcctcctgaaaaatatattgcacaaaaacaaacgttttattgtcaacatcagttgactcatcaacctggattgcttaccaaggtgacttattaattctctctaacaattgtgcctcagtatcctctgctatttcatcaattcctctagttatggtgctagctgaaagaggaacacatgtcaccttttgaactgcagtctctcctaaaagactacaaatgtcttcagcaataggcaggatcaactcttcatcaatagtaaagggcttctatggtttagcaatgctgttagctactaagaatgatgctcttagtacagacccatttgatgaagtggtggctttcaataattgcttcggctcttcgtgttcactttttttcttttgaaaaactccaaaggcttgttttttaatgcagggtgcttggtctccttgtggtgaagcagttttgaaggtttcatggtttcattggatggctggttgcaacgtattgtacaaagtggacttggagaatgtgaatcacctgttgtaatgaacccgtaatttaagtaagactcttagtattttctttgaaatgcagctttctttttgttggcagtctaagagtcttctgctatctcatcattcccccttttcaaagaagctctccagtgatgtttgttttttactcagtttggctaaggtttgtttgtgggcttaccaaaactgtaactgaaacaagtgtgcagtgtgggaaagaggtgtggacagaaatggtaaataaaataatggggggggggggcggggtcaggcagtgcccgcatggactaaaataagtattagattctgccttcaagcttgctaccagatgcgactgtaaaattgaagtacatcatctcacttgccactataaagcctgctaccagatgcagcttaattatcacttgccactcactcactgatagggttttgatatgagtctgcaagcaattgatttattgtggtccctgtgcactcaaacctctctgctaacattaatctgtatttgcagccactcccaagccctatcatcatcacctcagctccacctcagatcatcaagcattagattctcatagggacatgcaacctagatccctaacatgtgcagtttacaatagggtttgcactcctatgataatctaatgttgccactcatctgacaggaggtggagctcaggcagtaatgcgagtgatggagaatggctgtaaagacagatgaagctgtgtttcctcacttgctactcacctcctgctctgctgcctggttcctaacagggtgttgagaaccctgggattatattgtataggatgtcaccattatgtgtccattatgtatcagtattatgtatccactgtatagactgatatttattttttaccacctcagaactggtttcggtttttagtagatatggttacatagatagggcactttgttgagatactaggaaatgtgttttgaggacttattctttttcagtggtgaaatgaattcttttggactgttacttcccctgagaaaaattaggaattttatttgcctaaagcatgagagaactatcaaaaccatgagaatttgtcagagatttaggagaggtacaatgtcaagggatacaagacaggcattttgtgtaattttaaccttgagacagttagaaatcctggaaacctcctgagacactgagcagtccttttgtcagccattacagaggaacaaaattagatatccagatgtgccaaggaagaggagccttggtacatacttaaggatttagtctggcccctgagattctaaaccctactcgtgataattagcccacctttgaatcatcataatcttttattagattatggtgaaatgcccataatgtagttagatggcaacataaaaagtaaatactttattgagtgagataacatcatatggaggcttaaagtatttcttctatatatcatatacaatatctggcacaaactaaaaaaaaagctcggaagaagataagatacgaaaaaacaacatccgttagaaacatacatataggataatggagtgttttagacacaaactttaaaataattattgttatgttcaaggaattaaaatttaaggtagagaatattaggacaggcctggatactcatacttatgaatcaaatggaaattctagaactgaaaaatacattgagtaaattaagaattccttggatggaaataacagcagattagacacagctgaagggggaaatatgaaatggaagagagatcagaaggaaacatccagaaggaagtaaagaaagacaaaatgatgaccaaaaaaggacagaaagaaatacaaggaagatgtggaaattgtctaacccacatgtgtaattggaatcctaaaaagagaagagtgaagacaaatgtgtaacattattttaagtgataatgaataagaaattttcaaaagtgacaaagacatcaagccacagattaaagaagttctgtgagcaccaaggggcataagtacaaagaaactcagaaatattatagtaaaactgctgaaaaccaaaacatgaagacaaaaatttcaaagcagatagaggaaaaagggcatatttcctttaaaggaaaagcatgaagacaattaattttttaactgaggaaatgggatccagaatacatgttttcaaatagcttaaagacaataatcatccatctaaaattctacataattaaatattcttaaaaatgtaagcaaaataagagcatttttagaaaaacaatgactgagataacttgacagtagtaggctttcgataaaggaaatactaattacaataagtgctattgaagtagaagaaaaatgatcccagatactggatggaatgtaatgaaattatagagatgattctaaatgactatcatataaagctatagtaataatagtggcttgcatatacacaaaatttaaatgcatggtcctaatagcacataagtcagaaaaggggtaaattagtgttaaaaagtctgaaagttggtcgggcatggtggcttatgcctgtaatcctagcactttggagagctgaggtgggcagatcacttgaagccaggggttcaataccagcctggccaacatgctgaaaccccatctccactaaaaatacaaaaaattagccaggcatggtggcatgtgcttgtagtcccagctacttgggaggctgaggcacgagaatcacttgtacccgggaggcagaggttgcaatgagctgagatcgcatcgctggactccagcctggacgacagagactctgtctcaaaagacaaaaagaaattccagttatactaaatgtgacagattaaatattccagttaaaagccaagaatttttggattggatataaaaacaaaacttagccatctgctgcttagaaaagataaaccttaaataaaaatatttagaaaagttgaaagtaaaaggaaggcataacagttcttaatttatatataatttataacagtgttgaaataatgtaaaattgaccaaacacaagagacaaaacatagtgagatgtttttaacccaattttcttggtaactggtagtaccaggagaccaaaaaaccggcaagaacataaaacatttgaataggacaatgaacaattttgtctcacttgatatttgagagcataataccttataattgaagcatatacatggtttccaagaacaaaggaactttcccggaatttactatattctgggttttaatgcaagtcttaacaaatttaaaaggattaaaataatacaaattaattgaccacagtgaaataaaaagtaactttttggtgattacataaaaataataagaaaaaccctaatatatatgtgtatatatatttatatataacatatgtgtatttaatatatgtgtgtgtgtgtgtgtgtgtgtgtgtgtgtatatatatatatatatatatatatattttttttttttttttttttttctttgagacagactctcactccgtcacccagcctggagtgcagtgacacaatctcagctcactgcaacctctgcctctcaggttcaagcaattttcctgcctcagcctcctgagtagctgggactacaggcatgtgccaccacgcctggcaatttttttgtatttttagtacagatggggtttcaccctgttagccagggtggtctcaatctcttgacctcgtgatctgcccaccttggcctcccaaagtgctgggattacaggtgtgagccaccgcgcctggccaaaaaaccctagtataattttcatactgaaaattttcatacttaaaattactgaatgatgacacatcaaaatgcatgtgattcagctaaggaggggcacttatagatctaaatgcatttattagaaatgattttctaaaagtctgaaaatcagtagtctaagaatccccttgagaagttagaaaaagaacagcagactgatcccaagaaaggataaagaaaataaagatataataaaggaaaggaacatgagataagagcatgaattaatgaaataggaaacatgtgatagaaatgatccataaagccaccaaaactcgacaaagttggttgtttttaatagtaatagataaatccccacacagacttagaaacaaagattacttaaataatccatgccaagaatgaaaagggatatcatgacagatcacatagagattaaaagttagtaagaacatatgataagcgactctatgaccgtaaatttgaaaaagtagatgaattatgacaaatttctagaaaaacaaaacttaccagaattgacacatacatgaacattgaaataatcttatgtcaaataactagaatttttaattgaaaccttgttgcctcaaaatacagaagcatacatacagatgaacaaataaaaacaaaacaaaacaaattctccaggccgtgatcactttactggtgaattttcccaaatatttaagaaataagcatttaagaaataaataacatcaatctttcacaaactttctggaaacagaaataattatgttgagatttatgaggccagcataaccttgatataaaaatatgaaaaggatgttacaggtaaggaaaattttagtattgtcttttccatggacgattccagcaatttagaaagaaaataatagattatttgggttcattcaaagaatataatgttacttaaaatttataaaatttgaataattaagaaaatagagaagtaatggtctataatcttgaaagatgcagaaaaaattatagataaaatttatcatgtatttatgataaaacctctggtgaactaggaatggaagcaaatcatttatgtggtaaaatgtacaaggacacatgaaaactttactgcaagcattatggtgaaatagagaaagctttccctctaagattgggaatgggataagggtgctcgctgtcaccacttttattcaacattgtattggaatttccagccagtgtaataaggcagattaatataatataatataatataatataatataatataatataatataatatgtatatgggtaatcagttgctgcaaataacatcaatataaaaaattaatccagagtaattctgtataccaggaacagtttaaaactgataatttaaaaataatataatttatgtcactgtcagaacattaataacctaaggaataaatctaatgacttatgtgcaggatctttacacagaaaactataaaaccttattgtgagaaattaaataaaatttaaatatatctcagaccaaattatgacaattgtttgaaaaactcaatattatgcagatgtctattctgcccaaattgatctgtagatttaatgtgatcccaaacaaaattttagcaggtgtttttcttttggaaattgacatggtgattctaaaatttatacaaaaatgtgaagggtaatttttgtataaattttagagtctccgtgtcaatttccaaaagaaaaactttagaagaacaaagctggaggacttttctatccaaattttagaagaacaaagctggaggagttctctatcagatctcatcacttatgattttacaataattaagtgttgttgcaaagacagggaaatagactaatgcagcaaatagaattccacagacagacctatatatttatgggcacttaatctatgacaaaggtggaactacagagcagtctttcttaataaattgttctgggccaattgggtgtacaattggaaaaaatgaatattaagccctacctcacatcatcataaacaaagatctgtttcagatcaatgttagatctaaatgtggaagtacaataatattctagaagataacagaggcaaatatcttcatatttatgagtaaagaaagatttcttaaatggaatttgagtagttttattagtaaaagaaaaatgatagactgaactatatttatatgtctaaaaagtcagtaagaacacaaacatgccatgctcatggatcagaagaatcaatattgtaaaaatggctatactggccaaagcaatttacagaatcagtgctattcctatcagactaccaatgtcattcttcccagaattagaaaaaaaaaactatcctaaaattaatatataaccaaaaaagagcccgaataaccaaagcaatcctgaacaaaaagaacaaagctggaggtatcacactacctgacttcaaactgtactataaagctacagtaaccaaaacagcatgatacaggtagaaaaatggacatgtaaaccaattgaactaaatagaaaacttgaacataacgccacacacttacaatcatctgatctttgacaaggctgacaaaagcaagcaatgaggaaaggactccctattcaataaatgatgctggataactggctagccatatgccaaagattgaagctggacccctacctttcaacatatacaaaatcaactcaaaatggatcaaagattgaaatgtaaaacctcaaacaatacaaatcctaacagacaaccaaggaaataactcttcttgacattggccttgataatttttggctaagtccccaaaagtaattgcaacaaaaacaaaaattgacaagtaggacctaatcaaactacagagctcttcacagcaaaagaaaccattagcagagcaaacagacagcctacaaaatgggagaagatattctcaaactgtgcatctgacagaggcctaatatccggaatctgtagagaacttaagtccacaggcaaaagacaaataaccccattaaaaaatgggcaaaggacatgaacagacacttctcaaaagaagatatacaagtgcccaacaaacatgcaaaaatggtcaacatcactaatcattagagaaatgcaaatgaggtatcacaccagtcagaatggctatttttaaaaagtaaaacaacaacaacaacaacacagcagattcttatgagactgcagagaaaagtgaatgcttagacattgttgatgggaatgaatgtaaattatttcagccactgtggaaaatagtttggagatttcttaaagaactgagctaccatttgacccagcaatcccattactgggtatatgcacaaagggaaataaataaatcattctaccaaagagacataggcacttgtttgttcattgctgtgctattcacagtagcaaagacatggaatcaatccaggtgcccatcaatggtagattagattaagaaaatgtggtacatacataccacggaatgttatgcagtcataaagaagagtgaaatcttgtcttttgcagcaacatggatgcagttggaggccataatcctaagagaaattaatgcaggaacagaaaataaaataaatcagacataaaagaaaacagtatattcttctattgatataaagttcagcaccaggaaaaacagaattatgggcttagaagttatgatagggattgcctatgattgtgtagtatttgaatgagtagcagcaaagcttctggagtggttatgtgttcactttgtgataattcattgaactatacacttaagatttttatacttttggcatatatattatacttcataaaaatttataaaaaaatagaaatctgagttcaatttgacttcttatatgctaaaagattatgataatttgacataccaaaagagggtcaattttttatgtaaagttagcaaattacgtttttattatcagtgttagaaaagaatggagacataaaatttcagtcatttctgctatcccactccttcaggagtagttgcatctggtttcgttacatttaataagtaagagagaataaacatcttgaacttataggagttcctgttgctcaaaaatgattccttttatgtttttggtatattttgctgattcatattatctttgctcaggcactttaactttggtgtaatgattttgaatattggggtcattgtgatcttcattttatagccttgttaaatgaggcatctcataactttctttgcatatgtttgtacaacttataatgggagcttatgtcttcattatttttctatgtgaagacttttctctgatagtggagacctcagattttcttggcctattgtttaggtcttttcttcaattgttgtattcctttagcctgtgaaaaagcacagtaagttttaacacataaggaatttattaaactttaccatttataactttcagctgtaattatcaactttttatttttatttttatttttttccagtgagggaaaaaagacttcaattatatttctttctttcttttttttttttttttgagatgaagtttcgctcttgtttcccaggctagagtgcagtggcacaatctcggctcactgcaacctctgcctcccaggttcaagtgattctcttgccttggcctcctgagtagctgggattacaggcacctgacaccacgccaggctatgtttttgtatttttagtatagatggggtttcaccatgttggccaggctggtctcgaactcctggcctcaagtgatccacccacctcgacctcctgtagtgctgagattacaggcatgagccaccatgcttgcccaacttcaattatatttctacagatattaaaaagataggtagtgaatctaatggtaatgcttctgtggtacaaattaattctgtacttttaaaatgtctttctaatcacatatacttaaaaaatgttttcataggccacacctggttacatgaaatgatttaatctagcttcaatttgatataatagaagttgtttttacattaaaatattaaaaactatgttatgaaattatttttttttgtgatttctctaaaaaatttcctgtccgaggttttggaaagcgatagaggttaattttataaattatgttattatttaaaacccatttcagtaaatactgatgaacatcagcatttttctttctctgcttactgagtgtctgaaatcttttcaatgaaaattttgttggctctttatcaagtcctgttttggaaataatcctaagtagttctcagtaagggagattgagaatttaaaatttaattttatatatttatgagggaaataatagaaatatatacgcacacaagcacacaaacatatagttgcgaagtaagatatcagagatttattaaaatgaaaataaaatgtttatacaggcaaaaagactattatctttaaaaacatcatgataagagatttggaattttggaatgtctggttaaaatcccatattgataatttaaataagtacttatctctgtagctttgcttttcacagtgattaaaaaatttgtagtacttattttttactagttctcttttataaattgggaaatatcacatatggacaaaagactgtatgatagtatgtatatatagtttcaaaaccataataaaatgaattccctgcctacctgtgctaagaaagaggacattacaataccctagaagcccccatgtgtccctttatgattgtatcccttatattatccccctccattattcttaatattgtgttatttccttgcttttcattgcatgtttttaccctccatatatgtatttgccagcaaacctttcatttagtttttctgtttttaaattttgcataaattgtttatcattgtatgctttcttcagagatctttaaaaagtcagctttatgctctggagatatattttaatggagagaggcagacaataaatatggaaataagtaaaatgtattttaaatgataataagtgctatgaagagaaaagaaagcatggaaggaagatagagagtttcagattgttgcatttaaaaagagtggccagagaagacctcataagacatcttaataaaacctaaaggcgattaaggagcgagccatgcaaatatctgggggacaggtgttctaggaggaggtccagctagtgcaaaagccttgagatgggaacatccttgtcatctggaacagcaaaggggctagtgtagtcgaatgtcttggagtaagatggaaattatcttcccttagagaaataactggaaacccagtcatgtagggccttagaaaacattatagagcttttactttggtatgggtagactttgagggttttgaacagatatgtgacttatctgacatatgtgacatgctctgacttagatttttacaggagcggtgttgtaattacgatgcaagagcagaagcaggaagaccatttaggaggctattttaatgatctaagagggagatgatggtatctggaaccatagaggccaatgtgaaggtagtgagaattggttggattccgaatatattttcaaggtagaaccaacaagaattgaaaaaactaggggactggatatagagtggatgagagagagagagagagagagagagagagagagagagagagagagagagagagagaaatagtgaaagatgaagcaggcatttggcttgaagacctgaaagcatggagttggcattagttgggatgatgaattttgtgggagaagtaggtttggtgtcaggaagaatggaaacttggttttagacacgtttaatttgaggtacatactatacagcttgtggatatgttaaataggtggctggatgtaggaatttcaggatctggacactctaattttctggtcaaagagatgaggagaaacaaccagaaaaggagactgagaatgagcagttaatgagttaggaggaaaactgggagaatatggtattctagaagccaagagcatatttcaaaggaaagagaatttgtcagaagctgctgattggtaaactaatatgaggattgagtaatggtcatggaatctggcaaaccagtgctttttgctgaacttgacaagagaagtttcagtgggtggtgaagtcttgattggcatgtgtcaaataaagatgagagaagaggaattaaagaaaagtactaacaacttttttgaggagttataaggaaaggaaagaaacagggtaacaagtggtaagggatgtgggacaagatatatatatttttaagtttggagaaataattatgtttgtaggttgacaggaaagatcaagaagatgtaagaaatgatgccaaaaataaagggaataatttgctagagggatgtactcaagaaaacaagtagcaatgggatctagtgaacaaatagagtggtaaaccttacctaggaagagcatgggcactttattcataagaacagatatgaagtcaggttatttgaatacaaatacaggtaaataagtagaggtggagagaactcttgaaaattttgtttctttttattttctcagtgaagtaggaagtagagtcatcacttgagggtgagaatgagggatagtggaagattgaggtttgaaaagagaagtatgaaatcatttaggagggagggagagtgaatgagttagggaagtgtagtaggatccttggcagaattttcccatgtgagagacccttaatgtgcgaacgcagagtctttttatattttctgccttactgtggatgcatactggaattgtccttagtttttactattatgagcaattgtagcaaaaatattcttatttagtcttctattgtttcacgacagtttgtctaagctatttacttaatagtataaatgcttgttcatgctctattttacccaactatactccagcctcatcttactaatttgcacttctaccaggggtgaatgacagttcccatttcttctcaacaatctcattaaggtttgatgttttttcatttttgaatattttttgccaatatggtgagtataaaatggtgtcctattttggttttaatttgcgtttccttaattgctaatgaggtataacatcttttcatatttattggccaaacagctactctgaaattttcacccatattgtcatatgtagttgtttgtgtacccttttttgataataattttttgttagttttatattttgccaacattttatctctcagattgtggatcatctttttactctttgtgtaatatttgataagcaaaacttattaattttaatatagcagaagttgtcagtattttatggattttgctttgtgtcttgcttaaataatacttacttaccttagtgttttcaatattgccttccacacatttagtctttaacccaactggataaggacttttgtgtgtgtgtgtgtgtgtatgtgtgtgtgcacaaccagaactataaatagtgctcccagaactatttattgaaaagtccattccattagtggtctgcaatactaacagtttttttggttagaattacttccaggtgattgatattttatatgcttttctaggtgaaatctgtattcatttcctatggctactataataaactatcatagacttggaggcttaaaacaacagaaatttagcttctcacagttctggtggctaaaagtctgaaatccaggtgtcagcagggccattccctcttgaaaggctccagggaagaatccttctagccttttccatcatttggcagctccagacattcctgggcatactttgattgtagctgcattactccagtctaactcttggacttcatatggacttctccttgtgtgtttgtatgtgtctgaacgtggccttcttgtaaggacaccagtcactggatttaggacccatacttgtttaggattagatctatgtgatctcattttaacttaactatctgcaaagaccctattttcaaactaaggtcacactccaaggttccaggtgaacaattttgggaggacagtattcattcaaccagtacaatatcttttaatttctttttctgtttatgatctgatagactgaaaggcaattgattttttattactcttatgtctaacagtttgctgtatttttgtaatttatgtgtagacttttttagcgttttttaaataatagttgatcagattatatacaaataatgacagttttgtttcttcctttctgggtcttacagctttatatttttctcgtcttacaatttctgctataatcttcagctcattgttgaatagaagtgtgataacaggcatctattttattcctgagcttttaaaaaatgctttcagtatttcttcactaagaatgatgttcattgtgggttttttagatatcattataaagaaaggtctcttttttcctggtttgataagggtttatattatgaatggatgcttggttttgccaaaggctgttttaggaatgacttacttgatttttctactaaataatttaatgtggaatattattttaatttactttattattaactcaacttgggttaaatcaaacttagtcataatgtattatgtgttttttttagtttgctagtatttttgtaaggatttttacattgatgttaatatgtgagatttgcacatgttttttttgagatattcatgtcagctctttggtggtgttacttcgggcttttaaaatgagttggggagtattctttttaatactctagaacatttatcacatgtatatatgtatatattattggaattatttttcctattttaaaataataaactttgggccaactaggtctgatgttttcttcagggtgtagagttttaactactgaattcaatataatagttgtaagaacattcagatgttctatttgttgttgagtctgttttggtaagatatatttaaaggaatttatccatgaaactgatatcttcagttaaattgttataaagatgttaatatattctctcaggatcttttagtatctgcaatatctgtagttgtgttcccttttaattatttttaatactgcatttatttatatctccctatatatctatgtattgtttttgaatggagttgcttacatgatgccctcttaagcataaatattttaaaatatatttactaaaaagcaaagatactctcttacataaggatcaaatttagaaaataacatggatagaatattataatctaacacatttaattttttcaattgtaccaatattttttacaaattataacattaaaattgctagattcgatttttttctttttcttttttttttttttttgagacagggtctcactctgttgcccatgcttgagagcagtggtacgatctcggctcactgcaacctccacttcccaggttcaagcgatcctctcactttagactcccgagtcactgggaccccagatgggtgccagcagggccgactaatttttgtatttattagggactgggttttgctatgttgccctggctggtctcgaactcctgaggtcaagccatccgcccgccttggcctcccaaagtgctgggattactggtatgagccggatttgatttcttaataagttttcatgaatgttcacatatgtgattggcctgtggttttccctttttatactctccttctcagattttgatacttttttccttactgagtttgggtatcttttcctgatccaggattacatccaggagcatgcaaacatttagttgtcatgtctttttagtctcctttaatttggaatagtcatgatctttcatttgaagtctgtgcctcgtttgggtttatctgatgtttctgcatgattagattcacattttgtatttttgttaggaataccaaaatgtcatattcttctcccatggctggtgaagttaaatttttgtgaaaaaaccttttttattgagataaaagtcataacataaacttcttaattttgatcatttaaaacagtacaatttagtggttttcagtatattcataatattgtgcaactattaccactagttccagaatatttccatcagccccaaaagaaaccccatacctgtctattctctctatctccatcttctggcaaccactaatttaatttctctctctctatggatttgtctaatctggatattttgtatgtatggaattgtacaaacatggcctcctgtgtgtggcttctttcacttattgtgattttttttttccagagttcgtctgtattataccatatatcagtgcttcattgtttttgttatgactgaataatattccattatctcaatataccatattttaaaaatctatttgtcaattaatagacatttgggttgttttcacttttgactattaagaatgaggctgctgtgaacatttctggaaaggttaacttttatatcttggtaaaagtggtatattttagttttctcaatggtaaatatactgtttttcctttttaaattactaagtgccttattgggagatactttcagattatgtaaatattttatttcttattaaacctttacataatagttttaatacccattgatgattctcactagaaagagttattagtatgatggttactaagtggttatatttcattattccttcttagtctccccagtctatatattcatttatatcagtatgaattcatgtatttttattttatttaatgttttgtaatcaattgctattctttattctggtgcttatattgtcacagatttgcctagtgagctcctttcaatcaggtgtctgtattctttagatatgtccccatcattctttgtgcactcctttaccttctgcacaaacatttgtccctgccctagtgctcgaataaatcattaccctcaaggaacctaggttccttttagtggagaatgttctttaaaaactaagattagagaactacgcatatatccatttatatcctctatatccatttatagatctgggcatgtatctgtagctctacatatctatctgtgcttaaatgctgtctgtctaaattgcataatgatgccatacagcattacagggatcatttttgccttcccctctttcacatttgtaaatctcttctgccagtgagaaacttggtttccattttatgcttcatacattacaaaatatttttgtatgtgaagtatgaggaacaagatttactttttccatttaatataccatatctggtaaatcagatgtaattttaatccccacattttttgtttgtttgttttgtttttttaacaataaactctatgttttagagcagttttagttttatggagaaatgagcagaaagtacagaatgtttccaaatactctcatctcccctatccccaggtcctctattatgtgtcttacgtgaatatggtacatttgttacagtcagtgggtcaatgttgatacattactcattaactaagtccatagtttatattaggttcacttttgtgctgtatattctatggattttcacaaatgtatagtgacatgtatctacaatgatcatttcatacagaatattttaattttcctaaaaataacctgtgatcctcttgcttatctcttcctccctccaaactcttggcaaccactgatatttttactgtctccatacttttgccttttctagaatgtcataaagctggaatcatgtagtatgtagccttttaattttggcttctttcacttagcaataagcatttaaagttcctttatgtctcttcatgacataatagcccatgtcttttattgctgaattatgttgcattgtatggaaaccatcttttgtttatccagttacctattgaagaacatcttggttgcctccaaattttgacaattatgaataaagctgctataaacatctgtgtgcagatttttgtgtggacatattttcaactcattcaggtgaccaccatggagtgcaattcctggatggtatggtaaagttatgtttagttttgtgagaaactgccaaagtggctggctgtatcatttttcattcccagcagcgatgaatgagagttcctgttgctctagatcgttgccatcttttgtcagcattttagattttagctattctaatatgtgtgtagtggtatttcactgttattttaatctgcatttccctgtgacatgtaatgtgggatatcttttaacatgcttacttgacatctatatgtcttctttggaaaggtgtctgttcagatcttttgccttttttaaaattgagcttgttttttattgagttttaagggatccttgtataatttggataccagtcctttattagctatgtgttacaaatatgttctcccagactgtggcttgttgtttcattctcataacaatgtctttcactgaggagaggtttttaattttaatagagtccaaattatgacttttttctttcatcatttatgcttttgttgctgtatctaaaatgtcatcaccaaacccaggttacctagattttctcctgcgttatcttctgggagttttatattaaataattttgcattttacatttagctctgcgatctattctgagttaatttttgtaaaagatgtaaggtctgtatctagatgattatttctgttattactactgtgatgccctgttgttccagcaatatttgtccaatagacagtcctttcattgttgaatcgttttttctattttgtcaaagatcagttgaccatatttgtatgtgtctatttctgagctctctattctgtttccttgatttatttgtctattcttttgccagtcccagggactgacttgattattgtagctttatagtaagtcccaaagccaggtgatgtcaatctttgactttgttcttcttcttcaatattgtgctggctattttaggtcttttgcctttacatataaattttagaatcagtttgataaaaatttggtaaatttattactaaaaatcttgctggaattttgatttgtattacactgaatctgcatatcaagctgggaagaactggcatattgccagtattagttttcctatctgtgttcatgtactatctctttatttatttagatttttggtttcttttattgtttgtagttttcctcataccagtcttgtacatattttgttaggtttctacctaagtatttctcttcttttggttctaatgtaaatggtattgtgtttttgttcttgttcactgctggtatataaaaaatcaattgtatattacccttgtgtcctgcaaccttgctatgctagcttattagttctagagggtttttttggttgttgttgttgttgttgttgattctttgggatttacttcgtagacagtcatatcatttgtgaaaaaataccattttatttcttccttcccaatctgtatatcttttatttcattctcttgtcttattgcagtagcaagaacttccactaaaatgttgaatagaaatggtgagatgaaacatccttgccttattccttttcttggaaggaaaacattgtttctcaccattaaatatgatgtttttatagatgtttatcaagctgaggtattttccctctattcctagtttgctgagtttttatcatgactgaatgttggattttgtcaatgctttttctccatctattgatatgatcatatgattttctttgttagcttatcgacatgatggattgaatcaattgactttgaatgttgaaccagcctagcatacttggaataagttccaccttcttcttcattatatttaaattatcttagcttaaatattgctctactagagaatattttgttccttgatccatattatttatttactgtccactagattatagtattttcttgttttgtaaagaaaaattagagactagagattattttattttattttattttattttttgtgatggagtctcactctgttacctgggctagagtgcagtggtgcgatctcagctcgctggaacctctgcctcccgggttcaagcgattctcctgccttagcctcccgagtagctgggactacaggcgcaggctaccacgcccagctaattttttgtatttttagtagagatggggtttcaccatgttggcaagcctagtctggaactcctgacatcgtgattcgcccacttcggcctcccaaagtgctgggattacaggcatgagcaccgcgcccggccggggctgtattttttcttagcctgcctctcctcctggggaaaaacttctgtgctactgctttggagttgcaggtgggtgggcttagtggcctgttcctcttagagtgacaccactactttatgtacagagcactagatggggatagtagtctctggagtcttctcaacttggctctttctggatgcaacagtctgccttaggagtgaggtgggatgaaggctattgggtccaatgttgttagcctgctggaattagtgtatagctaccaccctatgagtggcaactgggcagaggaagagcacccagacctctcatgatctttcccagaacagagcttctgtaacccagagctggagggaatgagaagtgctggtatcctgccactcctagtgagatatcgctggcctggagtgggagttgagggatgaaggagccttatgttcttggctttacttgcctggggtagaatttctatcatgctgaattggttttgtgtgtgtgaggcaggcgtgagggggttggggtaagtaattatctattgccatagactattgctgttctttttgagtaaatgtttctttatttggtgttgctcttagcaaaattttcttaggttaatggttgctttttataatttttaccaattatagttcttttcctagtgggagtgtttgtggaactcctcatgttaccattctgtaagtgagcttcatacttttttcctttttttttttttttgagacagagtctcactctgttgcccaggctggagtgcagtggtgccatcttggctcactgcaacctccgcctcccgggttcaagcaattctcctgcctcagcctcccgagtagctgggactacgggcacgtgccaccatgcccgggtaattttttgtgtttttagtagagacagggttttgccctggatcaagccaggatggtcttgatctcctgatctcgtgatccacccgccttggcctctcaaagtgctggagttacaggcgtgagacaacaccacgcctggctgagcttcatattctttagaaattaattggtattataatccatggttttggagctgctacatatactatactaactatactttacgtattagctatgtttatgtatataataattctaacttctaattgtttgtatcagggctttagagtagttatttaatatttatttatattgtcatgcacctttactacatatccattcattcagatcagttataattgtgagcatatatttataatattttctctcagaattatactttaattaaaagaacatttatattaattttaatgtttcacaagatgcattgtaattgtaatttttgattacacaaaaaatatatatctcaaatatatatatatatcttgagcaaatgtacctattcatcaatgagtgcaatctatagactccacttaggtaaggtacaaaaacagcaaatgaatttatgctgttagaatagtggtaatattcttatagttttttatgtgagtgctgattacttagttgtgttcatgttgtgaaaaatcattgagttttaggcttctgatatatgcagttttatgcatgttatacttaaataaaatcttaaaagtttattatggagtccatatgagttacacagttttaaccaaatatagtttagactaaatttactatatttaactttttacttatttggtattttaaaatgatgttttgggcctctagttttaagatggcttgtttcctatctttgtaaatgaaaaaataatttataatataaattattatgagtattaaaaattctttttgatattgtgtctcctcaaagcattttaagatgctatgagcctcaaaatatttttttttgaaatattgaagtttagaggtcatttataaattgttaaaaaatatgtttttttcccccacaattccagggaaacctctatatgcaaagtagaccctttatataacatatataaaatcagggaggtcattttatcctttgtaatacatttttaaattttattctgtaggactattttgaaagaaagtgggtttgccagataccttcattcagctgttcttatcaatggagctatgcttatttttggaggaaatacccataatgacacttccttgagtaacggtgcaaaatgtttttctgccgatttcctggcatatgacataggtatgtatctgttaggattgtacaaagtaggaaatatcagaaattttccatatagatattctcaaatacattaattgatagcatgtgtatatgtcattttagagttaagtgatagaatatgaatggaattctttctaatttcagcacagtagtattatagtaatagagccaggagaacagaagtactgagcagaagtagtggtagatacagggaatacaaaaagctagatttggatgtcctttttgaagactttttatgttgtttccctttgtgaacactatatcagtttattgtgtttgctacatattaattttgataatgggtagatatggaatactgttgaattatgtaaatttttatacatagtaggaatgtaaacattttagattttaagggataagcaaaaatatattaaacatttccgatatacttactatatataggaatctgatagaactagagaaaggaatagagatagtagagctaaagaaataagattttgagacgaaatggaaacccagatgtatctgggaaacaactatataagcatgttttcccaaagaactaaaaacagtttgcatttatacaattcacctaattttagttacgcaatataatcctatcaatttctgaatatttaagtgaatgtatttattgaaatactaaatttaggtatccagtagacccttgtagtgaaaacattgtttttctatgtatcatattatatataaaacctagctgatatttaaaatatacttatcagtacttaagagcaccttttattgagggtataaataaagtattataccaatttgaagcgattaggaaacatttttataagtaaaataaaagaataacacatttaatagatgtaagaagtatactttttctcttaaacctcataaaggcacataatctgctttggtaaattatttcaagtagaatcatgtaaagaaaactctgactattaataagcactttaatctttttactattacagttgtttcaaaggaaattcctagtagtaaagttaagcatggtttttaaatctaagtaatgaatgtcattctgtgattaatcatttgatactagtaatttgatctttttctttttgaaataataatttgaagtggtaactcctgacgaacatgggattgtctcagcttttaggaggctcatgaatcattgtttgaaattagtaaaatgggttgaatgaagtactgaatctaggctggcagtgactttatctcattgctagattgggcctgtcaatatattattgttttggctatggtgataagaccctgggcttatttttctggaagttgatgaaagttttgtttgtttgtttttcttctggggaaaaaaaatcccacaaaaagtatacattgttgttgtcattgttaaaaatccatgaagtggaattttgaacttttgcaaaaggttcttcaaggagcttccacacaatgtctgtacttcaatgaagaatttaaggttgagctattttctggctgacaaaatgggaatgtatttttatttttttcatattgttgaagattatgatatatcaagttttatgtgtcaaaaaacttaagtgaaaaaatttggagaattttgtttcagaaatagaaagatgtcagattatgatgattctaattactactatttatttaatttccttctatgtgctaggtactatgttaagtaatttatatacaaaatctttaacctaccttgtagcatggtactattatcctaatattcagaagattaaacagatgagagtaacaggaacttgccaaagccatgcaggtagtaggcggtagatctaacttttgtaactcctaaaacttgtggtagtctttctatttgactacatcatgctgattagttgggcccagtgtatgttcttaattatggcaacaaattaccttattcttagtaatgcttgtttcttaatgctgtagaaatatagaagaaaatatgagttccattttttcaagcaagttgttcagactggaggaaggaatagcatattttaaacagttttacattttaacaaaggtttttttttatcccctgtgctaacactgacaacaaaaacataaagacagttccacaattcaacataggttaaaactgttcggctttatctcatttgattatttgtaggtagttctcaaaaatgttctctaaaataatctgtttgatcctcctgggtttggagtatgaaatgttggactatttttctgggaaaaggtatttttcatattattatttatacttcaacaaatgtctttcaaaataattgttttcctcatggagtatgtttttgtggaaatagatataagcattatatagtaaaccaattaggaaacagaaaaagtgtcatgttgctagtttttcttttcactgtggtacaccaggacatttttggtgcatttatggaaggcacttaaaagcttagctgattgttttgtgttatatgatatttaaacaggaatatttgtaccatttctaattttttattgttgcaaaatgtattatttgaacattactctcacagtaaattttatacagtcaatatcgctaatctttgggtatataaccttgccttcacagttcccattctattattgcatgatggatgtagaaggcatatgctggtgattttcaatcatgctcataccttggcatcctctttggaggttggttggaaaaaaaaaataacttacgtaatcagattctttgagattggatactgggcatctatgttttttaaaagtgactaaagtgcagctgataatacagctagggtggtgaataagataggttgagtataacacatagcatgacacatttcttaatttgactgtaacatatgacatgacacatttcttaatgttctagtttgtaaatctagtttgaggtcagatttgagaatccaaaaacttaatttttttttgttattgttagtgctgttattattactttcagaaagccactatggcaccttcttcaaggttaacaagaactttctggtaaagataaccttctatttagaattcacacagaattctgaaacaagatgcaaaacaacttattgactatgtttttttcttaatcaaaaagataatagaggataacagaaacatgaaaatgtaatttcctgagttaaattatttaagaatgggtagggaataggatttgtataagaactatatcttgcagaaagcagaacagctgaaatttcaaatgagatttaacgaataatcgagttttcaaaataaattccctgaacatagtggtttacttatgacattaatttctttgtagtgattatttaaaaactaaatcagtaaaaactaaaaagtaattttttatttgggaaagtaatattttaatggtagtatataataatgtatattcttaaccattttataatacagtgaaattgcagttctgtatactcttaaaagatcacttaactggccgggcacagtggctgactcctgtaatcccaccactttgggagcctgaggcaggctgatcacctgaggtcgagagtttgagaccagcctgaccaacatggagaaaccctgtctctactaaaaatacaaaaattagctgggtgtggtggtgcatgcctgtaatcctggctactcaggaggctgaggcaggagaatcgcttgtaccctggaggtggaggtttcagtgagccgagattgcgccattgcactccagcctgcgcaacaagaccgacactccgtctcaaaaaaaaaaaaaaaaaaaaaatcacttaactaattaatgaagcctgggatacctgattttgtccaactgtttggagtgatatatatgtatacatatataatagatatagtttggtaaggcatataatttcatagcaaaatcatattcaaattaagacatctaattatttaattttttggaatactcatgcaaagttatgaaaattccaatctgcttgcttttcatgtttataattatttttattttctggaggttattttattagttcctctctctgtttatccgtatttctctatgcacttcgttaaattcttagggctctttcttgatgaaagtggtaccacttacctggccatctgaaagaaacaatttctttgtagatcaggaaaatccttagaatcatcacacatttctttcaatgaatttagccaactgtcgactgttttaagcttcattgtatcctttgctcaaggtgttctctttctttttgttgggattatatacaagaaatagtagtttaatcttttttaaaaagaggccactaaataaaagaaaaaataaccttttattttgaggaaaggatgaactaacatttatctaatgttttcaacagtgcttggcatgtcacacatgatttataatataattattgttacatctgtgtagtgtacattagtatatttaatttatagaagaagacactgtgatttaccatggttaaacccaaactcacacaggctataagatgttgtattcagaatttaaagttaagtctacattcagagtccttttgatattaacactatacaccgtgatatttatttttcctggtttaacaggaaaaaaaaggaattttagttggaaagaacttgttagtgtagtgagacattcaaaaatagtttttatcaatagatttaatcatatttctgagaggtatttgaatttcactctacctgtccccctcccgaataagttgattggaaaatagtgacctcaagatagaaaatccaggagaaagaaaaggataatggataatgaatctctctcattcttaacaagtctgtatccattttgagagactgtattgaatacaaaaattactgaataaagattaatgaaaaaaatgctctgaaaaagcagcctctttaataaatagttctgggaaaagttgacattcatttgcagcagtatgaaactagaccctcccctctaaactaaaaatggatcaaaacaataaaacaacagaaaacaggaataatccttcaagacatgggtctggagaagactttctgcaaaaggccgcaacagcacaggcaacaaaagcaaaagtaaacaaatgggatcatataaaataaaaagcttttgcaaagaaaaggacaatcaacagaatgaaaagacaacctccagaaggggagaaaatatttgcaaactattcatctgatgggggattaacatccagaatatacaaagaactaaaaaattctcaatgataaaaaaaacctcaacaaacaatccattttgcaaatgtttaacaaaaataggcaaatgatctcaacagatatttctcaaaagaagacatacaagtaaccaataatatatgacaacatgttcaacatcagtattcatcagggaaatacaaatcaaaacacaatgaagtatcatctcacgccatttaggatatctattatcaaaaagacaaaaaaataacaaatgctggtgaggatgtggaacaatggggaaatgtttttgatggaaatgtaagctagtacagccactatggagaatagtatggaggttcttcaaaaactacaaatagaactattatacgatccagcaataccaccactggatatttatccaaaggaaagaaaatcagtatattaaagagacacctgcacctccaggtttattgcagtactattcacaacatccaagatatggaaccacctaggtttccaacaagggatgaatgaatttgaaaaatgtggtatatatacatgctgaaatactattcagccataaaaagaatgaagacctatcatttgtggcaacatggatggaactggaagacattatgttaagcgaaataagccaggaacagaaagttaaacactgtatgttttcactcatatgtggaagctaaaaaaagttcatctcatagaagacaaaaatagaacagaggatactagagtctgaggagggtgggggaagtggtaggttacacagagagatttgttaaagaatacaaaattacagctagataggaggaatacattgtagtgttctataccagtgtaagatgacaatagttaactattatgtgtagtttcaaatatctagaattaggatattgaatgtttctaacacaaagaaatgataaatgttcgagatgattgatatgccagttaccctgatctgatcactatacattatatgtattgaagcatcactatatactccattaatatgtacaattatttctcagtaaaaaatgtaaaaaaggaaaaaagttttaaaaagtcttaactcttgggggaagaaggcaggacaaagaagtcatgaatgtagaataaaaattttaaaataaaatattaacacataggctccaaccatatttcaaaagtttaataaactatgatcaagtaggattcattctaggaattcaactgtgattcgttatctgggaatctataaatataatttattagttcaaaactaccaaagcaacaggacatatcattgtatgttaagacactataaaataatttcgcctactttgcctggcagacagtaaaaaactaaataaatatttatttaatgaatgccaggggacaattcctgagagaagatacgggtatgaatgagtttttttttaaactgagaatgagttaacctagagtaaattgtgcttattttagaatattaaaagaagttttgaagtagggagccaaaaaacaaaaccccagtaaagtaccatcatttcaggggcaggtgggaaaagatatttggcaacatccagaaatgtaattttctattacagaagttttgaaatggctaatataggtttttctttatattcatcttgttgtgagccttgtacatacaacctatgtgtactttctgtcttatttcaaatttgcatttaagactaacttatgaattggcattttaagtgaaacagtaaaagatttttatttttttttgagttggagtgcaatggcatgacctcggctcactgcaacttctgcctcccaagttcaagtgactcttctgcctcagcctcccaagtagctgagattacaggcgcctgccaccatctccggctaatttttgtattttttttgtatttttcagtagagacaggatttcatcatgttggccaggctggtcttgaactcctgacctcaggtgatctgcctgccttggcctcccaaagtgctgggattacatgcgtgagccaccgtgcctggccaaaagattttttaaagtgtctttacagtaatacagatatatatatatacacacacacacacgtttatatatatgtatatgtatattgtgaaaaaacatgagcatttatggaaaaattagccagtgaatttacattttccacttgcattttttaatgtataattgttaaaataaatcagtctgccttcagcttgagtttttaatgtaattatctatccctcacgtgtaaatagttttgatggtatagtaccgtttgctcaaatttgggtttgagagaacagtaactctaattttttgatcttatgtgtattgagtatatggttcataattaatatttagtaccttaaataatgagtacattatgttattttattttttatttttttaagcctgtattccagagagtgtatattatcttggtcttcattcttttcatcgtggctgttttgttggtatagaatattatttctgtaattttcatgatgtcagtaactatggaatttgctttaatttgtttggccttgaactgtttatgaagtgataataacctaagtgctccagaaatatattttcttcttggcaagaaatataaattatagtcagacagattaaaaatgtaggagactttttagtgtaagaattggtttagactacttgtaaacacattatatttatttagtattgagctttaaggcatttgatttatgcccacatatcaagctggcatatttgtgttttcttcctcttgttatctggacagcagagaattccccatatggccatagggaggggtgttgatgtaacagtggtggatgacatagggatttgagctacatacttacacagattgcttgtgccctgtgtttctgctcatacttgatcatgggtaccacttccattttatattcttagggttattggtaacagaactagctcatgattgcaaactctcaacacatagtcacttgattacccatggtcaagcattctatttttatctggacccagtggcatggcagtaatagaggtatataactttccaccacagatggtatggcctttgacatgtgtgtgaagcctgcattgtgattctttcactggggcttgccataaattccacatactactttttccaacagtgacactaccaataactatagtatgtactgggtcatatgtgcctagctgcagagttgcatgcagggtagacttcactgacagcagagctatttcctaccctggctggaaagagctggcagcctttaatgtcttccagtatatgggctgaagcagcattcctaggagtggaatatgctgcctttagaacacaaagaggcctaccagatggtttgctttcttctttgtaatgggagttgcaagatgcataattggtcttttaattcagatgagctgtctgagaatgttcttgtccactggacccctaaatattttaccaatatcaaagtctctgaatctttgtaggttttattttccatcctttgaagcatatgtcttaagaaggtctctgttgcattattcttgcccatctggcccaattagcataatgttgttaatgtagtagaacaatgtaatgttctgcaagatgtccaacaggatcaaatgtattctgactatgtatgacaaaagagggcggaattaatatcatcctaaggcaaaagtgtgaaggtatactagtttcccctccatgtgaatgcaaactatttttgatcctcttttttgatagttagcaaagaacacatttgccgactccatggccatgttaatcttctctaataaagatatacatcttgcacgacacctgcaattttagttctacttggtagtaggtgtctgctatcctttaagctttgtttagtttgccaaactgatgatttaaatggagatttgatggggtccattatcctggcattatttagattctttagggtgatactaattgcttctacccactctctctggaatgtgatagtattttaaaatttattgtattatccaggggataaaagctcccagaggcttccactgtgagaaccaaagaccaaatgtggtaggtgttgtgccatttgttaagcctgtttattccaattctatatccagcgactgaagacatgatcactgggtgagtctgtgacccagtggacccattttgagctggaccttgtccagctgttttcctattgtctcccatcattgggctaagttctgttacagttgctcctactatcagctttggtctatggaggaaagccacgaaattcttagtgatgctagtgtctctcccaccatcatattcttcatggctttggtaattggcatatcctctggccctttccatagataaaatagcctggtgggttttctggcatcacatagtgtattgacttcagcatgtgcacatttttagacttttaatcactgcctttactgtttgctatggcagttccggcattttgaccttacttagcatgggtatacttttcatgttttacatgtttctaagagtcatccagatagcaagtgaacatcacctcttgtggcatccttgtcagaaaggaaaatcctgcatcttggcagaaggctttcaaatcagtaaactctccctaatccaatcataaggttctggccaccttgatcaagctcccctctgaacctagtaccacttgtactctcccacctcctgccaacatgtgctgtctagctgtctaggtttgttgttgttgttgttgttgttttgagacagagccttgctctgatgtccaggctggagtgcagtggttcgatcttggctcactgcaacctctgtctcccgggttcaagcaattctcctgcctcagcctcctgagtagctgggactacaggcgcccgccaccacgcccggctaattttttgtacttttagtagagacgggggtttcactatgttggccaggctggtctcgaactcttgaccttgtgatctgcccgcctcgacctcccaaagtgctgggattacaggcgtgagccaccgtgaccagcgaaggtcttatagattctttggtcgtatactctctttctttccttagcagtcccagcatgtacctagatgagttatgttgatacccaacccaagttataggccctctggccagtactgaagatgtgagcagattctgccctgcgccacaggtcatgctggagagtagcctctacattgtgtttaagcaaaggcagagtgctatctgtcttttaggaaggtaggatggatcatttctgcagtgtcagatgattcaggaaaatttgggaattcaaaatttgggaagactttaaggagcatcaacttctgatattcccattttgtgtgtcagagtcctttttcttctggggcttgaccttctttaattgacagatcttctataattggcagtctcgttatatggtactgaggagaccctctggctttatcagcctttcattatctttttctagagctcactggggctaagcagtagacatgcaattctagtatcttaatagttacccttcctcatgtttttcaagcatctagtacttcactcctgctatactattcccttctattggcatgccttcctactttatcactagtttaagtttttgcagttgcttaatggccactttgtgccaagagctatctgtgctccacctaccaccaatgatgagtttttcattgctagcctggcaatgtatgatccagctctcaaactccaacttatttcttactttagtataccattcctgaaacaagtcagagtttgagtcctctggaaagcagactctgaggtagagtttagtattcatgatgttaattgggagtacccttacaatcaatgcctttgcaagaggtagggggatgatgcagaattggacaaagggagaagttgagttgtgatgctcgatggataaccttagtcaaccctgtaaggattgactgaaggcaaaataattggtcatacttctccaatgttgggctggaatggccaggcctttataccaatacattgatcagtcattcaatatgggtcattctaggaagggtgtgcccttgagtgaagtgggcctgtgttcctcaggcagtttgtgaggtagcttgcaactgactcttcactgacagcactgctagcaacccagacaacaagtttttttttgaattatgatctgggcagcatatatccatgtctaccagaaatatccaaacttcagatgattgacaccaaataaaaatttatttttcacccattatacatgttcatcattggtgggcagggcagattttttttattattattatgctttaagttctagggtacatgcgcataatgtgcaggtttgatacataggtatacatgtgccatgtcggtttgctgcacccatcagctcatcatttacattaggtatttctcctaacacccatcaactcatcatttacattaggtatttctcctaatgctatccatccccaggcccccaaccccacaacaggccccattgtgtgatgttccccctgtgtccaagtgatctcattgttcagttcccacctatgagtgagaacatatggtgtttggttttctttccttgtgatagtttgctgagaatgatggtttccagcttcatccatgtccctgcaaaggacatgaactcatccttttttatggctgcatagtattccatggtgcatatgtgccacattttcttaatccagtctatcattgatggacatatgggttggttccaagcctttgctattgtgaatagtaccgcagtaaacatatgtgtgcatgtgtctttatagtagcatgatttataatcctttgggtatatacccagtaatgggattgctgggtcaaatggtaattctagttctaaatccttgaggaatcaccacactgtcttccacaatggttgaactaatttacgcttccaccaacagtgtaaaaacattcctatttctccgcatcctctccaacatctgttgtttcctgactttttaatgattgccattctaactggtgtgagattgtatctcactgtggttttgatttgtatttctctgatgaccagtgatgatgagcattttttcatgtgtctgttggctgcataaatgtcttcttttgagaagtgtctgttcatgtcctttgcccactttttgatggggttgtttgtttttttcttgtaaatttgtttgagttctttgtagattctggatattagccctttgtcagatgggtagattgcaaaaattttctcccattctgtaggttgcctgttcactctgatggtagtttcttttgctgtgcagaagctctttagtttaattagattccatttgtcaattttggcttttgttgccattgctttggtgttttagtcatgaagtccttgcccatgcctatgtcctgaatggtattgcctaggttctcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccttttcttgtttttgtcaggtttgtcaaagatcagatgtttgtagatgtgtagtattatttctgagggctctgttctgttccattggtctatatctctgttttggtaccagtaccatgctgttttggttactgtagccttgtagtatagtttgaagtcaggtggcatgatcctccagctttgttcttttggcttaggattttcttggcaatgcggactcttttttggttccatatgaactttaaagtagttttttccaattctgtgaagaaagtcattggtagcttgatggggatggcattgaatctataaattacctttggcagtatggccattttcacgatactgattcttcctatccatgaacatggaatattcttccatttgtttgtgtcctcttttatttcgttgagctgtggtttgtagttctccttgaagagaactccttcacatcccttgtaagttggcttcctaggtattttattctctttgtggcaatggcgaatgggagttcactcatgatttgactctctgtttgtctgttaatggtgtataggaatgtttgtgatttttgcacattgattttgtatcctgagactttgctaaagttgtttatcagcttaaggagattttgggctgagatgatggggttttctaaatatgcaatcatgtcatctgcaaacagggacaatttgacttcctcatttcctaattgaataccctttatttctttctcttgcttgattgccctggccagaacttgcaacactatgttgaagaggagtggtgagagagggcatccctgtcttgtgccagttttcaaagggaatgcttccaggttttgcccattcagtatgatactggctgtgggtttttcataaatagctcttattattttgagataccttccatcaatacctaatttattgagagtttttagcctgaagggctgttgaattttgtcgaaggcctttttggcatctactgagataatcatatgattttgtcattggttctgtttatgttatggattatgtttattgatttgcgtatgttgaaccagccttgcatcccagggataaagctgacttgatcgtggtggataagctttttgatgtgctgatggatttggtttgccagtattttattgaggattttcacatcgatgttcatcagggatattggtctaaaattctctttttttgttgtgtctctaccaggctttggtatcaggatgatgctggcctcataaaatgagttagggaggattccctctttttctattgattgggatagtttcagaaggaatggtaccagctcctctttgtacctctggtagaattcagctgtgaatccatctggtcctggactttttttgtttggtaggctattaattattgcctcaatttcagagcctgttattggtctattcagagattcaacttcttcctggtttagtctcgggagggtgtatgtgtccaggaatttatccatttcttttagattttctagtttatttgcatagaggtgtttatagtattctctgatggtagtttgtatttctttgggatctgtggtgatatcccctttatcatttttattgcatgtatttgattcttctctcttttcttctttattagtcttgctagtggtctatcaattttgttaatcttttcaaaaaaccagctctgggattcattgagtttttgaagggttatttgtgtctctgtctctttcacttctgctctgatcttagttatttcttgccttccgctagctttttgaatgtgtttgctcttgcttctctagttctcttatttgtgatgttgggtgtcgattttagatctttcctgccttctcttgtgggcatttagtgctataaatttccctctacacactgctttgaatgtgtcccagagattctggtatattgtgtctttgttcttattggtttcaaagaacatctttctgccttcatttagttatttacctggtagtcattcaggagcaagttcagtttccatatagttgtgcggttttgagtgagtttcttaatcttgagttctaatttgattgctctgtgttctgagagacagtttttttgtgatttctgttcttttacatttgctgagtactgctttatttctaattatgtggtcaactttagaataagtgcgatgtggtgctgagaagaatgtatattctgttgatttggggtggagagttctgtagatgtcttttaggtttgcttgttgcagagctgagttcaagtcctggatatccttgttaacctctctcattgatctctctaatgttgacagtggggttttaaagtctcccattattattgtgtgggagtctaagtctctttgtaggtctccaagggcttgctttatcaatctgggtgctcctgtattgggtgcatatatatttatcatagttagctcttcttgttaaattgatccctttaccattatgtattggccttctttgtctcttttgatctttgttggtttaaagtctgttttatcagagactaggattgcaatccctacttttttttgctttccatttgcttggtagatcttcctccatccctttattttgagcctatgtgcatctttgcacgtgagatgtgtctcctgaatacagcacactgatggatcttgactttgtcttttaattggggcatttagcccatttccatttaaggttaatattgttatgtgtgaatttgatcctgtcattatgatgttcgctggttattttgcctgttaattgatgcagtttctttgtagcatctatggtctttgtaatttggcatgtttttgcaatggctagtcccgtttgtttctttccatgtttagtgcttccttcaggagctcttgtaaggcaggcctgatggtgacaaaatctctcagcatttgcttgtctgtaaaggattttatttctccttcacttatgaaggttagtttggctggatatgaaattctgggttgaaaattcttttctttaagaatgttgaattttggcccttagtctcttctggcttgtagggtttctgccgagagatctgctgttcgtttgatgggcttccctttgtgggtaacttgacctttctctctggctgtccttaacactttttccatcatctcaaccttggtgaatccaacaattatgtgtcttggggttgctcttcttgaggagtatctttgtggtgttctctgtatttcctgaatctgaatgttggcctgccttgctaggttggaaaagttctcctggataatatcctgcagagtgttttccaacttggttccattctccccatcactttcaggtacaccaatcaatcaaatgtagatttggtcttttcacatagtcccatatttcttggaggctttgttcatttctttttagtctgttttttcttactttttcttctcgctttatttcattaatttgatcttcagtcactgataccctttcttctacttgattgaatcagctattgaaacttgtgcatgcgtcatgaagttctcctgtcatggttttcagctccatcaggtcatttaaggtcttctctacactgtttatcctagttagccattcgtctaatctttttttcaaggtttttagcttccttgcaatgggttcgaacatcctcctttagctcggagaattttgttattacctaccttctgaagcctacttctgttaacttgtcaaagtcattctccatccagctttgttccattgctggtgaggagctgtgatcctttggaggagaagaggcactccaatttttagaattttcaccttttctgctctggtttctccccatctttgtggttttatctacctttggtctttgattttggtgacctacagatggggttttggtctagatgaccttttgttgatgttgctgctattcttttctgtttgttagtttttcttctaacagtcaggtccctcagctgcaagtctgttggagtttgctggaggttcactccggaccctgtttgcctgggtatcaccagcggaggctgcagaacagcaagtattactgcctgatcctccctctggaagcttcatcccaacggggcagccacctgtatgaggtgtcggtcagcccctactgagaggtttctgccagttaggctacacgggggtcagggacccacttgaggaggcagtctgtttgttctcagagctcaaacgccatgctgggagaaccactgccctcttcagagctgtcagacagggacttttaagtctgcagaagttgtctgctgccttttgtttagctatgccctggccacagaggtggagtctagagacggtaggccttggtgagctgtggtaggctctgtccagtttaagcttcctggccgctttgtttacctagtcaagcctcagcaatggcggatgcaccccccagccaggccgctgcctcgcagttcaatctcagactgccgtgctagcagtgagcaaggctctgtgggtgtggtacctaccaagccaggcactggagagaatctccttgtctgctgattgctaaaactttgggaaaagcgcagtatttgggtgggagtgtcccgtttttccaggtagtctgtcacagcttcccttggctaggaaagggaaatcccccaaccccttgtgcttcccgggtgaggtgatgccccaccctgcttcggctcgccctctgtgggctgcatccactatccaactagtcccaatgagatgaaccaggtacctcagttggaaatgcagaaatcacccatcctctgcgtcgatcacactgggagctgcagactggagctgttcctattcggccatcttggaacgcctctccagatttttttttgtcattatttagggacccaggctgacagaagacataggctttcattgctaatcaaatgcctccaaccagaaacacagatattccagtagcttgcattacattgatacattcaacttctagggattgtaagagtataattttgtgccagaaggaaaggaactgaaatattttattgaacagcacaaatgtctatcaaaagtattgtatgtaattcttttttaaacttttagtataattgaagattgaagatgatgtcttggagatagtaataaagctgtcacttcctaccgctacatgtattgaaaggcaaataacttctagaagtagaattatgttttattattatttgcctaaattaattgccttcatgtataattacattactattactgtactgtaatgtttctcttctgcaggacttgtgtactttaaaaacaaaacaaaagaaaaccagaacatgactgagagcataagcactattttgtaaacagtgggattaaatgaaagtatacatacttaagagtgaaaccctctagctaccctttatccacttagggtcttcctaaaatgctgttagtccgatttatggtttccaggcaggagactggaaaattatctgaagaaatctgaccagcctaagagaaagcatgtagagatactgacatttggaggtctctaactgaaatggttccacctgatcagaatcccagaggtcaacatgtccttcttaagcactaaattcctaatgactctggtggtgcctcactcttaaatttgcagcctgttattattttgacaattacaaaaagttactaaatttgatcaaaatgtcaaacgagtaggaaaaaataagaaattaggggaaataaagataatccacagaggagattataagttaaatctttatggacagaagatgttacatttgtgaagcaaaatgtgagattttaataaaaatagttaattcagaaaagaaaaaaatgagctcttggaaattaaaattaggaaaacaaatcaatgatttgaagataaagtgaagaatctccataaagtattatgaataatggacaaatggaaaatagggtaaaaaatgagaaatttaatatgactgttccagaaaactttgtatctcagtaatagaattgaaaaagcaaagaacataacattttagacaggaaggaaattatcaagtgagtaattcaaaaatatgtttgggattgaagtacacaaattttaagactaaaagagcctactgagccccagaaaaataaatacaaaagactcacagcaaagctcattacaaaaagacaaaaagaacctaaaaacttatatagagagaaaagaaataggacaaataaatcatgagacttgatagcatagtgccttacaaaagcaatacgagaagccagaagagtggactaataccttcaatatctgaaaatgctttccatgttagaattctaacaccaatcaaatcatactaaaagtgttagagtgaaataaaattattttttagaattgcagattctcaaaaatatacctccaatgtacactttatttagatactttaggattatatctcctattgaagtatgagattaaataaacagatgaaatctaagaaatggaatatataacaggggagaaatatggagggaatccttatgatgatgtaataggcctagagagcagtaagttcagattggagaagaaagatggagtttcaggagggatgtctttacaaagtaaatgaaattgccagatatcttgatgtattagaagatattgagaagaaatgtacacatctggcaaagggttgggggagaaatagcagtagatatacagaaaggtaagcaaaaaagtgaaaatataatttgtggagaaagtaagttatttaagaataaaaatgtagtatgctacctggcttatctgtgaataatatcacagatatatactatcaaagataataaaaactgaacattagctgagtgtggtggtgtgcacctataattccagaaactctggaggctgaggcaggaggattgcttgagcccaggaattaatttagtccagcctaggcaatacagcctaggcaatatagcaattccccatctctaaaaaacaaataagaaactgaatattgctctaaacaaaattataatataaatgtatagagaatggagggagaggaaatatgcgtgtgtaagtctgtgtaagagcttaatcttcaccatctgaagaaggaagtcaggcatattatctgaaactgggaactaggcatgctgtttagaacagatgaaaatacaagaaacaaaaacaaaaacaaactctttatagctgtttatttagaattaaaagtgcttacctccatgattctggaatatgctttgggaagatagggggcagtggatttttttttttttttgataaaccttgtagaaatattggacttttgggcctcacacatgtatatatttaaaaatgataaaataaaagcaaagtataacagtacagaaattaaatgatgcacaagttagtggatcaaggataaatgttcaaaaattgggaaaattagtgcattgacatatacttggaaatatctggaaaatatgatatatgggaaaaattaagtttgatgcttaccagatatacaaaaataagttgcaaaaagattgaagaccaaaatagtaaaagccaacagaaaaacctttactggaaaattagagattatttttaaaatctcagtttactgagtaaacaagcacagatcataaggtgacctaaaggtaagaccaactttctgtaaaacaaggtttcataaactaagtgaaaaaaagatgctgtagcatggaagaatatatggtaatacatatagccagcaaaggattagtatccagaatatttaatcaagaatcctttaaattattaagaaaaagacaaaaagcaaatagaaaaatgtgcaagtcttaaacagtgatttcatagaagactaaaacaaataacctatacatgtgaaaataagttgactcaccagtaactggaaaaatgtaaaatcaaaccattcatcagattggtaaaaattttaagtctgatagaactacatgttgtagagaatataaaacaagaggaactgttgtacactgctaatgtgagtcaacacaactactttggggagcaaattgggaaaatctagtaaaatcgaagttgtgtcttttcttatacctcttggaaatctagagaaacattcaaaatatgcacaagatacatataagagtgaatataccaacatgacttgtaataggaaaaaaatctttaaaaaggctaattattaacagcttaatgggtaaatattttgtgtagtcataacatggaaaactctaacatggttacaatgagcacacagtaccacttgtatctataaatttaaatgagctgttgaattgacatttctccaaagatatacaaatgtccaataagcacatgaaaagatgctcaacatcactaatcattagggaatgcaagtcaaaaccacaatgatatactaattcatactcattaggatggctatgataaaaaaacagaagataacaagggttgacgaggatgtggagacatatgaacccttttgcattactggtaaaaatgtaaaatggtccagctactatggaaaacagaatggcagtttcttaaaaaattgaacacagaattactatatgatctgttaatcaaatggacctcatacaagttatttaccttcatgtaggtctgattcttcatttctaacatagggtaatacctgctccatcaatttcactggattcttataaagaccattttaagatatgcgatgaaaacactttggaacttttatgtgtacttaatttataaaagtatacagtttatactttatataatttcttttgcaccaacctaatagtgctacaaacatataatgtacatttattaaattaactctaacatgtaaaattggcagtcttaatctttatcataggcctccataataatattttctaaaatgtgatcttcagagcattgactcttgaggatcttaataggcattatgtgaaaagtgcttctttggataaaacattgggaaaacactgtgttaaataaagttaggttaggtttctgtacctttacactctctcttttgagaatatttaataggcagatataccatgtggactaaaaagacagattatacactttttcgggggagatttgtgtttcctggattatactttagcatatacaggtcaacatatattttattgttctcagtctttcagcatcattctctttttttttttaattatactttaagttctagggttcatgtgcacaacgtgcacgtttgttacgtatgtatacatgtgccatgttggtgttcagcatcattttctaaacttacagttttggtttttataattttttgatgttcattaataaaatattgagttgaaaccaaatttattttattattgttatagatgtaattacttaaataagaaaacaagtaattcattactttaacttttacaactaactgtacttaagattattttcttgttccataaaggcttttacctaaacaaaattaatttgttttaaaaaatcttgtatctatatgctttcatgaaataccaaagcatgcctttataaatatgacatttctaagaagttgaaatctaaaacactgtattgagaatgttcctagtcactgaatgatgaattattttaaatctcaaatttacgttagtatatatgtcagttctgagtttatattgaaataatacacatttttcttaaccactttccatagtttctatatagttcatagattatttatgattttcattttttatctagaagttttgcagttaaaataattcccttctatataaaaaagcttttttgagaattcaaatcattaaagtgatttaaatgttttatcctgatgattatatttttaggtattctttcagtgaacattgtatctgccattgacttttgtatgcatacatgtcatatttgatttagtatttaactttcaaagaggtgtgccctatactgacattcataagttttacttggaatatttaataaatatatgtcttcgaaattatcttccaatataaaatacctctaagttcattcttttcattttcttgttctcatatgcttaaaattatttgtgagaattctaggcaagagttatttttatttaatgaataatgttagttgagtaaatacactaaattgtaggtcatggaaaattaatgagaatttttttttgcttcctgcttatgcatagtgtatctttaattcggccaatgatgttttcatattatttgtcttagtttattcttttatttcattttttgtttttctgttttcttttttctagcttgtgatgaatggaaaatactaccaaaaccaaatcttcatagagatgtcaacagatttggacactctgcagtagtcattaacgggtaaaagaagcacatttccaatttttagagggtcacttatatcagtcatactatcctcatattctggtattctttttgaaaattatcattggtacttaatggtattggattttatgcatctcttctctaccatagaatgcattttgatttgtcaatcatatctttttttcctttcttgtttaatatatttaagggacatgggagtaggtaaaggaaaggtgctgagataagacatcagatacccttttatgtcatcctgccttcttttctttttccagagatcagataaggaatgactcttcttttaaaaagatggaactgaaatgatagagaggctagccccatatttctatcaaggagaacaaggaaagtgagaagaattagattctcattttagttctgtcatttactaaatgtgtgatttttgacaagtctcttaacctctctggaccttaaaatcattatatccattgagaaattggactcaatggtcattacattgccttccccatttaagttaatataatttttgtatttctatggcaaaaatttggtaatttggaatccagtgacagtaaacaatctgctagctcatttagtggcttaacatttgtaaatcagaatgacctttttataagcccattttattaccaccttatcctaaatatgtaaaaattctccactattgccacaaaatgacttaaccacaatgaaactgtgtaactgatatcaagtggctgtccaaacagtaatacatgaaaactgtgaaacataaaacctccagggttctctggttgatttttattttacttttttaaaataataaaagacattcttgaagacttttttgactgattcaatttattatgttaataatatttttgacatgaaaaatatgctgttttaagggcattggcactgcttggtattaatttagtattgtctaggcttctctttccagactgaatttaaaaaatctttttgattattttactcttagttttcttattttaaaagaatgaaacaccataagaagaactcggtatctaatttcaaaattctgtgtctatattgaaaagttataattctagatagcagttctaaagtgtgtcttgtccatgtatagctattatctatttttttaaaacattgttttctatattattaaaaaaatacttatttttctgacaaaggaatattgtatataatcattgtttcttttcctttcttgtattaacaataaaacatgttttgaagacttagtgttttcttaatatattaagatttatagaatatttcatattttgtctggaaagtcttcaagaaattatatagtagttcctctggtgtttttatatcatattgtatgctagaaatatgattttaaagaacagtactaacagaagtacttaaaatagtataaaatgtatatttaaatctatgcttatttttataactaaatcagtagatagggacttttaatagcgtttctttaagattcttgttttgtttttaataggtccatgtatatatttgggggattttctagtgtactccttaatgatatccttgtatacaagcctccaaattgcaaggctttcagagatgaagaactttgtaaaaatgctggtccagggataaaatgtgtttggaataaaaatcactgtgaatcttgggaatctgggaatactaataatattcttagagcaaagtgccctcctaaaacaggtaaatttctttttcttttcgtctttgtggcagcaaaatttctcttctacagaagtagaaatatcttctgcttataagaattactttagtagctacagaaatgaaaaatttgtattaccctaattaggaattctaatgtttgaacctagtgattaataatttaatacatttattagctatttttagctttatttttgaaatctgtatatatagtatatatatcaatattttatatataacattgtcatatatatgaattattttctaatataagtttaaaatgctttccagtacatcatttctaagaagtgctgttagattcaaagaaataaaatgaaataatttattttccatgtggtatttttttttcttcctgaattattgccaaaccacaccataaagtaaaaaaatgttacagcatttcatgactaatgatctggttttatatttcttataaaatggtgaataaataaatgagacttatgaaaagttaccagtcaattattaatcagttagctaattaattatttggataaatattgtttagttttttaagtgctgagagtttttatacatttttgcggttacaattaataaatgtatttttaagttttactaatctatattaattcagatgtcttttatatctttagaaaggatgataaacagtatttgttatgatgttttcttttgtatgtatagtaatacactttgttcagtaaaatatatgtaaatcctttgactttctctaaaatacgtaaatttatttattttagtttattttttgagacagagtctcactctgtcacccaggctggagtgcagtggtgtgatcaaactctgtctcctggtttcaagcaattctgctgccttagctttccgagtagctggaattacaggcatgtgccactatgcctggctaatttttgtatttttagtagagatgggttttgtgatgttggccaggcttgtcttgaactcctgacctcaagtgatccgtctaccttggcttttaaaagttctgggattgcaggcatgagctaccgtgcctggcccaaaatgtgtgaatttaaaatgtctgtaggatccttgtatattgaataattaaaatgggggtaaaaggtcttgaaaatcctgtaaacacaattgaactacaaaagttgtcttaatctttagaaaacttactttgaaattgaaggtcatttctttggttaaaaaatgtcttagtgattcttaatgattcttaaatagatattgtaaattaagaagagtaagattttcttttccgtgctgatatatcgtcccccatttgtattatagctgcttctgatgacagatgttacagatatgcagattgtgccagctgtactgccaatacaaatgggtgccaatggtgtgatgacaagaaatgcatttcggcaaatagtaactgcagtatggttagtatttatgggtaaatggtgctgtagttacaacagactgctgctttatgatcattagcttaccatttagtagcactgtagaaaaaaagcactttacacattaagacatttagaaagtatatagggaatcattcacttcttggcaaattgtgaagttagattggtttgttgttcaaatttgtcagtctagattccattttggatccatcaactttacttcttttcatggatgagactgggaacattttttcaaaactgatattgaaaaagactatagctataaatgttgtcttctgttcctatgaaaataagattatataggtaggtattgaaataatttccattggattcctgtcagacatgcattagtggtcgtgtggtctagtgctttgttttcacactttgtgtgtaagtttaacctgagtttttggtagttgtagtttctcttttaactgtctatacattagtggttctcaagttgaggcaattttgtctcacaggggacattttgcagagacattttggttgtcacaaatgtggagctgctattggcatctaataggtagaagcaagggagctgctaaacattctacagtttgataagattttttaacgtcctttttcatctaaagtagagttttagcactattgacattttgagccctataattatttgtttatttgtttatttgttgtgggagggctgttctatatattgcagaataaaaaaacataaaatatttatggcagatgaaaatgggttaagagaagcaaaaattaagattttaagtggtagcatctaaacattctatgttatgtagaagatatcaacaaattgaagggaaaaattttaaaaagtagtatttagtagaattaaagatttttttgttttgttttgtttttttgagacagagtctcactccatcacccaggctggaatgcagtggcatgatctcggttcactgcaacctccacctcctgggttcaagtgattcttctgcctcagcctcctgagtagctgggattataggcaggcaccaccatgcctagctaatttttatattttagtagagacagggtttcaccatgttggccaggctggtcttgaactcctggcctcaagtgatgtgcccacctcagcctcccaaagtgctgggattacaggcatgaggcactgcacccagcccaaagattctttcatgggcctatagcttgagtaaaaataaatagcatggatacatatttccaactgaatataatgtatcattttttcttttttggaaattttattactgaaagtatctacttgtttttcaagatagcaggcagaggtaaaaggcaaagaaaagggagttgaaactaagtaaaaaatttgattgtataattaaaaaaattcttcactaattaataattcaaaatatgtaagttttatgactttaatctaattttcagaacttaaaatggagggaaatttgcagttactgactcattagattgaacccttttgttttcatacatactctgttgttatatactttccagtgatacaagttgttttaataacaagatatacttcaattttatttgagttttaacattaatataacatggttatgctttgaaaatttaaattacgtttgaagatatccactgatattcatctaatgggagttattttagtagaagtcggagttaaataaaataagacatgggaatcagggacttgtattacagttcttcagagaaacagaatctgtctatatatatatatacacacatacacagtttatatatataaataaataatatatatttgtttatatattatatataaatatataaacatttgtttatatatttgtttatatattatatataaatatatttgtttatatattatatacagatatataaacaaatatataaatcttttatatataatatataaatctattatataatatataaatatctgtatattatatataaatatataatatatatttgtttatatataatctataatatatgtgtatatatatatataaaatgagatttattataagaaattggctcatgtggttatgaaggatgaaaagtcccaggatctgccgtctgcaaactgaagacccaggaaagttgatgatgtaaattctactctacgtatggaggcttgagaaccaggagtgcagatggtgtaagtctcagtccaagagcaagaaaaggcagagagaggaaattctttcttcctctacttttttgttctttcaggccctcaattgcttggatgacgcccaccatagggagagcattttactttacttggtttaccaattcagtctcatccagaactgccccctacagacatatccagaaataatgcttagcctaatatgtgtccaccccatgtcttggaaaagttgacacataaaattaaccattacaagtctaccccttgtcaacttggcacctatacatatctacataaaccatacttaattttcaaatgaagataataacaaggtcataattctacctaacataatacaagtatcctgtgtacaactggaaaacacatcaatctctttcccagaaaaggaggtaaagtcctggagtgatatttactcctctccttgatattctgtaaattaaatactatgatgtaaaatcaacagtacttaaattctgatatgagcatcttatgttacatgatgagggaataagagaagaaagaaaacaaagatattacacacacacacacacacacacacacacacacacacacagatgtattcttagcaaaatgaggaggaaatacagtccttatttctgtaagtgatcatgtggttgtagctaatatttatacatatattcttttttttattatactttaagttctagggtacatgggcacaatgtgcaggtttgttacatatgtatacatgtgccatgttggtgtgctgcactcattaattcgtcatttacgttaggtatatctcctaatgctatccctcccctctacccccaccccacgacaggccccggcaattcctcaacgatctagaactagaaataccatttgacccagccatcccgttactggatatatacccaaaggattgtaaatcatgctgctataaagacaaatgcacacgtatgtttattgcagcactgttcacaatagcaaagacttggaaccaacccagatatccatcaatgatagactggattatacatatattctcacctaaccattttgtatttcctttaccttcagcaagcaccttacctgcttgtagttttttatctgttggggtgactcaaacctttattcttgaagggtcattcttcattagtagtcctgcttgaattggattgttgtagttttccattgatcttaatcacagggtaatataatttggacatttgtccctgcccaaatttctgttgaaatataatccccggtcttggaggtggggcttggtaggaggtgtttgaatcacaggagtggatccctcatgaatggcttgggccacccgcttgttgatacgtgagctcttgctctgggttcacttgaggtctggtcgtttaaaagtatgtggcaactccacctccattctcactcttgctcctattctgccatgtgagatgcttactgccactttgccttctgcaatgagtaaaagttccctgaggcctctgcagaagcagagcagatgctggtgccacatttcctgtaaagcttgcagaactgtgaactaactaaacctcgtttctttatgaattacctgatttcaagtattcctttatagcattgcaagaatggcccaacacacagggtgtagggtatggtaatactgaaagacgccataagggatctcttgtattctagacatattcttcctagcctcctgtgtgaagtggcagttcagtttccctgtactagaagcagtcaccccaatgagcacagtaactcttctttgactgatgatttagaggtgtaaggaacccaaagtggccaagtggcagtcttaatttccaattctatggaatcagtgttgtgttttctggaaaaaattattccttcctctggaattaagacatctaggtcagcaaagaataaggtcacaggaataggaagaaaaatttcgctaatgaattactaagggcagtagtgagtagtaccactcccatttccaccccttgattattggacccataaatgctggctgtgagagaaaaagcaccatatattggatgctgactcagagcttatatggctttctggagaacccttctgtcagccttgcaaggtattactacgtagctggcactgtaactgaatcatcaaaagcccattccactgttttatgaaacgagttgcttgacaattgtagggaacatgataagaccagtgagcataggcccattgctgtcctccatgtgctgtgacatgagttccttggtcaaaagcaattctgtatggaataccaagatagtagagaaagaattctgtaagtttactgatggcagttatggcagaagcattgtgagcgaggaaggcaaatctatagccagaataaatgtctgtttcagtaaaaacaaaatgcttccctttccctgattgaagctgtatcaaccttcctccaggtagctggctgattacctagggggatggcaccatatcaggagctcagtgttggtttctgctactggcatattgggtactcagcagtggtcatagccaggttggcctcggtggatggaagtccattttgctgagcccatgcataatctccatccctgccaccatggccactttgtccatgagcccgttgggtaatgacacaggtggctagggaagaaggtatccacagaagtggtcatcttatccatgtgattattaaaatactcttttgctgatgtcacgttttggtaaacatttacgctggatacaagtatcttcacttatttgccattcagtgagatctgtccgcatcccttttccacaatttttttttttgtcaccaattttccattcatgttccttccaagttcctgaccatacagacaaaccattggccacagcccatgaatccatacataattgcacatctggccatttcttcttccaaacagaataaacattgagaagcactgtttgattttgcccactggaaagatttcctttcactactgtacttcagggaggtcccaggaagggatagcagaacttcagcagtccttttttgggtggtacctgcatattgtgcagaaccatctgtaaatgaaaccagtcttctcttcctctgtcaagtgatctagggaacttctcttgaagtgataggtcagactgggagagagaaggcagtgtggcagaagtggggatcatgggcatttgggcctcttcatgtaacgtagttgctccttcagggcctccttgagcctgatcatgtatataccacttttatttgatgatagagtgccgctgtgcatacccaacctcatgggttggtgggtcagataacacccagttcatgatgggctgaaatcacataatttggtgacccatggttaaacattcagtttctattaaggcccagtagcagactaagagctgtttctgctaaaggatagtagttatctgcagaggatggtgatgttttgctacaaaatcctaagggtctgcactattatttgcctataggggcctgccaaaggctccaaacagcatcctgtctgccactgatatttcacgtaccattgcacctgcaggatcatgtagcccaactggcagagcttgtatagtactctggacctgttgcagagccctctcttattctgagatctacttggaattcgcagctttttagatcacttggtaaatgggtcaaagtaacataccccagtgaggaatgtgttacctccaaaatccaaagaggcctattagacattctccctcttttttgttttggttataggaggggccagaggcaacaacttaacattcacctttgaaagggatatcttgacatgccccatactgctagacccctagagatttcagtgagttagaaggcccctgaattttagatgaatttatttcccaacctctgacaccaaatatcttgccagtaagtctagagtagttgctacatcttgctcactaggtccaatctatgtgatgttatcaatattatggatcagtgtgatgtcttgtggaataaaaaggcagttaaattcctcagaactaagttattaaataggagtggagagttggtatactcctgaggtagaacagtgaaggtgtattgctaccattgccagctgaaaacaaactgcttctggtgatctttactaacaaatttcaagaaagaagcatttgccagatgtttagctgcttgccagtttccagggaatgtgttaattgcccaagcaatgaaaccacatctgataaggcaattacaattggtattaccactcggttaagcttatgataattcactgttattctccaaaatccatctgtcttctgcatagactaaataggcaaatttcatgggaatatggtgggaattaccactcctgcatcctttaagtccttgattgtggcactaatctttgcaatccctccaggaatggagtattgcttttggcttaccatttttctacatagaggctgttctagtggcttcttcttggcttttcgctccgtaattgtcctcactccacaggtcaaggaaccggtgtgagttttctttcagctgctgagtatgtctattccaattatgcattctggaactgggaaaatagccacaggatgggtttgggacccagtgggcccactgtgagagggacctgaactccactgatcatctggcagtcataagcctctgactggtggcccacagtgatgttttgggtctcctggaattaatgtcagtttagaaccagcatctggtactgatactgattatttccctttccccagtgcatagctaggatttagtaggatttctatatattttactcctaggagcaacttcatgctcaactcaccaatgccatagatgtaagcaagtcagactattccaattgctgctttaactctgctgttcatcatagtaacctcacccaccttgcctttgttagttgagtgctgctacctagcccctgccaacctagatccaattattcctgttgcatttatgtttcccaattcagtggctgcacttcccactgcaaggctgggcatacagaaaacagcaatcatggagctcttcaaggatgccagtgctcccctcccaagtttattcctttcaatactggtgaaaggtgtgtcttctggaccctctcagtgagggtgagcagatcttaaaggacaaatccactctaacattccaatctccctaagccattaaatgtcttctatattaaaccaaggcagatccagcatttccaagtcactcactgtgggccaccttttggtctatgttttagccaactaacagaaagagccctttctaactctccaagctataacatcaaatgtataatttctgcttagtgagcccatatcaataaattttgcctgatccaactttatgtttcgtctatcattttccaatacttttaccgttctggaggctgggaagtccaagatcttggtggtagtagatttggtatctggtgacggcctactttctggttcacagtagatgtcttttcactgcttcctcccctggtagaaggggagctcttgtgtcttcaaccccttataatggtgttaatcccatatatgaggactccaccattatgattaaattacgtcccaaaagttgcacctcctaataacatcacattgggattgggtttcaaaatatgaattttgggagatgcaaacattcagtccatgacagacatttacatatgaaaatacaacatatctgagtgaaaacagacatatcttaaaaattgtattatgtaaattgctatcaagtatttataaagtggcattttgctttatattttattcaatgatgatgtgttaacaaggaaaacattgggtgagatagtgtaagagagcagatggtactcacttgtaatttagaatttgatgtaatgtgtcctttagacagttttatcagaatgtcttgtgattaagctaaaccaaatgttaatggcaaagagaggtctttgggatttcagtctagattatgtacattgatatcctatttcatataggtcaaacaatgtgctttattctcacatattttcatttacaatttacatgtcagtatattagagtgaagatcagtagagtagtggttactattcataagcgtgtctggttcattaggccaaaaatgccagctatgtttcagaataatagctttcttttaccattgattaacttggctctatgtgtgattgaaatataatttcattttttgtacttgtttagtatcaataaatgactatatttttcttaatgaagagcagtagagttatttggatggagactctgttaccattgttattctaaagattgacataaaactattattctttttcttattccaacatgtttagccattctcatgtcatttttataggttattttatttatctgatacttcaggtaaatttaattatttttagttagctatcaaatgtttagaactatactgtaatgattatatagaataatgctaatatttatatactatatgaaaacaaaaaattatgaatcagaacaaataacaataagaaagtatgtttctaatgaaaatgaagtggttgaaaaagtcataaaatgatttcaaatttacaaaaatgtatcttctgtaattttttaggatgaataaagataaaaattatatctgggtactttttatctgctactttacagtaagtgtaaaatgctctaatagaaattaacacctttggaatggaggtgatggcaatgtattttatgaaggaagtggcttataaataaatacttggtgagtgacatttaaagtctctaagtggttaaaaattgcttcaataaattttatctataggatagctataacttaattttaactcttaactttattgagtgaaaacaaatatttagctccattacatgagaaggcctgaggtatttatacctatagtcaaaacaaaacaaaaagattgaggtgggggctcaatgtttagcattaaatctttgtatttttttttcttataaagtagagccacaggaaaagctgagccaaaaattttaatatctatttttcatgagttaggttttatcataggtattgataatatgtgaattatctgaacctgggtatatgtaaggaaccaccatcaaagtttctatattgtctactttttttctttattggaaattaacttttaatctctcaatgccagattagttgaaatatgattacattatgtagatttggaaacaaaataaaacttttgcagattctttgaagcctcaatggaggaaatgtgacagatatatacagaagaaatctcaatcaaccagaaccattatttagtgtctgtggaagtaaaattagtttgagttgtgacagtcatttatctttttatattgtattgggttttgataaagcatctttttaccttttactacttttcatttctgcctcattcccaggggtctgcatgatacttttattaagactagaaccattttatgtcatcattaatggaaatgactttgtacatgactttattttttgaattggaaggctgttttcgaattcactggaaaaagttttcattagatggtgcctgtttaaaattatgtaatttgcacacttcattttttaataaacattcattccaattccaagaacaatagtttaacttgttaaaagaaaaacttgggacaaaataaatttagcagagcttatttgaacaaagattgattcatgaattgagcagcattctgaaccaagagcttcggacacctccagctatcaatgtgagcaggaagtatttttagacagaaaaaggaagtgacgtttaggaacatcttgattggctacaggtcaccatttgccctatttgggcatggtgtgatgaggcatttaccttgtatggaaatagtctgatcagttggcagcatgtgtttggctgaagctcagctgctgtgattagctgagactaagctatctgttgtaagaatacactcaaattatgttgcagtttgtttacatactatatcaggccaaatttaatttaatctccccttttggccagctgtcagttttgagaaattgaccaaaaaccttaggcactaatactactttctgtcactatcataatggacttgttttgtctgaatatggaattcacaatttgcaatgtcaagtcagttggatgatttttttatattctctttgtgtttttattattttaactatagtgagaccatctgatatataacagatggctgcatatgaacatataagacttgagaggggccgggcacagtggcatacacctgtaatcccagcactttgggaggccaaggcaggtggatcatgaggtcaggagatcgagaccatcctggctaacatggtgaaaccctgtctctactaaaaatacaaaaaattagccgggtgtggtggtgggcgcctgtattcccagctactcgggagggtgaggcaggacaatggcatgaacccgagaggtggagcttgcagtgagccgagatcgcaccactgcactccagcctgggcgacagagcaagactctgtctcaaaaaaaaaaaaaataataataataataaagactcttgagaagatatggcatactaaggagactattataataatgactatcatgagggtaatattaagagactgaactatacttcttaataggtgcttccatgaatcaaattggtcaaaatcaaatatatcaacaacaagccagaagaggaatctacttgttttaatcaattatcttgtttgttgatttcttaaaactgaatttctatcatgtcggacataattttccaagggcaataggaggtgtcatctgttgcacacactcttccctcttcagtcaacagataggccaaagcaaccatgttatctaaaacaactttagcaagagaatttaaagatgtttgatgggcaactgtagccaatttctgctatagtagctaatgtttgcgacagatttctaatcatagtctcatttacatttatgccaagccagggaaggagcattctaccaaaagatgcctgtttagggatacttagacttgcttgcaaactcctctttattctatagttaaattaagaggtgtagaccaatgttcaatttccaattggttattggaaataatcatgacaattctaacagtattactgttaaaatccctattcaacattttccacttattgagacatggagttgctcacatatatggttggttgttaaatcctatacagataaaaatataccctggtgaggcacgacagacagttccttgccttgtgtgttaggggccacagtagagaagcactagtaatatttctccaaggctccattatgaaatcattgcatggttgaaggatcttgacaattaaagggattagggtgataaatttctctacaaactgttgaattacctttcttttggttatcctattccatttctggcataatgtaactgcaaatccctcataggttttgactactgtcagatttaaacgaagaacctgatgtgtgaagctaaaagcctaaccctgtacaaaggaccagatattgctcttagaacatcagagaaatttgttagaaggtgaagcagagaatctctaagatcatttaaggatttgtgtttaacataacatatccaacattcagttacgttgcctgcaaaagctattgattatgaaatcataataagcatgttatcttcctgggtatatataaaaaataaaaacagagaaaagaggaaaaggaccatggtttcatggtgactaaggaaagaagtcttgatctgtcttcttgggaaagctttcatgtctaggatgtcatttgtttctgaggagaaaggtccctggtcaattttgccttgaggtttccagtgggtgtactgtcctgagactgggaagggtcctcttaaattgagaaatgtggatccaaggctcaggctcaaggccctgaagttttgctgcagagaagaacttcgtgtagtcccttacagctgacttcaagggcagtctttctctggtgtctcttttgaaaagacccagtctccggggtgtagaccatgaaaagtctggttgtcatcagttcgtgggggcttcttctatctggtgaaaatataccttggcaaaatgcattaaagccttgcaatatcaagtcatgtcagagtttataaaagcagtaaatacatgaggttctattattacgggcgtaggccttccagtaaccattttataaggggtcaatctatgttttccagtgggagtggatatgattgccattttaatttgtaatacctttgaacaaggcagtgtagttagctttgcctaatgccattgtgtttataataccttatttgaatattttgcagtttgtccattgaaacatatgcctctattgctgtgattggctgggactcaactatctgttacaagaatatgcttgtaagttaggttgcagtttgtttaatcctaaattaggttgtagttcaccacttgtagaggcagcttcaggccaaatttaatttaatttaataaactaatgaaataaataagggagagtctgattcagttgaattgtatttggagttagaaatgtttattttaaagttcaccagaggatttaaatatacactgaagtttaagaatcattgctgtacaaaggtgaaaaataacatgctcttttaattttgtagtctgtcaagaactacaccaaatgtcatgtgagaaatgagcagatttgtaacaaacttaccagctgtaaaagctgttcactaaacttgaattgccagtgggatcagagacagcaagaatgccaggctttaccaggtaaagatttcaaaatttagtaaatgagtttatggtctacagataaatactgacatagaaaagtacatttagtaaggacactacattttctaaaattaaagtcatagtaaatatcaacctataatattgtagtactaataacactgtttctacaagaaaagttttttgattacatatttgcttccaattattttaaggtgttcatatgtttatgatactgttgaactgattagataccttttcatcgaaaaaaatcttaaaaatgtagaaaataataagcactcagacttaatattcagatttaacaaatactaacattttgttatattttatttaagtgccttttattttccaaactcagtgcatattttcattatacattataacatttataaaaaatattttaaggcaacaataatatagaacatattaattatatattatatattttgcctctctgtatcctaaaatatatatattatatattttccctctccatatcccagggttttaaaaatattatatatataatatattaacaataaatacataaatatattacttatataatatgtaacatatatttattaaaattatatatctagtaattttaactaaatatataatttatatatttaataaatttaaaccataaatttatatatttattatattacatttataatatataatataatataaattatattttaatatattatcctatataatataattttataataaatacatttctttttttatttttttaaaattattattattatactttaagttttagggtacatgtgcacaatgtgcaggttagttacatatgtatacatgtgccatgctggtgtgctgcacccattaactcatcatttagcatcaggtatatctcccaatgctatccctcccccctctccccaccccacaacagtccccagagtgtgatgttccccttcctgtgtccatgtgttcacatttcttataataaatatgtgcttttatgagaatccgaattttataaactacagcaaagctcatttttaaaagtaatttcattttttcacagttaacattgctagtggatgctaagtactcttcctttgaaatataaaagataaaattagaaaattgaaaggtaatacaggcatttaaccagttctgcttgttatacagataaactgagatccatgctggttaagtgatatgctcaaaattatgtgacttgtaaatgacagagttgtagctattaactaggtgttttatttctgtttagtattttacctctctttatcccaggttttttttttttaaaggtggaattatttttttattattattatactttaagttctggggtacttgtgcagaatgtgcaggtttgttacataggtatacacatgccatggtggtttgctgcacccatcaacccatcacctacattaggtatttctcctcctaatgctatccctcccctagccccctacccccactttttttttaaagaaaagtttctgagcctatttaattctaaaacatattggaaaattccatcacagaatttgtctgaaagagaatctttcttacaagttaatgtgataaaaatcaaaattattctgcctttaaaaatgccattgcggtcaggtacggtgtctcacacctgtaattctagcactttgggaggctgaggtgggtggatcacttgaggtcaggagttgaagaccagcctggccatcatggtgaaaccccgtctctactaaaaatacaaaatttagctgggtgtggtggtgggcacctgtaatttcagctactcgggaggctgaggcaggagaatcacttgaactcaggaggtggaggttgcagtgagcagagatcacgccattgcaccccagcctgggtgacagagtgagactctgtctcaaaaacaaacgaacaaacaaacacaccattgaggcgctggaatgtcattcatactttgaattttgtttacatactggcccttaaagcctttaaacagtgcgatgtgcatgtgtgctcattttgagaaagatagtattaataatgcagtaggcagggtttaagaagcaacagtgagatgatactaagaagttgaaagtggtattggtctctcagaattaaactataaaatgaaaatgtagatcaatgaaaatatttacaaagtttcctgaaaatgacaaggttaatcttggaccaaaataagatttgaatgaaggaatgtatacatttcaaggaatattactttgataagaatggaaattagttgccagtggaagtttggaaaaatgatagtaaagttacttttggtagtactcatctactcattccctaggaaaaaaatgttgctttgttataaaggctccacttgaccaggctattattttggaaatgtaatgaaatatattatgcacaaattctcttttcttaattcatatttactaagcagccaactggttatatatcgtttgatttccattcagcttatctcaaggaagtgaatgctctaaatagagggcccagtctgtagagcagttgtacaattccatgacaattggtgtattgcattttttttacattgatctcatatgagcttggcaatttgaatttatctcactaaactcattataaattaattgccttccttttaaccccactgctaagttgttgcttaatactacaaaagcctgaagtataaaaatatttggtttggtagtataatttagtttagccacaaaggcccatgcatttgtttttatttgtatgatttgtcaatgaactatttttgttctcactaaaaaataaatgaggagacaggcaataataatctaaattcttccttgattcagtaaggtgagaaaaaaccgtaatttaagaaaacgtttgcattgtaaggaaaagttttttggtattttggatttaaaaggactgtgaaaattgaaacacatatagcttcaaactgaaaaccagggcatgctacacagtcttattaaatgataattatagtttattgagggattactatgttccaactgctgtgagattttcatggtacccaatttaatccttagagcagcaaccgtgaacgaacaggagtccccaagatgctttcgagtgggtccatttggtgaagactaatagtactgagacattatttgcttttaaaattttccatttgttatgggtttaccatggagttttataacggctatctgttgtatgctattccaatagactgaatgtagaagaaggtatgagaatatagctgtcaaatgccaaatattgaagacatttacaaaaatataaaacaataaaaataaaatatgctattaagttgtaatgttccccttcaacattttgttatgaaatattaaaacagaaatattaaaaaacagaaataattgtggagaggacacccaatacctacattctagattctgcaattaacatattgctctatctgcactatccctgatctctctgcctatccatcccctattcattcattaatccttctttattttttgatgctgaggtctaatttgaattgtcagctactttccctcgggaagggaatttgaggatacgtttcctttgggcctatttgtataccatagtggggcaagacatctcagcagctggaagagtgcatttatagtggggtttaaaattattattttaaatgaataaatacatgtatttgttaaagttaccatttttaattttaaaaccatttttaattttaaaacgctccaaatcagtagatatagcatgcataaagagaagttctgtgggaccctcaataatttttaagacttaaagaccaaaaatttgagaacagctgctttagaacaactttataagagttgcagcaatatatccaaggtccttcatacagggctagaggcgctaatacatttcatatgatatagaaactaaaatgtaatctaactttatagatcagtatatcaatgaaacactattattaattagtgcacactaaagtttagccttattaatatattatataaacctgtgttttggaaaacggtgtttcaagttcaatttggattctatagataaaccattattactgaacagtatgtttcatttttagaaagacatgaataattgtgtaaaaataaacattagcaaggaaagatcatagctactttactaatcataagtgaaatgagacttctctacccatgcttatgaaagaatcagagaacccaacttataccacaactatatacctgagctatagaaattagatttagaggtcaattagcttcacttataggagtaactttgaaactgcttctgttataagcttgttgtttttctattaaagtaatcttgtcttatgtaaactagaccttgggacataaatatagtagtgattttacttattgaaataccatatgccaatataccagatgttacacagaaaacctagcagtcaacacatttaacagatgtcatagagccataatttatctcatgtttaagatttaaagaaaaagttgggatgttctgctttcattctctaccaaactattagaaaaatttatttgaaatattgagatatttaatatgttttatttcaaaaataatttaaacaaatacagaagtactttgaaataattgaaaaatacatttgctttttggtaatctaacaataagacacattttttttcttactagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacaggtaacatttctacttgtttacattatggaaatatgctatgataatttcataattatttgaaatttttttttggttttaatacattattgttgctaattttggaaataaaagtgaaattgatttctcaagtgaattggcagaagacttattttgtataagtaataaggtaataaggttttgtaaattatcactttttgcagagtaaaccactgtattaccttaccaagaagtgatcttatatgaatagatacacttaaagagtatataatttaagaattataactgcacttggtatagtgtggcagaaacaatttttgctgaaaacttttcagagcaattatagtcgatcctctgtatctatggattctgcattcatggagtcaaccaaccgcagatgaaaaatatttttaaaaagtatggttgtgtctgtactgaacatgtacatactttttttcttcccattagtctctaaacaatacggcataacagctattcaataacatttacattgtattcagtaataatctagagatgattttaagtatatgggaggatatggataggttacttggaatactatgccattttatattacataaggggtatgatatttatggatgttagaatccacaagggacctccgtatcctccatggatacagagagatgactatgttaccaattacttgctatatagaaacaagtaatgcttacttgttacagcttactttaaagaagcattgtagatagcatatcaaaatggtggacagcataaaatctggacatatgcttatttctacaacttagtagcaagttaacatccctagctctatgtttctcatgtgtaaactggcataataatcatggctacttcatatgtttattgtgggtaataaatgagatactgcatgtaaagaatatagaaaaatttatttttgagagttaactttggttacaatttttactatttccattttaagggatactatttttttgtctttgttcccactactgctattactactatttccaggaatcattatttagacaatgaatttttaggtaactaaatgaatatttctggtaaatagttaatattgaaactgattgtggaaaaatgtcttaatttttctatggtaagtacatttttttgttcaagcttctattaaaatttattttattgtcactgaagaattgtatgtatttatggggtacatagtgctggtttaatacatataatgtatagtgagcaaatcagggaaattagcatatccattatgtcaaacatttattatcatttacttgtgttgggaacattcaatatcctccttctagccatttgaaactatgtgatatattattgttaacaatagtcatcctacattattatagaacattagaacttattcatcttatcgagctgtaattttcaatcctttaataaatctcttcttatccctccctttcgccttactcttcccagcctctagtacctctcctctacattttacttctataagatcaactgtttttttttttttttttttttttagcttccacttatgaatgagaacacagggtgtgtaactttctgggcctctcttattttacttaacaaaatgtcctccacttccatccatgttgccatgaatgacaggatttcattcttttttaatgactgaatattatccccttacttatatttaccacattttgtttatctatttttttcttgttggaaacccaggttggttccacatcttggctattgtgaatagtgctgcaataaacatgagaatgcaggtatcccattgatatactgattttctttcctttggataaatgtccagtagtgggattgctggaacaaatgatagttctatttgtagttttctgaggaacttctatattgttctccataggggctgtactaatttacattcccaccaacaacgtataagaattcccttttctctgcatcctcaccagtattttttgactttttgataatagacatctggaggtgagatgatagctcgttgtggtttttatttttgtttccctgatgattagtgatgttgaccatttttttcacacttttgttggtcacttgtatgtcttcttttttttttttttattttttttgagacagtctcgctcagttggccaggctggagtgcggtggcatgatctcggctcactgcaacctccgtatcctgggctcaagcaattcttccgcctcagcctcccgagtagctgggattacaggcgtgtgccaccacgcccagctaatttttgtatttttagtagagacagggtttcaccatgttggccaggctggtctcgaactcctgacctcaggtaatccgcccaccatggcctcccaaagtgctgggattacaggcatgagccaccgtgtccggcctgtatgtcttcttttgggagatgtctgttcagatcatttgttcttttctaattcagattgtggttcttttgctgttgaaattttttagttccttatatattctggatattaattccctatcaaatgaatagtttaccaatattttctcctattagtctgttttcatgctgctgataaagacatatccgagactggggagaaaaagaggtttaatggacttacagttccacatggctggggaggcctcagaatcatggcaaaaggcaagaaggagaaagtcacatgttacatggatggcagcggggaaagagagggagagcttgtgtaggggaattcctctttttaaaaccatcagatcttgtgagacttattcactatcatgagaacagcacaggaaagacctgcccccatgattcgattacttcccatcagatccctcccacaacacgtggtaattcaagatgagatatggatgggaacacagccaaaccatataatctccctttctgtaggttgtcttttcactgtgttgtttcctttgctgtgcagaagctttttatttttatttaataccatttgtttatttttgctttagtttcctgtgcttttgaggtcttgttcataaaatcttttagtaaacccattcctgaagttttttcatatgttttcttctagcagttttattgttttgggccttaaatttagttctttgatccatttttttgttgttgtttttgtatagggtaagaggtgggggtctagtttaattctaatgcatatagagatccagtgtttctagtactatttattgaagagattgtcctttcccctatgcatgttcttggtgtaattgtcaaaaatcagctggctgcagctatgtgaattatttgtgggttctctattctcttcaactggtgtatgtttatgtttttataccagtaccatgctgttttgtttactacaactttgtagtgtattttgaagcctggtagtttgatagctctagctttgttcattttgctcaggattgctttggctattagggctcttttttgttccatacaggttttaggattgcttttcctatttctgtgaacaatgtcattggtattttataggtagtgcattgagtctgtagattgctttgagtagcatggttgttttaacaatattaagtcttctgatccatttgcatggaatgtcattccatttgtttggatactcttcaatttctttaatcagtgttttgtagttttttttttttgtagaggtcttttaccttcttggttaaattaattctaagtattgtaaatggtgttaccttcttgatttattttccacctagtttgttgtttgtgtatagaagtgctaccgacttttgtgtgttgattttgtaacctgaaactttgctgaattagtttatcagtactaagagttttctggtagagttgaagtggtgtcattcctctagggtaatacccgaggttctttgcctcacaccaaggaaatcaaggacacagacacacaaggagtgaaattaagagcagaggttgccaggcatggtggctcatgcctgtaattccagcactttgggaggctgaggcgaatggatcacctgagatcaggagcttgagaccagcctggccaacaaggtgaaacgccgtctctactaaaaatataaaaaattagctgggcctggtggcgggcgcctgtaatcccagccacttccgaggctgaggcgggagaattgcttgaatctgggaggcggaggttgcagtgagctgaggtcgtgccattgcaccccagcctgggtgacaagagtgaaactgcagccccccacccccgtccaaaaaagagcagaggtttaataggtgaaagaaagagaaaacctttctctcctgcagagagagaggggctctggagtgggtcttctagttctgtggtgaaatgcatggggttttatagacaagcttaaggaggtggtgtctgatttacatagagcccaaaagattgatctgaccaggtgtgtcatttacatagtgaagaagctggctgccctaccttaatcttttattatgtagatgggttctctacttggctagtgccatgttgcctgttcctttactgtacacgtggttgacaaagaaaagggaagatgtagcctccacgttgaacatgcctggcccccaggtagccttcacctagtggcacagctgccggcattcaccggtgtaagcttccagctttcttatctctgtctgcagctcaatttcacaggctgctctttgttagaaaaataatgattttggagctgctttttgttaaaagggaagtcttgctcaggactctcttaccctcactatctacctaaataatttctttctagttcttgtataagagtcttaaggtttttctctgtatcatgtcatctacaaacagggacactttgacttcttctgtttcaatttggatgtcttttatttcttctgttgcctaattgccctggccatggacttacagtgctgtgttaaataattgtggtgagaatgggtatccttgtcttgttccaattcttagaagaaaggcttttagcttttcctgttcagtatgatgttagctgtgggtttgtcacatatggcctttattattttcaggtacattccttcctaaataaaggtatttatttatttatttccttcctaaattaggtaattcctatgtaaatacctaatttaagtttttatcttgatgagatgttgaattctgttgaatgcttttgctgcatctattgagatgattgtatggtttttgtccttctatcgatgtgatatttgatgtttattaatttatgtaggttgaaccatccttgtagcccttggataaatccttcttggtcatggtgtgtattgttctgatattgttggattcattttgctagtattttgttgagcattgttgcatatgttcatcatagatattggcctctaggttttttttttttttttttttaatgtccttgtctggttttggtatcagtgttatgctgacctcatagaatgagttaagaaaatcccctctccttcagttctttgaaataatttgagaagaattggttttaattatttttgaaaggtttggtagaattcagcagtgaagccatctggtcctggacttttctttgttgtgagacttttcatcattcattcaaaatcatgaattttgttggtattttcaacttttctatttctttttggttcaatttctaggtttcatgtgtacagaaatttattcatttcctgtaagttttcaatttcttggaatatagttgtttatagtagtctctaatgaccctttatgtttctgtgttattttaatgtctcctgaattttcacttctgattttatttatctgggtcctctctctttcttgtttggtctagcaaatggtttatcagttttctttattttttgaacaagaccaacattttgtgtcattgatcttctgtattattttagtcctgatttcatttcaataaagatcatgattgccatgatctttatttttttccttcttctaattttggattttttttttcttactttgctaattctttgtgatgcaacattagggtgtttatttgaaatcattctgtttgttttttttgatgtagatgtttattactataaacttccctttcagtactccttttgctatatcctataggctttggtatgttgtgtttctgttttcagcagtctcaagtaatttttaaatttcattcttaatttctttcttcacccagtgttgaggactatattgtttaatttccatttattcacattgttttgaatgttcctctttttactaatgtctagttttattccattgtggtcatgtaagatagttggtatgattttgatttttaaaaatttgttgatatttgctttgtgtcctaccatatatggtcattcctggagaatgttccacatgctgatgaaaagtatgtgtattcttcagtacagtgttctgtaaatgtctgttagatccatttggtttatgctgcagtttaaatctgatgtttctttgctgattttctgtctagatcatctgtccaatgctgagagcatggtgttgaagtctccaagtattattgttttggggcatatttctctttttatatctaataatattttccttatgtatctaagtgctccaacattgggtgcatgtatatttacaatttatagtctcttactgaattaatccctttcttattgtataatatgcttctttatctcttttacagcttttgagttaaagtctgctttgtctgatataagtgtagctactcctgttcacttttgctttctgtttgcatggaatatcttttttcatcccttcacttttagtctatatatgtctttccaggtgaggtaagtttctcttaggcagcatattgttagttatttttttaaaaaataccctcagacagtctatatctcttaagtaagggaattcatttactttcaaggttattattggaaggtgagaattattcctatcaatttattggttgttttctggttttcatacatcttttcttcctttgtatatcctttctatcctttgttcctttcttcctctcttattatttatttttgtagttacatggctttttgtagtgatatggttttatttctttctctttctccttagtgtgttggctctaccagtgagttttataattttgtatatgttcattatgttggttatcatcttttctgttctagatgttaggctcctttgagcatttattgtaaggctagtctattggtgattaatttcattagattttgtctgtggaagatattatttctccttaatttctgaaggatagcttttctgggtataatatttgtggttgacagttttttgttttcttctcaatagtttgaatatatcattccattcctcttggcctttatggtttctgctaagaaattcactattgctgaaatggggattttcctatatctgactttatgcttttctgttgctgcttttagaattctttctgtttgattgttgatgatttgagtattgtgtgcattgtagaggacctgtataggctggatctatttggtgttctctaagcttcttcgacctgcatgtccatttctttctgaagacttgggaagttttcaagtgatttattaaatatttctagacacctgttcccttctgttctcttttgtagttcctataatacaaataggttttcactaaatgtttcttgtaaatgctgtaggccttcctcactccatattctattttatttttgttacctgtgttatttgcttttaagtccagtgattcttctagctgggcatggtggtgtgaacctgtagtcctagctacttgggacactgaagtaggaggatcacttgtaagcccaggagatcgaggctagcctaggcaacatagcaagatcccatctctgttaaaaaagaagaaagagtaattattttttctgcttagtcaagtctgtggttgaagctctctgttgcatttttaaagttttattcattgaattcttcagatctaggatttattttgttctttttttctgatatctctgttgttgaatttttcttccaaattatgaattgtttttcttattttgttgaattgtctatctgtattctcctatatctcactgaagttccttaagattattttgaattttctttctgatatttcatatgtttacttatgttgggttctattagtggagaaatattgttttcctttggggatatcatgttttctttgctttttcatgtttgatgtattcctacataaaattcttccaattttatggagtaggttttgtatggaaagaattattagtatgaatgggtcttggggtattagttcaatggggtgtattggtattggttctaggtagatgaagtagtgtagtctccatgtagtttcttcagctataatccacattagtgacatagtagtgacattttcaagtgtcttggtagcctttgcaaagagagtttgtagcagtggtgatgtggctttgttggagagtgtgctcaccttgctgtttctcagattacgggcatgtgagtacacacagtgggtagggcaacttgcattctggcttgctggggttgaggtcataggactgtcactcttggagcataggcatgcagtcacttggctgacctgggggcttgcctgtcaggaacaacctatgagattggttttcaagcttaagatgtgagtgtatagctgctcagttggcctggaaagattttttccagggttggcctttggggctgtttttcaggcccaggagacaagttgaaggctgcttggctgtcctgggggcttgcttgccaggaacaacccacagggctatttcttaatcccaggatgcaggtgcattgctgctcggctggcttgggggaatatctgctgggagtgcctcatggggtcgtgtctcaggcccaggatatgcttatatggctttctggcgagcctgtgggtgtgcctgccaggggtggcctgtagaggtgtttctcaggtgctggatgtggactcatggctgcttgtattgcctggaggcatgcccaacagtggcagcctgtggaactgtttctaggccctgattgccagtgcaaggcttttaggcaggccaagggcctgcctggagaggttgcaatgtggctgtttctcaggccctgagtgcaggcatgtagccgctcctctggcctaggggcgtattagctgcacagagtctcaagggcctctcctgcttgggggagggcatgcaatggtttgactggcttggctggctcaaggaccacattgtcctgtgtgggactgccagaacattcctttggctcagaagtgcagtggtggggattggtttccctgctgtgtaggaccagagtcacagccaatcctggacctaggctccattcagctggggttgtggcattcagccgcctgtgtgggcttggtggaacgaaaatgaactgcagtactggagagatgcagaggctactggacacttgagcaaggtacactccagaggtggctctggtctcaacatggcaccatgctgcagcatcttggctcaagggcttgagtagggaatgagaagtgcacaccttgtattcttaattgagggcaatgcagctgagggaattcctggcagcttctaaactgggctcagagcttgtaaggactgtgggattcttctgtagtaaggattataggtgtttttggtagcaatgggggctggtggggatcttctccttacctattccctataacacgaagtcactgctgatcctaaacagatccaatccaggtggagaagacagggcaaaggctgggtgcctccatgctgcctttctggacttccattcaccacaggtgcatctccactcccccactgcactccagcactctcccttcgacactccagtcaaagcatagctctttattcattgtctcaatcctctcttgtggtagggatgagcaccaggtgtctctagtcagacatcttgctgacatcactgctgaaatttttgtatggacactcagtccactgttactgccaaccctaatttttgtgatgaaatatattaatattagcatgtatatttctcatgagtatcaataatggataatctaatttctatccccagtttctgtctatacagccaaagccctcttccccattaataaaactgatgaattaattatatcctttggcttttataaatattaaaatattttgaagtggatattgcaatatggtacttcttggccttaagttttttttttacgtctgggattaatagggtaaagaaaaactatactaatcatatttatatgaacagttgattcaggaaactacttttctgtgaactgtagctatttttctgtgaaggatagagcagtagttattcatttggtatacatttattactttcagtgtacttggcaatctactgctttctgagattacagagatcaaaagacaattgctgttctcaaagagcttagtggggagagaaacaaacacaattctactgaaatgtgataattgcaatgatagatgcacacagggtgctatatgaagataaagggtaggcatctaacgagtaatgtggacctaagaataatttcctagaggagtgccctagctatgtcttacaggatttggagttggccagcacatgaaaatattggtaaagaggccagagaaatgcctaagtcttttctcttgtcttgagagctactagcttaatggctagaggataagatatatgaggtagcatgtaggagagacctatcagttttataatatttttgaagaatgtgacaaggtgtatttgtaaagtattatttttagcatatgggacaaacaacataagttaaaatctgtttatattcttgtgatgccaggagctttatttcttttactacaaaaaataagggacaattaccgtccgggcgtggtggctgacgcctgtaatcccagcactttgggaggctgaggcaggccgatcacaaggtcaggagttcgagaccatcccggctaacacaatgaaaccccgtgtctactaaaaaaaatacaaaaaaattagctgggcgtggtggtgggtgcctgtagtcccagctactcaggaggccgaggcaggagaatggcgtgaacccaggaggtggaacttgcagtgagccaagatcgagattgcgccactgcactccagtctgggcgacagagtaagactccgtcttaaaaaaaaaaaaaaaaaaaagggacaattaccaatgaacatgtgaaaattagttctcactaccacttatgcagagcttattattggcagattcaaattccctgatatttagaaagtactgatatttgatattagaactctgttgttttctttcttgcttaagacatattatttttagttcttacaatataaccttgaaatgtgcttttttgagattgcatatttcaagattgttatgttagtgttcactttttcttccctattataaataataatgattgaactaataattattttgaatgtgtgatgaacttagacttgataagttcatcacacattcaaaagttccatttgctaaggaatgtgatgctaactagcatgccctgtaaatgaagaatgttttggtttatcagaaagctgaacttcagcaagatttcaaaggtggagacttctgcaaggtgacattcaattatgcatatctttatataaaatgaattctgagtcattacagttgtataaactgaagataacccttttttggcaaataaagattgacaaattcatgcactttatagagatatcttgggtcaaatgatcatttacttatcagaaatggctaatgaaatgttacagtgatttatggtgtgctgcagtaaattttcataatatagttatttatcttacataagataatgaactgcctgtccagttcatttactgagtaatagttactttaaatgttttatcagcagctccatttttctgttttcctcctcttcctctcagatttttatcacgatgagttagggagtaatatttcattttaaatgacttgtcttgactatagatagttcagggatataggcagaattgctgtcatgtgaaacacagttgttaatctgaaatatctatgttgaattgactcctgctgttattatcaagagctataagaatgttttaggtttttgcttattaaaatatttttcagaataatatatgaaatatatgctggtcacaatgtgaagcagcatgtgtgtttttataattagaagcattatttattaagtaccatctttgttttaggcactgtgctgatgatggaagataacaatttttattctaatgaattttgtttagcaaaatttactgattacctactatatgtacagtacttgggcaatatcagatctattgtcataacaagaatttataagatatttaaattttatccaagaaacatttgttgagtgtttactatgtgaaatttattgtatttgtactctgcacacatttctaggtgtggctatcttttaagatctctaggactatatgcacatcataattagaataaatactggatataaatatcttatttctatgttgttaatgtctaaggtggagaaacatttttctctatcctggtactccataatgtttaaaaaaaaagaacaatgtggagttttgacatcatttcacattgtaatataatattggtagcttagtattttggaaaataaatctattatcatatatattaaaatagagatgtttataatataaaaaattgtaaagattagtaacttggatcatgaatatatcatttttaatataagaacattttaaaattgagtaattattaaggttataaatatggtaaagatttttatttcaagttaattttgaaatattacagcattaagaatagttatgtagtatttgtcaatcttagttaaattataggcacgagcatcagattttattacttttgttgttttttgttaataaaattatatgacataaatttatccaaaaatcatatagaagtccagatttatttgtagacgtctgagctaagagagaggcagttattcttctgtaagtctttttgctaggtcttgttatgaagtcttcactcagactctatatattgtttgttgattttattttctagtttcacaatgcagataatggcaatttatctttagagtcttaatcctataactgattacattgatagtagtaatagtaatagaagcagcagcagcaataacaatatgttaagtttttaaataatcctaccttatcagatagataattatatctccactttatagaagagtaaactgaggttcatgaaggctaaataaattattccaatcatgtagctaaatataaaacctgtgttttaaaaacagtgttctattctacatcattctccaaaatatgctataattgttaattattcttagtactaaaactcattagaaaggcagctttatatattttcaaatataatttttaatgatagtgaactatttgctaaggaatatgccatatttttacatctaactttctttgaatgccccttttcctgttgtttacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttggtaagtagtccagtaaattagcattcctttaaaagtatgtttcccacccatcttctcattccttccttctagggtgtagtcttattctatgatatttatgtaaattttatttttatacacattcttccccacttactattagtgatctcagcattaacttgtgaaaataacataatattattattttatgcaaactttgttggttcaaatagtgagattgtggttgtagttacttataatatgacaataatctattcttaattcattaatgtcttttacttttatcatgatagtgtttgggaagaagatttgcttttaagattaatggctaattgggactccttttactcttgtagacatatttcagttatcaagtaaaaagaaacatttttgttacatcttctgaaatggatttttgttaagtaagaaaggaatattgaattcttttcttttaaatcttatatttttatcatggtaaaatgtacttaaaatttaccattttaaccattgtaaatgtattttaatgccaattcaatggcattaaatactttgacactgttgtgcaaacatcatcaccatttagctccagaactttttcattttgcaaaactaaaaatctgtacccattaaacaataactctccatttcctccaccccaccccctacagtccctagcaactactgttctactttctgtctctatgaatttactacttcaggtacctcatatggtgaaatcatacagtatatgtgctttgtgactggcttattcccttagcataatgtctttagggtttaaccaagttgtaggatatatgagaatttccttcctttttaaggttgaccaatattacattatatgtaaatactacattttgttcatccattcatttatcaatggatacttgcgttgcttctacctttttgctattgtgagtaatgctgctatgaatgtgggtgtatgaataactgttcagcttcttgctttcacttctttggggtatatatatatagccagaagcagaattacaaaataatgtggcaattctgtttttcacattcccaccagcagtgcacaaaggtttcaatttctctccatccttgccaatatttatttcctattatttttaaataatggccatcttaaaggctgtgataaatattgtatcttgtgtaatattttatgataagctgtatttttattctttgtttatatcaaagacatgttcacttacaggacatttactttgtaagatgtggaatgctatggaaaacgtggctgggaaaaaattgtggctgggaaaataaacagtgctggtatacaaactaggtcatagattacattactgcttataatacttaaaattatacaactttatatactttgtaaagaattacaaatttcaaaggagttatacattttcaaatttaataaaaattttaagaagtattgatatatcatctttgtttttatctacctcatcatattataatgccacagttggcttaattgaaacatgccctgaacagcaaagcaaagaaaacccatacaattgtgttaacatgaagttaaaaatgaaattattgtatttgtttatttattccagttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccgtaagtatttatctagagtgacttttcacttgacagcaacgtaaatttacttttctgtgatgtaaagaagaattaaatatttgaagaagtttcaaaaaatgagaaaaaatattgttacggctacttttgaaaccaactggtactgttaacctctgatttttattatatcatcattttgcatgccactaagtatcttaccctaaatattaacatattgccacatatgtacagcctcttttccctgaactgtgtgtatgttgcagacagtataacacttcatgagagtgttcacctcaaacatcacagattgctttggtgagcctttttagtatcttttaatctagtgcaattcccatatcttttccttatatgactttgatatttttgaataacctataccaattgttttggaggtttctcaatttggatttgtctaatttttccctcatgattagattcaggaaagcattttggggcaagaatattttatcaatgttggtatatctgctacaagtatagaatgcacagtcttgaaatcacatagagttatgtcagcagggcagtactgggcttgctatgagttatacttcaggagaaagattttgccccttgctgatctctcatgttttctaaggactataggataaggctgcacctgaatgaatatttaatactgggtactatgtggtgagagtggccttgcttacaaacacaaatggcgtcagaatacagctgccaagggaattgcataatgctactgggagcacttgttagccttgtaggaacttaagaccgtgtgaaactctttctgcttgggagaaaaaagtgccaatcttagctagcttcttcatagcagagaatatggtttatctttctgcaatccactctttgacactgacgctcatcaaaaatatgccttttcacctgaattaattggtatgttcagatttggaacaaaaaagtagaaagttttacttactcctgctgctctcatgacctgtttctcaatgttggttgcattcattcatatcccactcattggtatctgtccctcttgtaattaatccagactttatgtccttttttttttgaataatatacttttcaggggcccagtagttaccattctaccaccatagaaagctgcagaatcacctgagataaagttggtatgcaggtttttttttttttttttttttgagatggagtctcactctgtggcccaggctggagtgcagtggcctaatttcagctcactgcaacctccacctccctggttcaagtgattctcttgccttagcctcccaagtagctgggactacaggcatgtgccaccatgcccagctaatttttgtactttttttagagatggggtttcactgttggccaggctgatctcgaactcctgacctcatgatccacccagctcggcctcccaaagttctgggattacaagcgtgagccaccgcgcccggccggtatccaagtttatgtccgttgaggatgctttgatttgaacaaagcaaaatatcagttatttggtaaagtccaaacagacaaataaaatcagaagttcttttgcttctttttcagttcccttcttctcaacatctgagtgtccaggaagctcacaaagaaaaaaggagcaagactccttggatttttttttcttccaatactttaacctgcagtaaacaggatttgaaatgagtgaatctaattaacatgttggtgtgtttgatccaggttccaaagaaactgtagttacagttcagtcaaaggagacaaaataacagccacttggagtctggtgtatctattaaactcaggaatatgttgtggttgaaatgtattcaatgagatagggaaagcaacagtttccctctctatacaggaattctctccaggggatctttatcccgattctaattcctttctcctaacagccctaagttctccactatcatcatctctcttcatttgtcatatttgaaacttttaaaggtcaaaggtccattttaggtttttgcatcagtccactggtttccctctgaccctttctctccaggaaacagccacttggagttttcctaggagtgtaggccataacacagcttgtttctataacgttcataagtatcttcaggactttcttattagatcattgactttcttgcagtccctccataggagcagccactggcagcctgactgatgaaaatacaaacaactatcccagcagcaatatttattttctgcccgtccactcttccttccctcctttgagctttcttgtttttcctctgagaggcaacccattctagttagcaattatagtaatgatatggctcccatgagtggaggaacaccagggctcttgtctcacgttgaattagattaaacaatacggacacacgtggagtggttttaaggagcagagagtttaataggcaagaaagaaaagaaaaggcagaaggttcgctcttacagagacagagggatgggggctccacagccgaaagaggaaaccccaagtgtggtgcgtaccaggcaggtatatgtagaggctggaggagggggtgtctgatttgcatagagcttaggggattggtttgaccaggctttcattcaggtagccctcggaaaaaaactggccttcccaccctagccttttaatatgcaaatgcagggcaccatgatgttctacacacatggggatatgtggggcggccatattcccaaatacatgtggggcaagggcaagaggacaaaggtgggaatcgccatgttgagtggacccagtttctaatggcttgcatatgcatactaaaggttgccggcttggctctaagagctgggacttttctgttagacaagaaacacttttggaggtgttttaaaaagaaatgaaaactttccaaggactccttttttctctatctgcctaaaataatttcttaataacttctatcacagtaacttcataattctgagatccctgttggtggtaaatctagtatgttgaagcctgtaagtgtatggcccttggacaacatggtcacccagttgatactagtccttcttgctcagatgagtcatcttcccatttagaggtagccactgcataaggcaatgcacgtagagacttactgactttctaggcctttcatcactctcagtggtccagtcaaatatgtatttggtccatagtgggcaccactgttacttgaagagctaaggcaaaacagtaacacaatgcaggctggaatcccagctgcagctgttgtgttcatttgttccttcaggctcttggcatgaagtggagaggtatgcctgggatggacatggttggatgtattatgagttgagctccctgttgatatccttttttagggattgtggtaaggaatgggggtgttgtacctgatcaagtgggtggcagtgtggtggttgcaggcataaaatggcctttgtgcatagcaaaacatttcaaaactaggagccagctgcccaggagagttgaatacaagagttgaagacttgtggggaatgagacaatgcgcaccttctcctgcctcaatagtcatgcttgtctctcgacaaacattattgttcaatgaaagaagctagacatgaaagattacatactgtttgactacatttaggtataaagttaaaaaatagtcaaaacggcactgtattgtttagaaatgcgtatttaggtggtaaaactatagagtaaggcaaaagtgtattctcaaaaatgtcagctagaggatgttgctgggggaagtttaggggtgctgattaggaaatgaaacaagagaggcaatgctccacttctaggctttgtgcaggtccagagtgtgtgtttataggaatttattaatcttatatttttctttatgtaattgtatgtgtgttatatttcacaataaaagaggctagaaagtagggaaaaactggtttgtgaaagtctaagctcttatactcttaacaactttctaaaaattatttagaattaagcttatgttgtcacaaatttttcttatatcccattccttctcatttgttctacttttttgtttttttacaattttttttggtggtataacacacataacataaattttaccattttaaccattggtaaataatctttagtaatttctttcaaataaattgtgacataaacttttgagtctttgcatgtctaaaagtgtacttttcattttcacttgaatgataaaatggctaaatgtggtattccaaataattttttccttggaacctctttagcactcagtgttgtggataagaattccaatgccaatctaattttcattcctttgtggaacatcttttttatcccccctttgggagcttttaagatttttttctttcttgttggcattctaaaatttttcattgttttaattcagtttttcagtgattgatgtggatctttaaaattaatttttttttacagtttttcattgaagaaaaggatttttagattttttagattttctcattggctctttaaatctgaagagtagtttgtttcttcatctgctaaaaatgttgtgtaatgtcttaaaatacatgttttcttctctttactcttgttgcaaatattaaaatagttgctggaacttctagatatatcttaatatttcttaactctgtttgcattttttgtatttttgtttgctaatatttagctatttttctttttataatcctttgagactttttatttatttgaaataagttttttgagaacaatataattatacagtgcaaatataaaaattgttgtaactgattttttttgagaaggttaatgaaacataattcactattttaacacaggtatgaattaaattctaccactgacaaatcaaataatgataactaaataccgctggtgggattgtcagctaggcaagcataagtcaggtcttcaggtctgccattgtctctcttgtttttgatcttttgcttcttttgttttcttgattattatagaggcttcattgtctacttctaccatttgttccttgagcagatagtctagtttgctattttttctcctctatagttcctttctctgttctgttgtcatgttcgcctttcctgaagctgtgtatagatcatttgtgctgataatgtccaatactactctaacagttatttctatttcacagggtttttttgttggtttttgtttttttgagacagagtctcgctctgtcacccaggctggagtgcagtggcacaatcttggcccagtgcaatctccgccttctgggttgaagcaattctcctgctgcagcctcctgagtagctgggactacaggtgcctgccccatgcctggctgatttttgtgtttttagtagagacggggtttcaccatgttggccaggctggtcttgaactcctgacttcaagtaatctgcccaccttggcctcccaacatgctgggattacaggtgtgagctactgcgcccggcctccacaggttttttattatacaccctgtgtgtcgttgtggggaagaagggcattgaacattgcctcaaggagactttgtatttctgaaagaagtagttacctggcagtgatccactgtttgtgaataatgaactccttcattatgtttaatttttcccgtgtttttaaccaacagacatttgtagagtagtgaagaaatgccaggaagtacaatagggactaggagtaaaatgacattcttgttcaaaatacaagttaaaagtagctgagtgttactctttcataggtgtcagcttcttggcaatggttttagtgtgcttttgactttaactttatgacttttcaggataaattatatatatttacattatcgttttctactacacgtctattcatttaacatttgagtctttaaaatatttttatacttatcaacaaaactttgtattggaagtggtcttttagttgccttcagaaagttgcctcaatgttcatttgaggtttactggtaaatagaaattaaggcaaacttttctttggaaatgagaaacaaataggattttgcaatattctccagtatttttcagtcataatattgtgatatcattgtttaaaattcacgaattgaagagaggaaatgttttttaagataatttttgactaatggtttctgagaaagctttgctaataattggcattattagtaattgatatattttgggtagacagatattctacttgtgaaaatgaattccagggcaatgtttaaagaaaaataggagatttagtcccaaatgtataaaggttcaaatgaaaattcaattaaatttgtatagtaaaaatagaataatacacaacttgaggataaggtgttatctcacaaatctgtatttttttcagtatttgtaagtttatgtgttcaatttaaacacttcaacaattaaggaaggtaatcatttttaaaatttgatgacaatttcttacagattgattttttaatattcttacccatttgaaaaaccattttgaatattttacaacttgatcttttgaaaagccaaaaataaataaacaggattgctccaattaaccatatttcatacaagtccttatactacacataactttaggaacaatagcatagcctgcataaggtttctcatatattatctattttgctgtgtagaagcttttgagtttaattaggttccttttatgtatttttgtttttgttgcatttgattttggggtcttagtcataaattgcttatgccaatgtccagaagagttttcctgaggtttcttccagaatttttatggtttcaggtgttagatttaaatctttaatccatcttgagttgatttttgtatatggtgagagacatagattcagtttcattcttctacatatgttgatccagctatcccagcaccatttattgaatagggtgtcctttcctcaatttatgtttctgtataatttgccaaaaaatcagttggttgtaagtatttggctttatatctgggttctctattctgttccatttttctgtgtatccccatttttctatgtatctacttttatacaaatactatgatgttttgattactatagtcttatagtataatttgaagttgggtaatatgatgcctccagatttgttatttttacttaggattggtttggctatttaggctcttttttggttctatatgaattttaggattattttttctaattctgtgagaagtgatgttggtgatttgactggaagtgcactgaacctgcagattgttttgggcagtatgattattctcatgatatcagttcttctaacccctgagtgtgggatgtgtttccatttgtttttgtcatctatgatttctttcagcagtgttttgtagttctccttgtagggatagtttacctgcttggttaagtatattcctaggtattttatttttgcagctgttgtaaaaggggttgagttcttgatttgattctcaggttggtcatttttggtgtatagcagtgctactgatcagtgtacattgtttttgtaaccttagactttactgaattgatttatcaaatctaggagtcttttggagggctctttagggttttctaggtatacaatcatatcaaagtctttagggttttctaggtatacagtataaaatcacttcatagtctttagggttttctaggtatacaatcatatcattggcaaaaaagggtagtttgacttccttgtttcctatttggatgccctttatttctttctcttgcctgattgatctgggtaggatttccagtactatattaaatagaagtgacgaaagtgggcctacctgtcttcttctagtacttagaggtaatgcgttcaacatttccccattcactgttatgtttgctgtgggtttgtcatatatggcttttattattttgtggtatgttccttctctgcctagtttgttgagggtttttaattataaagatatgctggattttaatgaatgcttttcctgtaattatttgagattatcatatcacttttgtttttaattcattttatatgatgaatcatatttattgacttgcatatgttgaaccatccctgggatgaaacctacttgatcatgatgaattatctttttgatgtgccactggattcagcttgctagtattttgttgaggattttttcatttatgttcatcagggatattagtctgtagttttcttatgttcttccctgactttgctgtcagtgtgatactggcttcatagaatgagttaggaaaaatttcctatttctcagtcttttgcaacagtttcagtaggattggtaccaattctttgaatatctagtataattcggctgtgaatcccctggcccttgactttttttggctggcaaattggtattactgattcagtcccgctgcttgttattgatctgttcaggattttgatttcttcctaatttaagctaggagagttgtgtgtttccaggaatttttccatttccactagattttctagtttgtatgcatagaagggttcagagttgtctcaaatgatcttttgtatttctgtgatgttgtttgtaatgtctccattttcatttctaattaaacttatttgaatcctcttctttgttaatctagctaatggtctatcaattttatcttttcaaaaagactagttttcatttcattggtcttttgtattttgttgctttcaattttatttagttctactctgagatttgttattttattctgctggctttggatttggtttgttcttgtttctctagttctttgagatgtgacattaggttgtcagtgtgtgatctttcagactttttgatgcaggcatttagtactataaacttttagcaccacttttgctatattcaaggtttagataacttatgtcacagttattgttctttttgcagaatttaaaactttccatcttgatttaattgttaaccccaaaatcgttcaggagcagattgttaaattttcatgtatttacatagttttgaaggttccttttggaattgatttctagtttcattctactgtggtctgagaagatacttgatatgatttagattttttttttttttttttgagacagagtctccctctgtggcccaggctggagtgccgtggcacaatcttggttcactgcaacctccacctcccggattcaagcaattctcctgcctcagcctcccaagtagctgggattacaggcacatgccagcatacctggctgctttttgtatttttagtagaaaccggtttcaccatgttggtcaggctggtctcaaactcctgacctcatgatccacccaccttgtcctcccaaagtgctgggattacaggcgtgagccactgcgcccagccgattttgattttttataacttattgagacttgttttgtggcctgtcatatggtctatcttggaaaatattccatgtgctgatgagaagaatgcatattctgcagttcttgggtagaatgttctgttaatatctgttaagtccatttgttctagagtgtaatttaagtccagtgtttctttgatgactttctgctttgatgatctgtctagtggagtgttgaagtcctccaccattattgtgctgctgtctatctctttcttaggtctagtattgattgttttatgaatttggcagctctagtgttaggtgcatatatattttagattgtaatatcttcttgttgcattgatacttttatcattatataatgaacttcttttttttttctttactgttgttcctttaaagtctgttttctctgatacaagaatacctactcctgcttgcttttggtttccattggcattgaatatctttttccacccctttaccttgagtctataagaatctttaaatgttagatgtgtctcttgaagatagcagatatttgctttgtggtttttcatccattctaccagtctatgtcttttatgtggagcatttataccatttacatgtaacattaattttgagatgtggggtacatttctagtcatcatgttgattgttactagttactttgttttcttcattgtattattactttataggccctgtgagttttatactttcaagaggttctattctggtacatattgacctttcattttaagatttagaactctttttagcttttcttgtagggctggtctggtagtgacaaaatccttagcatttgcttgtctgaaaaggactttatttctccttcatttatgaaagttagttttgctggatacaaaattattggctggcagttattctgcttaaggagggtaaagagagaaccttgatcccttctggcctgtaaggtttctgctgagaagtctgctattagtctgataagtttttctttatagattatctgatacttttgtcttagtgctcttagaattcttttattcatgttgacttcagagagaatgatgactatatacattggtaatgttgtttgtgcaatgaatctctcaggagctctttgagcttcttgtatttgggtgtctacatttctagcaaggccaggggtgtttttctcaagttattccctcaaataagtttttcagatgtttttctctttcttttacctcaggaacaccagtgattgttaggtttggctgttttacctaatctcatatttcttggagactttgttccttttttaaattattttttctttatttttgtttgattggtataattcaaaagctttgtctatgaggtctgaaattatttcttctactttgtcttagagtagtatttgtctaagacaaagtattgttaaaactatccacttgcattttgcaattttctaaatgtgcctttcatttccagaagttggtttctttttttaaaatgtattattttgttaaaatttttatttatatcctgaattgtttttttacattttcttatgttggttttcacttttctcttttatctccttgagtaacatagtagtcaaccttctgaattctttatctggcatttcaaggatttcatcttggtttggatctattgctgaagagctagtgtgatctttttggcagtattataaaaccctattttttcatattgccagaattatttttctggttccttcttatttctgtaggttcttataattatttttgaatttatttttgattcaactgtgcttttttcatttcttttttccccttgagaatgtgactttaatgtttgtagtttattttaatctaatttggctcttggtgctttcagtcatgaaggctctgtatgagttccttggtcatagagagccttttcatggtggctttctcagatactggttgtagtagtgatgtgctccatttataagtaggtgcactgtctcctgtggggttggaatggcagaggtatcatgaagcttatttcattcgccagtggcgtgtacttatttatttatttatttattctttccccagtattttattcactgggttgaacaattcagactttaggtcaataggtggtgtccacaggtaaaatctggctgttgctaaagcaggtatcatgatcctttcttaagaaaagatagttttaaaataaaacttactttcttaggaaatacctgtataacaatattagaaaatttgatttattcagggtgagtcccactaaagatttactttctcctcacgtgatatatgatacaaatcattacatgatagtaaataattggaatgccaagccaatattactaattagatattttcccttatgtcctattgatagcatagtaacccaatatacttttgaaaacaattagaataaactagttaacaatactgtgggctaactgtaatcatagatatacaataaatgttttaaaccaacaaaactaaggagggacatggtaaataggaaatgttcagttatctaaggatttttaaaactgtgtcatttagcgctgtgtactgttgaaaaaatgtaagattttaaaggaagactgtgtcaatgaattatttatctacaaatttaacattagccacttttatttaatgactcaaagagtattcttccttttttatttcttattaagaaaatacaggaggtgatacgtactctctaccttcctatgaaggcatgagatccttacctctcaaaggattgacaactacaaataatgttataattggtaaattttttaaatccagtattctattatctgtgcagagtcaacgatatcaagttcctgatattcactgagaaatttgtgccattgtttgtagttttcttaggaatgtttttgttttaaacactgagtggcagctgagccattaacattatacaatgaaattgagtctgccagaaatctaccattttttcttccattgttttttctttcatgtgactagaagacatcattcatgatgccgtgtatgtctgtcagtatcttctatttataaacaatccccaagacaaaatataatattcctagctaaataatagtaaaagtaactatgtaaataggaaaagactctcagcttaatgtaagatgctttggttgttaagtaaaggtttaaaacatttcatagcaatggctatgtctgtggtgtttgactataatgtctgcttatctttggcaaacttcaccatattcataggctttgttgagtctcataggttatacctgaatcaaaaaacaaaaagacaaaaaaccaacaacaacaaaggttgagtatctgcaaatgagtcatggagtgttattttatagccctgaaaactagaatgtgtgctctggttgcctggctgaaggagagtaccaggttttcatgttcccatccagcttggctttttggatgagattaagtttattcatcacatagtagccaaatactagtatcttggacccttgtgaggagcattgtccataataggtagtccaaatatagcccagcaatctcaggaaatgggcagacgtcacttatactggatgtccacaggcagaatacagagttctttcattgaatgtccttacgaggcacaataagaatggctaacatggatttatatcacagacaataataaaggtggtctgtagggccctaaaagttctagtactgccaaaattttcaggggtcttcaattactgattttatttttctccatgtcatggttaaccacaccttttttcactcctgtggtggcctgtttatctcctctttgtttgtgatgtatgttttatttgcttttagtaattgctgtctcttaagtattattgcaaaaatgtttgcattaactatagatgacctttcatggtttttatcatgatcatatttattttttattagcctataattctgtttgaatatatagtcatgttaacatatttgtcaatgttcctgtcacgcagctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccaggtaataataatgtaatggaaacaatttcagtttctgcttaagggatccaagaaggagtttttgttcttataataaagaaaatttagctttaggaaaaaagcagaatgaaaatgagactaaaatgtcaaagataaaaaattattccatagactatatctatctcagtttatgcaggtggtattcagtttagaatcattagataggctaaatgaattcatggaatatcatgattagctttcatttcttttttaatattttgttatttagtttaagttttgggatacatgtgcagaacgtgcaggttacataagtatatgtgcaacatggtggtttgctgctcctattgacccatcctctgagtttcttcccctcacccccagcccggcaacaggccctggtgcatgttgttcccctccctgtgtccacgtgttctcattgttcaactcccactttggagtgagaacatgcagtgtttcgttttctgttcctgtgttagttggctgaggatgatggcttccagcttcatccatgtccctgcaaaggacatgatctcattactttttatggctatgcagtattccatggtgtatacgaaccacattttctatatccagtctatcattaatgggcgcttgggttggttccatgactttgctattgcaagtagttctataataaagatacatgtgcatgtgtctttatagtagaatgatttatattcctttatgtacatacccagtaataggattgctgggtcaaatggtatttctggttctagatccttgaggaatcacagtgtaaaaacaagcctctttctccacagcctcgctaacatctattgtttcttgactttttaataatcgccattctgactagtgtgagatggtatctcattgtggttttgatttgcatttctctaatgatcagtgatgttgagctttttttcatatgtttgttggctgtgtaaatgtcttcttttgagaagtgtctgttcatatcctttgcccagttttttacggagttgttcatttttttcttgtaaatttgtttaagttccttgtaaattctggatattagacctatgtcagatgggtagattgcaaaaattttctcctattctgtaggttgcctgttcatgctgttgataagtttcttttgctgtgcagaaactctctagtttaattacatcttatttgtcaattttgacttttgttgcagctgcttttgggattttcattatgaagtctttgcccatgcctatgtcctaaatgttattgcctaggttttcttctagggttttttatggttttgggttttacatttaactgtttaatccatcttgagttaatttttatataaggtgtaaggaatgggtccagtttcagttttctgcatatggctagccagttttcccagtaccatttattgaataggagatcctttccccgttgcttgcttttgtcaggtttgttgaagatcagatggttgtagatgtgtggtgttatttctgaggtctctgttctgttccattggtctacatctgttttggttactgtagtcttgtagtatagttcgaagtcaggtagcatgatgtctccagctttgttctttttgcttaggatcgtcttggctatatggggtcttctttaattccatatgaaatttaaagtagttttttctaattctgtgaagaatgtcaattgtagcttgatgggaatagcactgaatctataaattactttgggcagtgtggccatttttacgatattgattcttcctctccatgagatagaatgtttttccagttgtttatgtcctgtcttatttcattgtgcagtgcttgctttgtagttctccttgaagaggtccttcacatcccttgttagctctatttctaggtattttattctctttgtaacaattgtgaatgggagttcattaatgatttggctctctccttgtgtattgttggtgtaaaggaatgctggtgatttttgcaaattgattttgtatcctgagactttgctgaagttgattatcagtttaagtagtttttgggctgaaatgatggggttttctaaacttaaaatcatgtcatctgcaaacaaagaaaacttgacttcttctcttcctgtttgaataccctttatttctttctcttacctgatagcccttgccagaacttctagtaccatgttggataggagtggtgagagagggcattcttgtcttgtactggttttcaaagcaaatgcttccagcttttgcccatttaatatgatattgctgtgggattgtcataagaagctcctattatcgagctgtgttccatcaatacctagtttagtgagagtttttaacatgaaaggattttgaattttatcaaaggccttttctgcatctattgagataattgtgtactttttggctttggttctgtttatgcgaggagttacgtttattgatttgcatatgttgaactagccttgcatcccagggatgaagttgacttctggtggataagtattttgatgtgctgctggattcggtttgccagtattttattgaggattttcacatcgatattcatcagggaaacgggccagaattttctttttttgttgtgtctcttcctggttttggtgtcaggttgatgctggctttataaaattagttagagaggagtctctccctttcagttgtttggaatagtttcagcaggaatggtattaggtcatctttgtacctctggtagaatttggctgtgaatctgtctggtcctgggctttttttggttggtaggctattaattactccctcaatttcagaactgttactggtctattcagggattcagcttctttctggtttagtcttgggagggtgtgtgtatgtgtccaggaacttatccatttcttctaggttttctagtttatttgcataggggtgtttatagtattctctgatggtagtctatatttctgtggggtcagtggtcatatcccctttatcatttttttattgtgtctatatgattcttctttattttcttctttattagtctagctagcattctctctattttcttagtttttcaaaaaaccagctcctgaattcattgatgttttggagggtttttcatgtctctatctcttttagttctgctctaatctcagttatttcttgtcttctgctagcttttggatttgtttgctgttgcttctctagttcttttagttgtgatgttagggtgtcgatttgagatctttccagctttctcatgtgggcatttagtgctataaatttttctctgaacactcctttagctgtgtcccagagattctggtattttgtctctttgttctcattgttttcaaataacttcttttctgcgttagttttgttatttacccaagagtcattcaggagcaggttgttcaatttccatgtaagtgtgtggttttgagtaaatttcttaatcccgagttctaatttgattgccctgttgtctgagagactttgtaatgatttcaattcttttccatttgctgaagagtgttttacttccaattatgtggtcaattttagaataagtgccatgtggcactgagaataatgtatattctgttgatttggggtggagagttttgtagaagtctattaggtccacctgatccagagctgagttcaagtcctgaatatccttgttaattttttgtctcgatctgtctaatattgacagtggggtgttaaagtgtcccactattattgtgtgggagtctaagtctctttgtaggtctctacaaacttgttttatgaatctggatgctcctgtattgggtgcatatgtatttagaatagttaactcttcttgttgaattgttctctttatcattatgtaatgcctttttttttgtctttttaaatctttgttggtttaaagtctgtttgtcagagactagtattgcatcccctgctttttttttttttaactttccatttgcttggtaaattttcctccatctctttattttgagcctatgtgtgtctttgcctatgagatgggtctcctgaatacagcacactgattggtcttgactctttatccagtttgcaagtctgtgtcttttaattgggggatttagcccatttacatttaaggttaatactgttatgtgtgaatttgatcctgtcatcatgatgctatctggttattttgcacactagttgatgcagtttcttcattagtgtcattgatctttatatctcggtgtgtttttgtagtggttggtactgccttttccattccatatttagtgcttcttttaggatctcttgcaaggcaggcctggtggtaacaaaatcccttagcatttgcttgtctggaaaatattttatttctccttttcttattaagcttagtttggctggatatgaaattctgggttgaaaattattttctttaagaatgctgaatattggcccctagtctcctctagcttgtagggtttctgctgagaggtccactattagtctgttgggcttccctttgtaggtgacctggtctttttgtctggctgccattgacatttttgccttcatttcgcccttagagaatctgatggttatgtgtctttggttgatcttctcatggagtgtgttagtgatgttctctgtatttcctgaatttgaatattggcctgccttgctaggttggggaagttctcctggataatattctgaagtgtattttccagcttgttttcattctccctgtctacttcaggtactccaatcaattgcaagtttggtttctttacgaggtcccatatttcttggaagctttgtttcttttcattcttttgtttctttagtcttgtctgcatgccttatttcagcaaggtggtcttcaaactcttagattttttcttccacttcgtcacttcggctattgatacttgtgtttgcttcatgaagttcttgtgctgtttttttttcagctccatcagatatttatgtttctctctaaactggttattctagttagcagctcctctaaccttttatcaaggttcttagcttcctttagctcagcgtagttttttattacccaccttctgaagcctacttctgtcaatttgtccatctcatcgtctgtccagttctgcgcccttgctggagagatgttgtgatcattcggaggagaataggcgctttggcctttgggtttttggcatttttgttgttgttgttgattctttctcatcttcttgagtttgtctagttttgagtttgagtttcagtttgtctgttttctttgaggctgtttacccttggatagggttttttgtggggccttttttttgttgttgttgctttctgtttgtttttctttcaatgatcaggtccctcttatgtaggactgctgtggtttgctgggggttcacttcagcccctattcatctgcttcgctcctgcccctggagatatcactcaaggagactggagaacagtacagttgggtgcctgcgccttcttctgggatctctgaccttgagggtcagcaagtctgtgtcttttaagtggaaagtttaatttgtttaccttaaaagttactatttgatatgtgagggcttatttatggcattttgttaattgatttatggttgttttatatatcctttgctcctttcttattgtttatcattgtggttttttagttttctgtagtggtagcatttgagtcctttctctttcttatttgtgtccttgcttcgtcagggagttttatactttcatttgtttttatgatggcaaatattgtcctttcacttcctgaagcgtctgtttcaggtcttggctagtggtaatgaatttcctgtttttgcttgtctgaacatagctatcataatactgaagagggaaaggtgaaagctttttttttttttttttttaaagaactggaacaacacagagatgcccacttgcaccactcttgtttaacatagtactgaaagtcttcagactgagcaattaggcaaaagcaagaaattaaatggatctaaattggaaagaagggagtcaaattgtacctgtttgcaggttacataatcttatatgtagaaaagcataaagattctatcaagaaactgttagtactgacaaatgaattcagtaaagttacagaatgcctaatcaacacacaaaaatcagtagcattttcatacatgaacaatgactaggagaaaaggaaatcaagaaggtaataccatttacagtagctacaaataattaaaatacttaggaataaatttaaccaaggagatgaaagacctagaaacttttaacatatacattttaacttgttaaaatatttttcagatttatattactaccagtgagatgtaataatgttattcatataggtctattctttttcttcattttggtcttatttttgctactacatctatatatgttgtggacccaacagtactttaataaaattattactttatataattttatatcttttaaataatttgagtgatgaaaggaggataagtatatagttatagcttttattatattaatctttttaccatttctggttttctttatttgttgccatggccccaaaccatcaggtatcatacctttagcccaatacaggttttcttgactcacctattttgtgcttttattggcaaacatgttacatttttatggttataggacaaataataccattatatacatatatttaaaaataattccttaaaaatatcaggtaatagaaaaaaggaaaataaatatgcatttcctatttttattattacacagtaattaccagtactgtttttctttttgcatggagttgaactaccgtctgggtcacttgctttccttgaacaacttcctttagtatttcttgtatggctggccttctagcatctcattctcctaattttttaatatttaggaatgtcattatttctccaattttctaaaggtagatttgcttgatagaggattcttagttagcattgttcttttgagtatatattattatactgcttactggcctctattatttctgatttaaaatcagttgttaatcttattgggcttttttgtaagtgagaaatgattttatctctttcttctttcaagattttgtccttgttgctttcatcattttaattataatgggtctttttgtggatctctttgtgtttgtcctatttagagttttttaggtttcttggatgtgtaagttaatatttttcatcaaatttgagttttcagaaatgatgttttcaaataatttttattttcttttctctttctccctcctctctttccagtgtttctattattcatgtgatggtaaaattaatgatgtcccatatgtttttccaagctctgcttacttttctccattcctagttctctctgtattttagattatataatctgtcagtctatctttaagcttgctgattatttttctaccagttcagatcttctgttgaattcttctagtgtatgttattgtacgtttctacttcatttgtttttttcttaaaaatttttatttctttgttgatattctctatttgatgagacattgtcatcatacccttcttcttcaggcatgatttctccctcccctcccctcccctcccctcccctcccctccccttcccttcccatttatttattgagacagagtttcactcttgttgcccaggctggagtgcagtggcgcaatctcagctcactgcaacctccgcctcctgggttcaagcaattctcctgcctcagcctcctgagtagctgggattacaggcatgtgccaccacacctgactaattttgtatttttagtagagacagagttttgctgtgttggccaggctgtccttcaactcctgacctcaggtgatctgcccaccttggcctcccaaagtgctgggattacaggcatgagccaccgtgcctggcccgttattttttatatctttaattatttttgaatatttttgtctctttttttttcctgagacagagtctctgttgcccagcctggagtgcagtggcgcgatctcggctcaccgcaagctccacctcccgggttcacgccattctcctgcctcagcctcccaagtagctggaactacaggcgcctgccacgacgcctggctaattttttgtatttttagtagcgatggggtttcaccgtgttagccaggatggtctcgatctcctgacctcgtgatctgcccgccttggcctcccaaagtgctgggattacaggtgtgagccaccgcgtctgacctatttttatcttttatgtgtattctttgtttaaatcaactctctctctttttttaatctcctggtttttatggtgtttttgaattttttattttgagatttaatttagaatttttttttctcttccatgtcagggtttggcaaaccaaggtcggtaggccaaatctggtgtgctgcagatttacgtaaacaatgttttatcaaaatacaactctacccagttatttgtgtattatgtttgtttgcttttgcactacagttgcagaaaggaatagttgtgatagagactgtcctgcaaagcataaaatgctatctagtcctttatgtaaaaaaagttttaccaattcctttcttgtagtatatttgtataacctgggttgtggatgtatctacaagggccatttacatctgcttttacaatatctatggggctttttctgttttcagagcaggtttgtattaatattttacttggtggtttattcaccaaatatatgatgtgaatttaagattgccatataagcctgacatatactttaagttcccacaagttatgtttttctttcataaacatatcccaggggacttaaaattcttttctgctttttgtagagcttgtgatgtgttttaatacctttttcatagatagtgtctccagttgataggatcattttatgaacatggttcagtttagcttgcttcctttaggatgccaagaattatatcctcttggtctgctggattttggaacccatgcctcctagttcttattcgtctattccacgtatagtaaaatttggtcgctagctcaaatttagctttactattcttattttgaatctctgcttcatttctagcatctgataattcccatttcttttaaagtggtatatgtgttgaaaaatgctttgggtaaatttttgtcttaaatttctgtgtatatttttaaaatttattaagattgtcacaaagatatttttaaatgttgcgcatctgttgcagagtaactatttttcaaaactatgtacttatttgcatatcaaatgctgagttgtcattatattttattttgatttttttctgtttgtgtgtccataaatgaggagccatctggagtggttttaaaatttagagaaaatagaatggatgacttctctttagttttattcatattccatagctactgagatattagatgatattagaacctttcaagcaacaatgtaaacctcaacactcttatgtgcaagctgacattacctgtcgatctaacactcttttggtagtggggaatagaacataaccataggcttactaatataccattttcttgttatttgatacagccattatgcctgggtccccttttctgtaatatactttctcctttgccattgctaccatattagttataaggtgtgacaattaccagacttttttcagcagatattttttctgcaggtaggtctaaagtatactggctttctgcatcatatatagaccatgtcaggcttccttgatttatactttccaccagatggatgaaggaataccagtgatatgcttcttgactgccctatgactaacctttgttttcagaatttttcttattcaggaaaggagggttgagtggcattttgctagggaacttcttttatcatcaagaggtattatagattactaccttctagttttgttcatgtaggtcaccataatgcctatcattgctggtacatttacttattattttaccattaatctgtgagggagatgttagatatgagtgctaaatttagctgtcttattcagatgttaaaacttttttttttttaatgattcttccaaatggccagaaatttcatgaagttgttacagtaacccatttcttactttaaatcttctggtaagtctttacatgtagtgggcactcaataaattttgtttttacctgagtgaattaattagtggtgtcacagagtaaattttctatgaaacagtaccttgccagggcaactaggcaggagaaggaaataaacggtgttcaattaggaaaagaggaagtcaaattgtccctgtttgcagatgacatgattgtatatcgagaaaaccctattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttaaagggacatgaaggaactcttcaaggagaactacaaaccactgctctaggaaataaaagaggatacaaacaaatggaagaacattccatgctcatgggtaggaagaatcaatatcatgaaaatggccatactgcccaaggtaatttacagattcagtgccatccccatcaagctaccaattactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgcacatctacaactatctgatctttgacaaacctgagaaaaacaagcaatggggaaaggattccctatttaataaatggttctgggaaaactggctagccatatgtagaaagctgaaactggatcccttccttacaccttatacaaaaatcaattgaagatggattaaagacttaaacattaggcctaaaatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaaacaaacaaccccatcaaaaagtgggcaaaggacatgaacagacacttctcaaaagaagacatttatgcagccaaaaaacacatgaaaaaatgctcaccatcactgaccatcagagaaatgcaaatcaaaaccacaatgagataccatctcacaccagtgagaatagcagtcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaatgtggcacatatacaccatggaatactatgcagccataaaaaatgatgagttcatgtcctttgtagggatatggatgaaattggaaatcatcattctcagtaaactatcgcaagaataaaaaaccaaacaccgcatattctcactcataggtgggaattgaacaatgagaacacatggacacaggaaggggaacatcacactctggggactgttgtggggtggggggaagtggggagggatagcattgggagatatacctaatgctagatgacgagttagtgggtgcagcgcaccagcatggcacatgtatacatatgtaactaacctgcacattgtgcacatgtaccctaaaacttaaagtataataataataaaaaataatttaaaaaaaagaaacagtaccttaagcttttaaggataatgttataaaattaaagtttttaataacattattgtaaagataatattaatttattatagacaattggtaatacagaaaaatcttactttagtaagatacccatcagcttttccataaacgtatttatacatttcatcacaaaattgtcactatgttaaattgaaacaaaatatgcacatgtttcacacggttcaatgcgatgttttaatacaggtatatgttgtataatggtcgaatcatggtaattaacatatctattaccttaaacatttataatgtgtttgttgtgagaacattcagaatcctctcttctagctatttgaaatgcattattgttagctataatcaccttactactgttcttgtactctattgcatcataggtattcctcctatgtgtaatattgtatgcattaaccaacatgtccctatctccccctcctcctattctctccagtttcttgtaatcatcattatactcttaatgtctatgagatcttttttttaaagataccatatatgactgagatcatgtggtgattgtctttctgtgcctggcttatttcacttaagaaaatgtcatctaaactcatccgtgttgtcccaaatgatgggattttattttttatggacctttttcatggctgaaaaatatttcattgtgtgcatgtgtgtatgtgtatttatttgtttattcacactttctttatccattcatccatgtttggtatttaggttgatcctatattttggttattgtgtgtagtgctgcaatatattaatacattgaagtgctgatgtctcttcaacatactgattttatttcctttggatatacacccagtagtgagattgctggatcatatagtattatatttttattttttttgagaaacctccaactgtttttgatgtaccaatttacattcccataaaaaatgtatagagttcccctttctccacatacatgccagcatttgtttttttcactgtcaattttataatttacccatggctgtttaggagcatgttctttaatttctatctatttgtatagtgtttgaagttccttctcttttcttctagttttatttcattatggtcagaaaagatacttcatatgattttgatatatttaattcattaagacttttttcctaacatattagctaacctgaagaatgttgcatatgcatttgagaagaatgtgaattctgcagcttttggatggaatattttgtatatgtgaagtcatttttgtcataaattcagtttatgttcagtgtttccccatatattttctgccttgatgatctgtcgattgctgagagttgggtgttaacattcccctactactattgttttgctttctatacctccctttggatctattaatgtttgctttctatattaagttactccaatgtgcattccatataaattctcgattgttctatcctcttgtattgatccctttatcagtaagtattgacctcatttatctctttttatagtttttgacttgaagcctattttgtctaatagaagtatagttaatcctacttacttttccatttgcgtgcaatatgtttttgcatctcattactttaagtctatgcacattcttaaaggtgaattgaatcttttgttggcagtatgtagttgggtcttgtttctttattcattgactcactgtttgtcttttatttggagaatttaagccctttacattcaaggtaattattggaaggtaaggattttgtactgccatattgctacttgttttctagttgttttgtagaacatttctttctttcttctcttactgcctccctttgtgttaagtgattttctctagcaatatgatttgatttcttgctttttatttttagtgtatatattgtaggcttttgttttttgcttaccttgagcctatcaaaaacatcttattattttaaaaggctattttgaattgataagttaattttggtcggaagaaaaggaaaaacccactctattctttaacttcattactcttctacattttgcatttttgatgtcataatttacatcttatattgtttatcccttaaccaaatcattttagttgttgttatttttatttgctttgttttttaaccttcctaataaggatataattgtttcttgacccacgattaccatgttagagtattctgaatttgtttagatacttatttttacctgtcagttttatagttttgaactttttttgttacacattaggattattattttttctttttgttcgaacaactcctgaaagtattttttttgtaatgtagttctggttgcaagggttttcttcagcttttgtttatctgggaatgtctttagtctttatttctaattaataagtttgctctatacggtattcttggcaggcagttttgttgtctttgaatatgtcatcccgctctctcttggcctgtggggtttctcctggtaactctcctgtcaggcatattggaattcctttatgtgttatttgctttttttttttttttttttctcatgctgctttcagtgttctctgtctttgacttttgagaaagtggttatatatgtcttagggttatcttatttggattgaatctgttttgttacctttcacctttctgtacttgaatatttatatctttcttcaggtttggacattttctgttattttttttaaataagctttcttccccattttcattttttattcttttttgaacactaatgatacacagatttgctcttttgacactgtttcatagaacctctgtgtttttctcattgcttatctgttttcttctctgagtgtgtattttccaatagcttgtttttgaaatcagtgattcttctgctttgtcattctgctattgatgccctttattgcattttttttttttgagacggagtcttgctctgttgcctaggctggagtgcagtggtgcaatctcggctcactgcaacctccacctcctgggttcacgccattctcctgcctcagcctcccaagtagctgggactacaggcgcccgccaccaagcctggctaatttttttgtatttttagtagagatggggtttcaccatgttagccaggatcatctcaatctcctgaccttgtgatctgtctgcctcagcttcccagagtgctgggattataggcgtgagccaccgcaggtgtgaggcctgcatttttcctttcatttattattctttttagctcctggattactgtttgattttttaaattatttcaatttgtttgttgaatttctctaacaaattcctcatttgttcctctgtgttgtattgacattgctgatttttcttaaagcagctatattttaattctttgattgcctatgatttatgtgcatatgtttaggattagtaattggcaccttgttttgggcgtttcatgaggccatcttttccaagctaatcttatatcttctttacatgtgtctctgtatgtttattgacaaattaggtatttttttccagtctttgcagtctggatttgtttgtgactgctctgtttcggtgggcttgttgacatattctgagcatactgactcttgtatttcattttagtgctagaaggtgctctgagcccagctttgacatgattgtctaatgcaggatccaaactcattgtgatcatgggagatccatattgggtgcccaggccatgtaagagatcagggtcagaccctcacatatgaaggattgtagaccatccatctgacattgtggcactcataaacatcctctgtggtggggcatcctctctgccagggatggtaagccactgccaagttctctgtgctgcctgttactagccctactctttcttttttccataggtggcctcaggtggttcagccccattgtacttgtgatgctcttcatgggctgatgcagaagcaaatctcccatgaagggattcaggatggtagagaagcataatgcctatctccggcttcctcttttgagtgtagaatccctgagtcctggagacctttctgtgtatagtactctaagggcttggggatggggtattgtggtcacagaaaactgattctcttaccatccaaccatacttttactagtctgtagtctggagaggcttcacagccttacttgtgcattcaggttttttttagccctcgtgaaggcaattgtatgtgtgagtggttgttcaaattgatgtttcttcgtgggtataattgttggagaaacctattttgctgtttgctctgcttccttgaatttaacattgccatctttctaaatataatgctctgtattaattgcttctcttaatttgtcatgaacattattccttgctattaaattttctaattgtttcataatgtaatatggagtttaaaaacattataattattctcaatttcataaagaggatgatgagcattttttcataactgcatattctttctataatgtgttacaatagacttgcacctctaagaatttctgtaaagtatttggttttactcttttgtttgtctgtttcttcacatgctaattcattttgatgatcctatgctagcctcttgggaattcctctcactttcagattttctgaatataagaggcagttttacatgctatttaatatctgttttttttttacattcaatgttccatatacatatttgtttctgtcgttgattagctgtgtgactttgtgtagttgcttaacccagatttctccatcttagaatcagtcctgaacacagcaacttccacatagcattgttttgaagattaaataataaaattcatatgtacaatttggtcctctgtctggccaaggcatggtgtttacagtgtttaaaaattgatgcttatgtacacttaccaatcagaacagataccaactacaaacaattggcaccagcagaatattggctttcctcatggagtgagagagagctcagttaaatgctagttgctatcatagttgtaataagtaaaaataatcatgagggtgacaattaagatgatttttggccaagcagttaccagactaagttaattttatgtcccaaataggcacaaagagcatgagcctttcatacatgaactttattctgaaatttttatattctgctgtaatattaacatcgaaacatggaagtctcagttacacagatatataaacaatctcatactttatatttcattctgtttagttcaaacttaaatagactttcagttaaatcttgaagtttttcttacctaaagaagatacatatttatgcaaattaattcaaaagtacttttttttttttttttgagacggagtcttgctctgttgcccaggctggagtgcactggcacgatctcggctcactgcaacatctctctcccaggttcaagcgaattctcctgcctcagcctcccaagtagctaagattacaggcatgcaccaccatgcccagctaatttttttgtatttttagtagagacagggtttcaccaagttggccaggctggtctcaaactcctcacctcaagtgatctgcccacctcggcctcccaaagtgctgggattacaggtgtgagccaccacgcctggctcaaaagtactatttttattaattttactattagtttactttattctggttagaatctattgccacactattttctatattgattgactctttattatcatgtgttaatataattaagatgaattttagcattctttatcaaagttatagtatttagccttgtgtttatataacttaacagacataccattcttatgaatttttaaggattatgctaaagattattccctctttagctataacttttatgttccagttcatctttaaccatggcattgtaaagaggttaaggtaaaatttcaacacatgatttatggtacatactgtcttgcacaaaactttgagctatatgtgttattaatttttaaacaaaacttggaagatgctctttgggcacttttacaatccagctttttaagatacattctttgttttgatagctattatacttgatattatgttagatatttgtaatgctttttactgtttcctttagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacaggtaagtttcttttaagcaaattttggtgtatttttactaaggaaaagataattaagaaagcagcgcctgttgtggagaatatatactactacagaaaattttttactcagttttagtatgttttctaaagtaatacatattagaaactgtgaactataaaaattctgtaatatgcttgattcaaaaatattcctttttcttatttcaaaatgaatgcatgtttcttattgtaatttctcaaacacagataaataaaagaaaaaacacctactatctcactattcaaaaataatcattgctgatagtttttttaataagtaataatttattgttttgacttcagaaataataattaaaagttaaatgtgtttaacttacatcaggtaagatttttattgcacagggtggtagtatagagtagtatctaggagagtatgggtttggaaccaaatctgggctgaaatcccaactctgtcactgttcaaatgtatgaccttggttcattaacctctcagtgtcttatttttcccatatgtaaaatggagatgataataattcactgagttgttgtaaaggtcaaatgagattttatgtaatataggccttaggaattgaagcacataaaaaagagcattataaatgctagccataatcatcacattcttgtttactaaaccctactttcctccatcttcctctctattctgccacttctttctcctactttgtaaataatatttgttctttaaatataatttccttttaaagtagaatttaatagaaatccttcattatctctagattggaacttgtcttttaaatttttaatctaccgtctctaaatggagtttgcctacatagcacccacagaaatacgtttttggctgtgaagatgtgaggaatttgagggagtggagcctgactctggttagataatttttttttaacactagctgcatattagaaccagctggaaagcttttaaaaatatggctgtctgggccactttctaaaacaattaaatcattatcttggttgtggttgtagggtgattcttaggtaattgttctttttaaatgtttcccaagtgactaatatgcactcagagttgagacacatggggaatgatgaactgattcaacatttgagtcaacaaaattgtgcagctaatacagttgtaccttggtatccatgcggattaattccaagacctttcctgtgtaccaacatctgcagatggtgaagtcccttacatagtggtgtagtatttgcataaaactgatgcatatcctcctgtgtacttcaaatcatctttagttgtaattcctaatacaatgcctatatttcacttcattcacatggattcaaagtatacttggtgcatggcaaatataaattttacattttggaatttgggggattttttctgaatatttttgatctgctgttggttgagttcacagatgtggaacccatgggtaaggagggcctactgtagtatgttgggtgacaaataaagataggtgaatggaagttttgtgttatgcagtgctctgatccatttgaagctctaatacagatgcattggcccacatttaacattttttatatcctaggcaccgtactaatagctttattgtcattattttatattagctttacaaaactgtatggtattactttgatcctcattttacatgtggacacaaatatttaatgcacaaagaagttatctaaaatacccaagatcatattgctagttagagtaagaaaatgtctcattcctaaacctcgctcttaactgttaatgcaggagttatgttcatatggaccaggaagatccagttgttctcacctaaaagccacagcttagtgctctgtccagtggatacataagatgcagtaattatgggccaagtggaatccacaaaatttagggtctacatactagagtcatagtgttttttaattttatatttctaaaaagaccaaggttttcaagacaagctctttctaaagtgtttcagtactgaattttccatggccatacattttattggagaaagtgcatgtgtcagataggttatgtgtgttaatgtattgattgcataatttgaagaaaaaatatactatgagatgttttcattcacattacaatttgtgtgtctctgtaaactgtcgtgtatttaatataaaattgtggtatgttttattttacttttatgaaaattattttggatatattttccaacatattttcatgcccatatgtaattagttcattctgtaatttacttaatatatttctgttggcatttatataatgcttctaaccataactccaattcttgagaatgactttttagcaaagtgaaacccacataacagacacttaactatgtacagtgttgtgcaactgtctgatttttttttctttttttttttagacagagtctcgctgtgttgcccaggctggagtgcagtggtgtgatctcggctcactgcaacctctgtgtcctgggttcaagcaattctcctgcctcagcctcccaagtagctgggggggggggactacaggggcccgccaccatgcctagctaattttttttttttttgtatttttaatagagatggagtttcactatgttggccaggctggtcttaaactcctgacctcgtgatctgtctgcctcagcctcccaaagtgctgtggttacaggcgtgagccaccatgcctgggcattttttaaagtttttaattaaaaagaattcaatttttaattttgtgggtacatagtaggtgtatatatttatggggtacatgaaatatcttgatacaggcatgcaatgtgaaataatcacttcatggagaatagggtaacctgctcaagcatttatcctttgtgttacaaagaatctaattacactctttaagttatttcaagttattttaaaatgtacaattaagttgctactgactatagtcaccttattgtgctatcgaatagtaggtcttcttcattcttcctatttttttgcacctcttaactataccccctgccctccagccctctaactattgtttttgtacccattaatcatccctaccttctccccagcaccccattacccttcccagcctctggtaaccatccttttactgtctatgttcatgaattcaattgttttgctttttagattccgcaaataagtgagaacatgcaatgtttgtctttctgtgcctgtcttatttcacttaacatagtgatctccagttctatccatgttgttgcaaatgacaggatctcattcttttttatggatgaatgccataaaaaatatataccacattttctttatccattcatctgttaatacagcagtccccaacatttttggcatcagggagtagttttggggaagacaatttttccacggatggggtggtggtggggtatagtttgtggatgaaactattctacctcagatcatcaggcattagttagattctcataaggagtgcgtagtctagattcctcacatgtgtagttcacagtagggtttgagctcctatgagaatctgatgccaccacagatctgacaggaggcagagctctggcctgaatgctttttcacccgctgatcaccttctgctgtgcagccggttcctgacaggaaatagactggtaccagtccatacccaggggttggggacccctgtgtaatggacacttaggttgcttccaaattttatctattgtaaacattgttgcaacgtaggagcgcaggtatctctttgatataccagtgtcctatttttaaggtttatacccagccatggaattgctggatcatacggttgctcaatttttagtgttttgaggaaccttcaaacttttctccatagtacttgtactaatttacattctcaccaactgtgtacaagggttctgttttctccacatcctcacaaacatttgttattgcctgtctttggatataagccattttaactggggtgatattacagttctgatttgcatttctctgatgatccatgattttgagcacctttgcatatgcctgtttgtcatttgtatgtcttcttttgagaaatatctcttcaaatattttgcccactttttgattggattattagatttttttctgtggcattgtttcagcttcttatatatttgggttactagtcctttgttagatgggtagtttgcaaatattctctcccattctgtgggttttctcttcactttgttgattgtatcctttgctgtgcagaagctgtttaacttgttgtaatcccatttgtccgtttttgctttagttgcctgtgcttacagggtattgtccaagaaattttggcccagaccaatgtcctggagatttttccccaatgttttgttctggtagtttcatagtttgaggtcttagatttaagtctttataccatatgctttttatatatggcaagagataggctctagtttcattcttctgcatatggatctccagttttcccagcaccatttattgaagaatctgtcttttccccagtatatgttctggtcacctttgtcgaaaatgaattcactgtagctgtgtcgatttgtttctgagttctctgttctgttccattgaactatgtgtctgtttttatgccagtattatgctgctttgcttgctgtagctccttagtataccttgaagtcaggtaatgtcattccttcagttctttttgctttggatagctttggctattctgggtcttttgtggttccatatatattttaattttttttctgtttctgtgacaaatgttactgttattttgagagggattgcattgtatctgtagactgccttgggtaatatggacattttaacaatattgattcttccaatccatgaattgattcttccaatgcatttttggtatcctcttcaatttctttaattagtgttttatagtttccattatagagatctttcacttctttggttaattcccaggtatttaattttatgtgtggctattataaatgggattactttcttaatttcttttttatattgttcactattggcatatagaaatgctactgatttttgtatgttgattttgtatccttcaattttactgaatttatcagttctaagatttttatggagtctttaggtttttccaaatataagatcatattatctggaaacaaggataatttggcttcctcctttcctatttggatgccctttatatctttcttttttcttattgctctagctaggacgttcaggactgtgttcaataacagtggtgaaagtgggcatccttattgtgttccagattttagaagaaagcctctcaattttcccccttcagtatgatactagctgtgggtctgtcatatatggcttttattaggttgagttatgttccttcaatccccaattttttgagggtttttatcatgaagggatcttgaattttatcaaatgcgttttcactgtcaattgaaatgattagatcatttttatccttcattctagtgatatgatgtgtcacatggactgatttgcatatgttgaaccattcttgcattccagggggataaatcccacttggttatgaatgatctttctgatgtactgttgaattttgtttgctagtattttgcaccaacattcactagagatattggcctgtagttttctttgtttgtttttgacatggagtctcgctctgtcacccaggctggagtgcagtggcacgatctcagctcactgcaacctccacctcctgggttcaagtgattctcctgcctcagcctccaagtagctgggactgcaggtatgtgccaacaagcctggttaatttttggatttttagtagcgatggagtttcaccatgttagccaggatggtctagatctcctgaccttggcatctgacagccttggcctcccaaagtgctgggattacaggggtgagccaccacacccggctagttttctttctttttttttcttttcttttcttttctttttttttttttttggtgtgtgtgtctttgtctggttttaatatcagggtaatattggccttgtagaatgagtttggaagtatttccttctcctctatttttcagaatagtttgagtaggattggtattagttctgctttaaatgtttggtagaattcagctgtgaagccatcagaccccaggcttttctttattgggaaactttttattataccttcaataacattacttgttattggtctgttcaggttttggatttcttcccagttcaatctcggtaggttgtatctgtgtaggaattttttatttcttctagatgttccagtttattggcatgtagttgttcatagtagccactagtaatcctttgaatttttgcagtatcctttgaaatgtctccttttcctttctgattgaatttttttgtgtgtcttctctgttttttcttagtttgtctggctaaaggtttttctattttgtttaacctttcaaaaatcaaccttttgtttcatcagtcttttttttattgttttcttcatttcaattttattatttctgctttgatctttcttattttcttctattaattttggttttggtttgctcttccttttctagtttttaagatgcatcattagattatttgaagcttttcctctttttttgatgtaggcacttatagctagacacttcctcttagtattgctttgctgtatcccataggttttagtatgttgtgtttctattatcatgtttcaagaaaattttcagtttccttcttagtttcttcattgaccctctggtcattcaggagcatattgtttaatttccatgtatttgtaaattcctcttgttattaatttctagttttattccattgtggtcagagatgatgctttatattatttcagtttttttcaatgttttacaacttgctttgtgacctaacatatggtctatacttgagagtgatccatgtggtgaggaaaataatgtgtattctgcagctgttggatgaaattttctgtaactatctgatagatccatttggtctatagtgcagattaagtcccatgtttctttgttgattttcttcgaagaaagatctgttcatagctgaaagtgcagtgttgaaatctccagctattactttattggggcctatctctctctttacctctaataataatatttgctttatatatctagatgcttcattgttgggtgtatacatatgtttaaaactgttatatcttcttgctgaattgaccgctttatcattatagagtgaccttctttgtctattcttttgtttttcgtcttgaaatctgttttgtttgatgtaagtatagctactcctattcttttttggtttccatttgcatggaatatatttttccattcctttatcataggctacatgtgtctttatttgtaaaatatgtttattgtaggcaacagattattgagtattttttttccatccattcagccactctcttgattgaagagtttagtctatttacgttgaaagctattattgataagtaaggacttacttctgccattttattatttgttttctggttgttttgtgttcttctcttccttctttctttctgtcttgctttagtgaaggtgatatgattgagtttcttggtttttatttcttgtgtatcttgtttttttgttttgaggttaccgcgagacttgtaaatagtacattataacccattatttaagctgataacaacttgacactttttgtggtcctcttttccttctttctttccctcctgtcttcctttagtgaaggccttttttttcctggtgatatgatatagttttttagtttttattttttgtgtatccattgtatgttttttggtttgaggttaccatgaatcttgcaaaaactaccttatagcccattattttaacctaataacaacttgacactgtttgcataaacaaacaagcaaatgaaaactaataaaaactctataccttaacctcatccatctgctttttaacttgttattgtttgtatttatatcttattttactgtcaacatcttgaaaagttgttattatttttgagtggttcattgtttagtctttctatgtaggataagagtattttactcaccacagttacagtgttataatattctgtgtttttatgtgtactcactgttactggtgagttttgtgttttcaggtgattacttattgctgattaatgtcattttttttttctgtttggagtactccctttagcatttcttttaggacaggtctggtgctgatgaaatcactcagcttttgtttgtctgggaaagtctttatttctccttcatgtttgtaggatatatatacacttcaaatatatacattttaggatatatatacatttcaaatgtaaaagttgttttccttcagcactttaaatatgtcatgccattgtctcccggcccataaggtttccactgaacagtctgccgccagatgtattggagctccattgtatgtgatttgttgcttttcccttgctgcttttaggatcctttctttattcttgatctttgggagtttgattgattactaaatgccttgatgtagtcttctttgggtttaattctgtttggtgttctataaccttcttgtactttgatattgatatatttctctagtttgagaagtttcgtgttgttacccctttgaataaactttctacccttatctgtttcacttcttcctttttaagaccacgaactcttagattttcacttttgtagctattctctaaattctgtagatgtggttcattgtttttaatcttcttcttttgtcttttctgacagcgtattttcaaatagcctgtctttaagctcactaattttttcttctgcttgattaattctgctattaaaagactaatgcattcttccatatgcgaattacatctttcatctacagaatttctccttgataccttttaattatttcagtctctttgttacattcatctaatagaattctcaatttcttctttttgttatcttgcatttctttgagtttcgtgaacacaggtattttaaattctctgtttgaaaggtcacatatctctgtttctccaggattggtccctggtggcttatctatttcatttgatgaggtcatgttttcctggatggtgttgatgctaatagatgttcttcattatctgggcattgatcagttaggtatttattgtagcccccactgtctgggcttgttggtacctgtcctccttgggaagactttctagatgtttgaaaggacttgggacttggatgttatggtattagttgtatctgctataggggggaccctaagcccagtaatactttacttacaaactcatagagggactgccttgatggtcttggacaaggtctgggagaattctggattaccaggcagagactattgttctcttaccttattttctcccgaacaaacagaattcctctctctgttctgggccacttaaagctgggggtggagtgacaaaagtaccaccgtggccatcaccagtatgactgtgctggtcagacatgaagccagcacaacattggatcttgcctacagcctgctgtatgcactcactggttactgcctgtgttcgcctaaagtcctggggctctacaatcagcaggtggcaaagccagctaggcctgtgttcttcccttctggatgacgagttccctcaggcccctggtgggtccagaggtgctatacaggagttagggactagagttaaaaaccttagaagtctacttagtgttctattgtactttggctgagctggcactcaaaacgcaatatgcagtccttcccactcttccctcccttttccaaaggcagaagagcctcacctcatagccactgccatcaaaggccatggggagtactgccagactacagctgatgatcccttaaggcctaagggctcttaagtaagcttatggtgaatgctgcctggcctgggactcaccctttaggggagtgggctcccctctggcctagggtaggttcagaagtgccatccaagagttaagtcctaaaattggggatcccaagaccccacttggtgctccatccacctgtgactgtgttagttcctaaggtacaaggcaaagtaccatttacttttccctgtgcttttctctaacataagagttttgccctttagccactgcagctggtaatgtgctgtgtttcacctgaagccagcaagtctcagaggctcacctaagaccctcaacatagaacgtgggtattgctgctggttattcaggacccaagtactcttcagttaaccaggtgatgaatgcttccaggactgggtcctttccttcaagtcagtgggttcctttctggcccagtatgtgtctagaaatgtcgtctggaagctaagacctggaaggagggcctcatcattctgactggtgccaagacaaagtcctctccacttttcccacacctcttctcaggtggaagttaggggtctcttttggaaccacgatttgtgcagtctggggttagaggagaggcaatgccagtactcccttagtcaccccctctgctgtcccagcaggtcctgtgccctccagttcactgtttctgggcccagttcagcactaggacttgcctaagagttgtagtccttatggcccagactgcctttcaacttcatttaaagactcagagcattttagcccttggtggtgaggtcagtgggaactgaagttcagactgctaggattggcgattttcctttgtctagtgctggtttgtatgtgccttctgtaggcgggtgtcccctgagttttgttcagttctcctttctactatagcaggacagcagtgagttcagtccctcacgattattgttttctccctcctttagtgcctagagatactttcctccccgtatactgccactgcagggaggtgggagagggctgatgttggcaattggagaatttttaagaaatcacttcagtgcctctttcactgatagaagttaacaccaggtactatgagggctcacctgatttttggttttatgaaggtgttttttctgtttagatagttgttaaattgatgtccctgttggaggggacgattgatggaaccttctattctgctatcttgctctgtgtctctatcacctttatctatttcttaaacattttttatcatcccaaaaggaaactccgtactcatgaaggagtcaccccagcccctggcaaccactgctctgctatctgtctttacaaatttacttatattctagatatttcatataaatggaatcacagtatgtaacatcttgggatttccttctttcactaaatgttatgtttttgatgttcattctcattgtagcaagtaccagtacttaatacctttttacagctaaataatactgtggttttgatttccatttccttaatgattaaatattgaatatcttttgatgtgcttgctggcccttgtatcttagtttggagaaatacttattcaagtactttacctgtttaaagaaactttgttttcttaaattttggaaaaatatgcataatataaagtttaccattttaaacatttttaagtatacagtttagtggcattaaggacatgtgcattgttttgccaccatcattttcattcctctttaaaactttttaatcttgtaaatctgaaactctataaccattaaaaaatagctacccactcccccacctccttccagaccctaagaactgccattctactttctgtttctgtgaatttgatggctatagatacctcatgttaagtggaatcatgcagtttttgtcctttggtgactggcttatttctcttagcataagccttcatggttcattcgtatgatagcatgtatcagactgtctttcctttctaaggttgaataatgtttcattatgtattagtacattcacaatgttgtacaactgtcacctttatctagttcttacacacatcatattttatctatctatttattcattgatggacacttgagttgcttccaccttttggctgttgtaaataatgctgctaagaatatagcttacaaatatctttgtgagtatttgtgtcttttcatatgctttttagccatttctttatcttccttggagaaatgtctattcaaatcttttacttattttataattgggctttttttgctgttgaattgaaaaagttctatatatcttctagatatgaggctcgcatgagatatatgatttgtattttccaccattctgtaggttgtgttcacttttttgatggtatcctttaaaacgcaaaagtttcaattttgatagtttatctatttttttattttgttgcttatatttttggtgtcatatctacaaatccattgccatatgtaacatcacaatgattatttttttgccaacataggtaaaagtaatatatgaatggctctattagctccaaaatgttttaaattattatggtaagttttactattctaacaggcagagtgcttttaggaatatgttcccctttaaggataatacttctctgctaggttgaagacaagtttagttatttcacattaatttttgttactgacgtgatacatttgacaagccaaagtaaaggcaatgaaaaattaaatagagtgaataatagatgcctgttgtattcactgttatactttctccggtagtttatgaaatttttaaataattctttaagagtttccgtgtttcttaaagttggcaggaaatattttgctgtctatgacttttatatggtgatgtgatgggtaaaagtcatttttattttttggggccacattagctacctaataataaacaataagtcacatctgatgaattattttaatgtagtaatgtctaaaatcaatttataaagcatggaaagtaaacatttattactattctttcatttttagttcactttattgggaaaagctcatttttaaaactagtaaatatacttattaaaattcaaagtgcatgccgatattaagggaaagtaggaaataaatttatatttgactggcaaagctttaaatatactgcagcatatatattattttaaaaatccaacctaataaagccaatctaacattattgtcaattattattatattatggttagtcagttattataagttactcttaaaatgttttattaaaattttatttataatgttcaggaagattctctgattaaaaacttgctttggagatatgtatataaaatatttatgtgtgtatatgtatactatatatatatgtatatgtaatctttgtggctatggaaaaatataacaatgttaaatgcttgggctttggaatcataccacttgagtctacatgctggcaatgccactgtcaccttggataaattatttaacttttaacttaattttattttttgagatgcagtcttgctctgttgcccaggctggagtgcagtggtatgatctcagttcactgcaaccccagcctcccgggttcaagggattctcctgcctcagccttcctagtagctgggacgacaggcacgcgccactgcacccagctaatttttgtatttttagtagagatggggtttcacatgttggccaggctggtctcagactcctgacctcaggtgatccacctgccttgacctcccaaagtgctggaattacaggcatgaggcaccgcgcctggcctatttaactttttagtgtcttagttttctcatctgcaaaatgcagctaatttaatttatgttgtaatggtaagtcataaatgtggtactttatatgttgtataatatatgttcctggcaaatgttaactccctaatcctagctattattgtgatattattattactattcataacatcaataagtttagtattttgataaaaatatatgattcaaacttttatggcagtattatttttgtcatattatttccaatctgacttataaactgtagtaaaagaaactaaattaatatttagttgaatagaagaatggctcagtacattacacattatgttatttgcaatgaaggaatatccttgaactccataaatacttattgaatgcctaataaatgcaaggaacaatgttaggacttgaatttatatacattgtgtgggtgctattatagtgttatgaagaaattgagtgatagaattagtgacaaagagatgaattctcattgaagaatctggtcttggaaggtctttcatttcttcaatatttaaaaaaataattggatatataatagttgtacatatttaaggggtacatgtgatattttaatacaaatagataatgtgtaatgatcaaatctgggtaactgaaatatccatcacctcaaacatttatcatttctttgtgttgtgaatgctccaagtctactcttctggatcttttgaaatatacaataaattattttaaactatagtcactttattatgctgtggaacactagatcttattctttctttctaactgtatttttatacccattaaccatttctatttatcctcatctcctcactagtgttcacagcctctagtaaccaccatttcattcactacctccaggagatcaattgttttagctcccacatatgaatgagaacatgagacatttgtcttttgtacctggcttatttcacttaacataatgttctctagttccatcagtgtcattgcaaatgacaggatttcattctttttaatggtggaataatgttccatttgtgtatatataccacattttctttcattgttcatctgtcgatggacacctaggtggattccaaatcttgcctattgcaaataatgctgcaataatcatggatatgcagatatttctttgatatactgattttccttcttttggatataaccagtagtagaatttctggatcatacgtagttctgtttgtagtgttttgaggaacttccataaacctccatactgttttccatagtggttgtactaatttacatcttgaccaacagtgtgtgagagcatgcccctttttctgcatcctcaccagcatttgttatattctgtcttttggataaaagccattttaactgtggtgaggtgggttgcatttccctgattattactgatgttgaacattttttcataaacctgttggccatttataagtcttcttttgagaaatgtctcttcaggtctttagcccaatttttaattgtattattattattattttgctattgagttgtttgagctccttatgtgttctggttattaatcccttgtcatatgagctatttgcaaatactttctccccattctgtaggttttctctttactttgttgattgttagctgtgcagaagcattttagcttgatgtgatttcattttttcaatattactttggttacatgtgatttagaggtcttactcgaaatctttgcccagaccaatgttctgtagaatttcctcaatgttggctgggcacaatggctcacgcctgtaatcccagcactttgggaggctgaggtgggcagatcatgaggtcaagagattgagaccatcctggccaacatggtgaaaccccatctctactaaaaatacaaaaattagctgggtgtggtggtgtgcgcctgcagtcccagctacttgggaggctgaggcaggagaatcacttgaacccgggaggcggaggttgcagtgagccaagattgcgccactgcactccagcctggtgacagagcaagactctgtctcaaaaaaaaaaagaaaaaaaaaaaaaaaaaagaatttcctcaatgttttcttctagtggtttcaaagtttcaggtcttacatttaagttttaaatctattttgttttaatttatatatatcttgagagttagggggtctagttccattcttctgtatatacaggatataattttctgagcaccatttattgagagactattcttgccccagtgtatgttcttggcaccttctttgaaaatgagttgtttataagtgtgtgggtttatttctggcctctctattctattggactatttgtctttatgccagtatcatgctgttttgtttgctgtatagctgtataccataattcgaagtcaggtaatatgctgcctctagctttgttctttttggtcaagattgctttggctattctgagccttttatggttcaatatgaattttaggatttttttttccatttctgagaagaatgtcattggtattttgataaggagtgcatttaatctgtagatacctttgggttgtatggatattttaacaatatttgttcttccaacttatgaacatgatatatattttcttttttgtgtccttttcaatttctttcatcagtgttttatagttttaattatacagagcttttactactttgattccatttattttatttgtagctattttaaatgggattactttttgatttttcagattgttctctgttgccatacagaaatgctactgaatttatatgtcaattttgtatcctgcaggtctactgaatttatttattagttctaataggtttttggtggagtctttaggttttttgaagtataagatcatatcatctgtaaacaaggataattttactttctcctttcctgtttggatgctctttatttctttcttttgcctaattactctgggtgggacttccagtactatgtctaataaaagtggtgaaagtgggcgtctttgttgtattccagatcttagaggaaaggctttcagtgtttccctagtcagtatgatgccagtggtgggattgttttatatgacctttattgttttgagttatatttcttgtatccctagttttttgagagtttttttttaaatcattaagggacgttgaatttcattgaatgctttttcaaccattgaaataatttttgacctttattttgttatatgttatagcaaatatgctatattttgttaaatgcgctatgatgtatcacatttatcgatttgtatgttgaactatcttgcacccctgagatgaatcttacttcattacgatgaatgatctttttaatatgttgttgaaatcagtttgctgaattttgttacagatttttgcatcttgttcatgagtgatattggcctgtagttttcttttcttgtgttttgttttgttttgttttgttttgtttgtgtttttgtttttaattgtgtctttgtctagttttggtatcaggataatgctggccagtaggatgaatttgagagtgttctctcatccttgactttgtagaatataataagtagaatttgttagttcttctgtaaatgatttgtagaattcagcagtgaaactatctgatattgggcttttctttgatgggagtctttattattgtttctgtttcataacttgctattggtctgtttagtttttctgtttcttcatggttcaattttggtagtttgtatgtatttaggaatttatacttgtctcccaggctttacaatttattgggatatagttgcttatcatagtctctaatgattctttgaattcctgtggtatcaattgtagtgtctttttttcatttcttaattatgttcatcttctcactttttttcttagtgtagctaaaagtttataaattttagttattttttcccaaataacttctccttttgttgatcttttatatatattttttagtctataacttattcatttgtgctctagtctttattagttcttctcttctcctaagtttgggtttagtttgttctgcttttttattttctaagatgcactattaagtgttcttatttgaaatcttttttgatgtaggcaacattgtttttgtggtgtcccataggttttggtatgttgtgattctatttttatttgtttcaagccattttaaagttttattcttaatttcttaattgaaatttaatgttttcattccttcagcagcgtattgtttcatttccatatatttgtatagtttccaaagtgtcattattcatttctagttaattccactgttgttagaaaaaatacttgatactctctttgggaggccgaggcagctggatcacctgaggttgggagttcaagactagcctgatcaaaatggagaaaccctgtctgtactaaaaatacaaaaaaattagctgagggtggtggcacatgcctgtagtcccagctactcgggaggctgaggcaggagaatcacttaaacctgggaggtggaggttgtggtgagccgagattgtggtgccattgcactccagcctgggcaacaagagcaaaactctgtctttaaaaaaacaacaacaacaaaaaccaacttgatattattttgacatgtaatactttgttgagactatcttcctggcctaagagatggtctgtcctcaagaatattccatgtgctaatgagaagaatgtatatttttcacccgttgaatgaaatgttctcttattgatcattaggtccatctggtctgtagtgcatattaagtctaatggtgcattgttgattttctatttaaaatatatgttcagtgttgaaagtgggtgttgaagtccccaggcattattatattggagtctgtctttctctttaggtctagtaatgtttgctttatattatctggatgctccagtgttttgtgcaagaaatatttgcaattttaatattctttggctgaatttgaccattttattattatataatgaccttctttgactcttcttacagtttttgccttgaaatctattttatctgacataggtatagctattcttgttttttgtttccatttgcatggaatatttcatttcatttccttcatttttagtgtatgttgtttttatagctaaagtaaatttcttatgggcagcatatatttgagtcttgttttaatccattcagccactctctgtcttttatttgaagaatttagtccatttacattcagtgttattgttgaaaggttaggacttaactacttccagtttgtcatttttcttctgattgttttgtacattttctcttcctttcttcctctcttcctttttagattagtgatttcctctggctgtatgttttaattccttgctttttattttttcaatttctattataggtgtttgctttgtcattactgtgaggcttgcaaaaatattttatagctaacaacgttaaattgataaaaactctaatctcaaagaagagggaacaaaaggaaaacaagcaaagaaaaaactaaaaaattctgtactctaacttttcctctaactccctcctactttttgactttttgttgtctctatatcttttcatattgtctatctttcaaaaattgttgtagttattatttttgatagatttttcttttggtcctcatgctgaaaatgtaagtgatttacacaccacaattgttgcactagagcaagcttgtctaacccgcagcttgtgggccacatgcagcccaggacagctttgaatatggcccaacacaaatcagtaaactttcttaaaacattataatttttttttagctcatccactatcattagtgatagtgtgttttatacgtggcccatgacaattcttcttctaatgttggactcttctgttagagtattctgaatttgtctttgttcttaccttttccactgaatttcatgctttcagatgttttcttgttatatgttagcagcctttactttcagattgataaaatctcttcagcatttttttttgtaaaatctcttcagcattcatctggtgatgatgaatttactcagcttttgtttgtctgggaaagtctttatttctcctccatattgaaggatatctttcctgtatgcagtattctaggttggaagttttttccctttagcacttttaatatgctatcttgctcattctggtctataaactccccactgagaaggctgctgccagaaatatcagagctcctttatatgttatttacttttttcttcttgttgcttctaggatgattctttcatctttgacctttgatagtttgattattatatgtcttgtggtagtcttatttcagttgaatcttcttgatgttctttcaccttctttacctaaatgttcgtatctttttctaggtttgaaaagttctcttattactttctttgaataaactttctaccccggtctttttctttgtatcctctttaagaccagtgactcttagattttcccttttgaggctcttttttagatcctgtaatcatattttattcttttttattcttttaaatctattttcatatagtatgtcttgaactaaatatttccgtttttgcttgatcaattttgtttttgagagattctgatgaatttttcagtcagttgactttttcagctcgagtgattttttattgtttatttcagtgtctttgttaaatttctctgttttatcttgaaatgcatcatgttttctcaaaacaggtgtattgaattctttgtctgagaatatatgtatctgccactctagaattggtcatgggtgcctcatttactccgtgtgatgaggtaatgttttcctgaatgctcttgatgcttgtggacatttgatgatatatgagcgttaaaaatttaggtatttgttccagtctttccagtctggcattgtttatacctgtccttgagaaagttttctgagaattcaaatgggattgagtgttaaattacttatttctgtggtccttgcagttgttttagcactagagggagccctaagcccaggtatgctgtactcttgcagactctaggtacatagcctgggtagacttctgaaagtgaagggagaattccttttgttatcaggcaaagtccctttctgtcttttccagaagcataaggagcccttctctaccctgaactgtctggagttggggaacgggtggcatgggcactttttatgtacatatttgtttatccaattatttgtaaaacaaaagatgtactataagaaaaatatgtcttcaaatcatgaaatatacagacattaaaaaaaattccaatcctatataactaatagtttcctccatttaggtcttactcttttgggttaagtttattgcaaggtgcttaatgggttttgttggtattatgaatacatttttttcctttaatattacatttgtaattggtaatgtctgtttttatatctgttatgtttttagttcattttgttgatctttttataggtttttgaatagtaggcttatctgattttcttaatttctctctatattttaagtttttaacagtgataaactttaatttttcagttttggggaaaaaagagttctttcaacataatgacagttctatttttaccttatgtttctctttttggcatactgtgactatctgttcatagcagacttttacagacgtgtttaatactttaatacacacactaggatgtgacccaaacattctctgagactcaagggtagtaaaaaggaagatgaattacctttttttctctcttctaagatgaggaaatttttcattttaaaccattctcacacattgtagattattcagagaagcagaaaatttattaccaaatgaggttgagcatttcttaaaataagtgtaggaagcttaattctctcaaactaggaacattgaaaaatctcaagctgcagatacatgaaaatagcttgagatggaaatattggttctatttattcttttgacacaacaatgttaaaagtttgtattctctcagtacatactacgttctgtgttgcacaggaaagccaacttgagattttgaatattccaaagagaggccatccttttgagctgttttcattctttttgttttcataaaaggaatttcaaaggtgaggagaactgaggctatgaaaactgtttggccctgatgtcagatattttagcatgccttcattatgggttactggaatatgcagtttattacttatttctgttagatgcttttaaaaagaactatctgtgggctaattcccaaagttcccctggggaactttgccatggctttatcaaacctactcccttcctcaggatctcttcttctaatttttatttgtacaaagttttatgttctacctcttcaaactttgactaagcattacttcaacttttgctatttgaatagtgatttttaggcccttagatctgatgttatagaatatcttcacctctggtttacaagtttttgacaatgaagtgtgtcatttacttgctttcttttcaggaacaagtggactaatatatctctatgtaattttgaaaactattcaatagtttcagttctgtaggtagaatactatttatttggggccagagagaaactattattttgtctaagggttcaatatttctctttaattttatttgatgtgatgcttagcccctataatgtattgcttgaggtttgcattacaagaatatggcactatttggttttttaaaaagtgatataagatgttatgattgaacttaataataaaaatggttcttatgccaactcacaagtgttgtagaattcctactggcttgaaatgacaggcctagggtgaagaaaagataaatttaaagtggggcatagttctacttatattctaatacgtataaaacatttatttagtacagttcagaagattataggttaacctaagaaactttaaacatacttttggttttattctgatatttgtacaattttttcaaaaggcaaaaccaaactaaattccaatttggacacacacttttgcattgctcaaatagtgcatgaatactaattagtgatggtggagaagttaattatattttagtcatgcctacagcaggtgtaggaaagcttcagcataaatattgtttataaatatttcataaacacattaaaatcctccttaatatattatttaggaagaagtgcctttctctcaaagacccatttttatatgccataggacatggatccaaatatttacttttctcttagttacacatacttttatctatatcttttatcttacctttactttatggccaatttattgattttatagtaataatttatgtttttaggctttaaaggaagtatataaacatttaattatatatttgcttaacagtacagcctattttattaggcaatttaaaatttttaactttctgctgaacatttccaaagtcccactactatacaaattaattagttaagaaatggaattcattgtcgttattattttaaatatattctctctccatccctatcttagttaatgatactatcactcttttaggctcaatttcaaaagcatcttcttattccatcttttccctctgccagtatattcaattccaaactgatcctggctctgcactatctatgatatttattcccttcttggagttcattgcccttattagtttaggcctccatgatcctgcttctcttgtgttcttgttagatgttacagattacctgacatgatataagttctcattaaatatttgttgaattaatgcatgaatgctctcactatgtatttatagactctctccatttacaatccacctttatacttccttcataggaaaagaaaaaagagacaattttcttcctaaaatcattcaaaaaacttattttgttactatttctaaaatatttgttgcctgcaaattatctatgaagtacatttaaagctcctttataaggcttgtaaatccttttatactgagcccagataacttttcttgctttacgtcttaccatatttttcatattctatcatatctttatttttttattttttgcaatttacattttactcaataatacattttccttgtcagttaagctccaagcattatatctaaaaatgtggataatgtttattgattataccaggtacattgctaaaaagctaatctaaatgtttttcgattaattctaagcatttaataaagattttagtatacctattttagttattatttattatacctattttacaaatgagtaaaccaaggacataagcctaactcctttttgaaaggttaagtcattaagtgctagaatgagaattgaaaccttgaactacctgattctaacagtggtctaaaccagtatgttcttatattttctttgactctcacatgcaactagtggccagctcttatccattttaaggccataatattgcacatccattgtcctacttatgtctattattatttagccttgactgttacattagcttctaaacagatcttttaatcagtattttattcagtttccaagacttccacaatattatatagtttttacttcatatccaaccactcctccctataaacccaggtctttgcctatttaaatgggtgttatgtccctgcctttgaactcaaattactcatttttcaaatctcagctccaataaaattccagcctaaaaacttgtcataatatccccactaacttcaggcaggtttgtgcctccatgattattaccatcagtgttcttgttaagtcataatttacttgtctttttatctagcaggatgtgaacatctttatgagagaatttttgtctcatatgttttgtagttttttacattcttgtatgctcactattaggtagtactgtacttggtacatagttagaattttgctgtattaatattactacaaagtaacatttgtttcatctgttttaatcatttttatattatcgaaaagaaaatattatttagtcttcctagcaaacgagttttctagtttcaactaatttttactttacaggaagaggcaaaaagtagcttcctgtttttaaaattattgattattctgcttgcttttattttcagcaattgggccaacagtgaaataacactggcagttccaatgtatgtattatatttgctctgaatgagaattggttttaattattatagatgatttcccattctcataactcttattgagcaataatgcaatattttatatataaattttttcattgaagactggtaagagaagttatgtaaagctcaaataaggaagaaaatgcaatttatgtaactctcttcagtttctagtttttctagagaagataaatagaatcttgatatctgacttttcagagcttaactatcttacattttgactcactaacctattaattctggagtcattttagcagaatgtattattctatacaataagttactagataacttcaaagtactaatatttcactttaccataacatatgtattttatgtgatttttaacatacattttgtgcattcttctagctgtaagcgtccaacttctggaatttcaaagtagtataagactatgtaactcccattatttgtaacagaagatatttgagtaattattcacatatgatattttatatattttaaaaattaagcactagtgttttcttgacaaatggaataatcgtttatttcatatattcctaacaacatcccaatacccaaaaagaaaaaaataactacccttaatatatgtaggaaaaacaaagaactcttcaaataaagttgttacacataatgttattattgatttacaagtcaaaagaataaaaatgcattttattgtctatttctaagtgtagaaatgtttagtatttataaaatggaaaagttctatttaatttgtttgttttgacataagtccatgtgaaagagctataaagaaaatacaaacagttcccccaaattgcctttctctcttcatggctttcagttaaacattgtaaacttaaggtctctttaccccttaaatactttagtgcatatttcttaaaaactaggaattctcttaaccacagtataattattgaaatcagaaacttaacattgatgcatattgttattaaatatagattttattcagattgtgccaattgtctcaatgttgttttttaaagcaaaaaaaaaatccgattattagttgtgttcatttttgaggccttcttagtcttttttttttaaaaaaaaatttattttactttaagttccagatacatttgcagaatgtggaggaggtttgttacataggtaaacgtgtgccatggtggattcctgcacctgtcttagtctttaacctgggtaatttcccaactctttcattttgtttaatgtcatttgacattttttaggactacactatattatttttgtgtatggatagaatgtgctacaatttgtgtttgctatgtcttcatgattatgttctgattatgcacttttggcaggaatacctctgaagttatgttaaattcttaccaacgtatcaggagccacatgctgtcatcatgctcttaatagggatgctcacaatgaacctttggttacagtggtgtctgccagacttcatcactgtaaaggtgctattttatcctttacaatgaatgagaatcttatgggagatactttgagactatgtgcatgttgtgttagtcctcagtctttcacccgctagttctaacatatattgatagttcttctgtaatcaatgattattatgatttttaccaaatggtgattttctaatttctttattctttccacattgattagttggctttctactataatgagaagcttgcttttctctcttttgtctacctgtctatgtatgtatgtatgtatgtgtgtaatcctttcattctttgagcatttccttatagtttcggcatttatcttgtacttttccagccataactgtggaagctagcatttatcaagcagctttggtacttttagtgggctctgagcatcattgtttgtggatcacctcagcagacaaactagagaatacatgtatgtgtacagaaatgcttacataggtgtctactcacagacacatgtattttcatacatatgcacaacctcacctacatcaatattcatttcttccttcttcacaatcctttaaaaatgcaataacattcttagcttgagaatcatagaaaaattggacatgggctggatttggaccccatatcatagtttagtgacccttagaatatatggtttgagtttcctctcattttttaatgtggtatacaatgttggactgtaaaatgtaaattttatagcactcttggccctttgagtctccaatttataacttaaatttttgaaacagtgctattttctggaagattccagttacttaaggtttaaattattgtttatgatcatgttcacgtactggagcactgctttgaaaacattcagtaagtactggatcaaagaatgaattactttaccttttttatcgaagaaagaatcatttcttgttttcccactctttaatataggcaagtacaggtgcctaatatcctaaataaacaaagtaatctgattaagtcatatggccttttctaaattgcaagagctatcatgtatccaaaagaaaaaaaaatttacacttctcataacagcaggttaatatatggcaatggttgtaaatctagggcttttttgtgagaaaaatcagatagtgaagatattgatatcagcatttcatatttatttatataaaaaagaaacagctatattgttttcctttttcataaactataaattgatgaaaatttgggcttagagctataaataaaaatgtaagttaaaaaatagaatgaaaatttatttttcatatttttaattgaccagtgaaaattatgtatatttataatatacaacatcatgtttggtttatgaggatatattgtggaatgcttaaattaacttaacatatttatcacctaacatacttatgattttttgttatgagaacatttaaaatctgctcagcggtttacaagtatgcagtacattgtttttttttttttattatactttaagttttagggtacatgtgcacattgtgcaggttagttacatatgtatacatgtgccatgctggtgtgctgcacccactaactcgtcatctagcattaggtatatctcccaatgctatccctcccacctcctcccaccccaccacagtccccagagtgtgatattccccttcctgtgtccatgtgatctcattgttcaattcccaccaatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaaatggtgtgagatggtatctcattgtggttttgatttgcatttctctggtcagtgatgatgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaagtctttagtccatcttcaattgatttttgtataaggtgtaaggaagggatccagtttcagctttctacatatggctagccagttttcccagaaccatttagtaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttattcttttggcttaggattgacttggtgatgcgggctcttttttgattccatatgaactttaaagtagttttttccaattctgtgaagaaagtcattggtagcttgatggggatggcattgaatctgtaaattaccttgggcagtatgggcattttcacgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatatcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagttattgcccattcagtatgatattggctgtgggtttgtcatagatagctcttattattttgagatacatcccatcaatacctaatttattgagagtttttatcatgaagggttgttgaattttgtcaaaggctttttctgcatctattgagataataatgtggtttgtgtctttggctctgtttatatgctggattacatttattgatttgcgtatattgaaccagccttgcatcccagggatgaagcccacttgatcatggtggataagctttttgatgtgctgctggattcagtttgccagtattttattgaggatttttgcatcaaggttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactactgagtattgccacaatttcagctcccgttattggtctattcagagattcaaattcttcctggtttagtcttgggagagtgtatgtatcgaggaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatgaattttgttgatcctttcaaaaaaccagctcctggattcattaattttttgaagggttttttgtgtctctatttccttcaattctgctctgattttagttatttcttgccttctgctagctttagaatgtgtttgcccttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacagctttatttctgccttcatttcgttatgtatccagtagtcattcaggagcaggttgttcagtttccatgtagttgagcgattttgagtgagattcttaatcctgagttctagtttgattgcactgtggtctgagagatagtttgttataatctctgttcttttacatttgctgaggagagctttacttccaagtatgtggtcaattttagaataggtgtggtgtggtgctgaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctgagtctctttgtaggtcactcaggacttgctttatgaatctaggtgctcctgtattgggtgcatatatatttaggatagttagctcttcttgttgaattgatccctttaccattatgtaatggccttctttgtctcttttgatctttgttggtttaaagtctgttttgtcagagactaggattgcaacccctgcctttttttgttttccatttgcttggtagatcttcctccatccttttattttgagcctatgtgtgtctctacacgtgagatgggtttcctgaatacagcacactgatgggtcttgactctttatccaatttgccagtctgtgtcttttaattggagcgtttagtccatttacatttaaacttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatcggttagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgatcgttggcctgccttgctagattggggaagttctcctggatgatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatcgcatcagctcctgaggcttctgcattcttcacgtagttctcgagccttggttttcagctccatcagctcctttaagcacttctccgtattggttattctagttatacattcttctaaatttttttcaaagttttcaacttctttgcctttggtttgaatgtcctcccatagctcagagtaatttgatcatctgaagccttcttctctcagctcgtcaaagtcattctccatccagctttgttccgttgctggtgaggaactgcgtccctttggaggaggagaggaactctgccttttagagtttccagtttttctgttctgttttttccccatctttgtggttttatctacttttggtcgtcgatgatggtgatgtacatatgggtttttggtgtggatgtcctttctgtttgttagttttccttctaacagacaggaccctcagctgcaggtctgttggaataccctgctgtgtgaggtgtcaagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcagttggagctccctggctgctttgtttacctaagcaagcctgggcaatggcgggcgcccctcccccaggctcgctgctgccttacagtttgatctcagactgctgtgctagcaatcagcgagactccgtgggcgtaggaccctctgagccaggtgcgggatataatctcgcggtgcgccgttttttaagccggtccgaaaagcgcaatattcgggtgggagtgacccgattttccaggtgcgtccgtcacccctttctttgactcggaaagggaactccctgacccttgcgcttcccaagtgaggcaaagcctcgccctgcttcggctcgcgcacggtgcacgcacccactgacctgcacccactgtatggcactccctagtgagatgaacccagtacctcagatggaaatgcagaaatcacccgtcttctgcgtcgctcacgctgggagctgtagaccagagctgttcctattcggccatcttggctcgcagtacattgtttttagctacagtcaccatggctgtagatctccagaaattattcttcctttctaacaaaaactttgtacattttgaccatctcctcatttcccatccccttttccacaccagctcctggtaaacatcattctaactctctgcttttgtatattcgattctatttttttttttttttgaggtgaattctcgctcttccgcccaggctggaatgcagtggtgtgatcttggttcactgcaaccaccgcctcctgggttcaagtgattctcctgcctgagcctcctgagtagctgagattacaggtgcccaccaccacgcctggctaatttttgtatatttagtagagacggggtttcaccatgttggtaaagctggtcttgaactcctgacctcaggtgatctgcctgccttggcctcccaaagtgctgggattacatgcataagccactgcgcccagccgtaaatttgagattttagatactgcatacgagtgaaatcatacagtattagtctttttttaacctggcttattttcacataaaataatatcctctaggttaatccatgttgttgtaaaacaccggatttgcttatttttaaggctgaataatatttcatttttaaatatatatattataaatactatgtatataatgtggagaaaatatgggggatggaggattctgtgatgaggataggggttgtgtgagggggatggggtaattctttgaaggggattggggttctgtgagggggaagggggttccatgaggggatgggggttctgtgaaggggataggattctgtgaaggcgatgggattccgtgagagggatgagggattctgtgagcgggattggggttttgtgagaggatgaggcttgaatgagttgatcacttttgtgtagtattcatccattgatggatatttaagttgattttgtatctttgctagtgtgaatactgctgcagtaaacatggggagtgcatatatctctttgaaaattgatttcattttccttggatatatatacacagtagtgggatttttggatcatatgaaaggtccattttcagttttctgagtaaactgcatactacattccataatggccttattaatttacattccccccaacaatgtacaaaggttccctttttttccacatcctctctaactcttgttatcttttgtcttcctgataacagccattctaacagatgtgaggtggtatctcactatggttttaatttgctattccctgatgataaatgatgtggaatatcttttcctatatttattgaccattttttaatcttttgagaagtgtcttttcatgtcctgatatggtttggccatgtccccacccaaatctcatcttgaattggagctgctgtaattgccaggtgttgtgggagggatctggtagaagataattgaatcacaggggtggatctttcccatgctattcttgtcatagtgaataagtctcccaagatctgatggttttataaaggggagtttccctgcacaaaatcttttatcttgtctgccaccatgtgagatgtgcctttcacattctgccatgattgtgaggcctccccagccatgtggaactgtaagtccattaaacctctttcttttataaattgcccagtctcagtatgtctttatcggctgtgtcaaaatggactaatacagtaaattagtaccagtagagtggggcacttctgaaaagatacctgaaaatgtggaagcaactttggaactggttacaggccaaggttggaacagtttggagggctcagaagaagacagggaaatgtgggaaagtgtggaactccctagagacttgttgaatggctttgactaaaatgctgataatgatatggacaatgaaatccaggctgaggtggtctcagatggagatgaggaacttgttgggaactggagcagaagtgactcttgttacgttttagcaaagagactggcggcattttgcccttgccctagagatttgtggaactttgaacttgagagagatgatttagggtatctggtggaagaaatttctaagcagcaaagaattcaagaagtgacttgggtgctattaaaggcattcagttttaaaagggaaacagcataaaagtttggaaaatgtgcagcctgacaatatgatagaaaagaacatcccatttttctgaggagaaattcaagccagctgcagaaatttgcataagtaatgaggagctgaatgctaatcaccaagacagtggggggaaatgtctccagggcatgtcagggaactttctggcaggctttccaaccacaggccaggaggcctaggaggaaaacattttttgtaggccaggcccagggtccctctgctgtgtccagtctagggacttggttccctgcatcctagccgctccagccatgaataaaaggggccaaggtacagcttgggccatgggttcagagagtgcaagccccaagctgtggcaactttcatgtggtattgagcctgtgggtacacagaagtcaagaattgaggtttgggaacctcttcctggatttcagaggatgtatagaaatgcctggatgtccaggcagaagttcacttcaggggtggggcactcatggagaacctctgctggggcagtgcagaagggaattgtggggtggtacccccacacagagtccccactaggtgtgatgcctagtggagctgtgagaagagccaccatcctccagaccccagaatggtagattcaccaacagctggcaccctgcatttggaaaagccacagacactcaatgctggcctgtgaaagcagccaggagggaagctgtaccctgtaaagccacaggagcagagctgctcaagaccatgggaacacacctcttgcatcagcgtaacctggatgtgagacatggagtcaaaggagatcattttggagctttaaaatttgactgtcttgctggattttggagttacatggggcctgtagcccctttgttttggccaatttatccaatttggaacaactatatttaccgaatgcctgtacccccattgtatctaggaagtaactaacttacttttgattttacagtctcatagacagaagggactctccttgtctcggatgagactgtggacttttcagttaatgctgaaatgagttatgacttgggggaatgttgggaagacatgattggttttggaatgtgaagacatttgatttggtaggggccaggggcagaatgttatggtttggctgtgtccccacccaagtctcatcttgaattgtagcccccgtaattcccatgtgttgtggaaaggacctggtgggagatagtggaatcatggggacaggtcctttccatgctatttgagatagtgaataagtctcacgagatctgatggtttgaaaaaggggagtttctctgcacaagctctcttcttttgtctgttgccatgtgagacatacctttcaccttctgccgtgattgtgtggcctccccagccatgtggaactgtgagtccattaaacctctttcttttgtaaattgctcccagtcttgagtatgtctttatcagtagcgtggaaacggactaatacatgttctttgtccattttaaaaatcaggttacttgttttcttgctattgagttgtttgagttccttttatattttttgatattaacccctcatccaggtatatgatttgaaaatattttctgcaatttcctaagcgtatcttcactgtgtggattgcttctttggctctgcagaagcttcttaattggaaacaatcccatttgtctatattttttttgtctatttttaagctttaattatctgtgcttttgggaccatgttcaaaatatttttgccaagagtaatgtcaagaaggcttcctatgtttttctctaagaattttcagggattacctttaagtcgttaatccattttgaggttatttttgaatatggtataagataaaatttcattttcattcttatgcatgtaaatatccagtgttcctaacagtagtcattgaagaggctatcctttccttattgtgtgttcttgccacctttgttgaagatcaatagactctatggttatggatttatttccagtctttctattttatttcatcaatcatatgtctgcttttgtgctggtatcatggtgttctgattactatggctttgtagtttattttgagataagatagtgtgatgcctccagcttcgttctttttgctcattattgctatggctatatgagctattttgtggttccataattttagggttgtgttttctgtttctgctaaaatgccattggcattttgatagggattgcattataccagtagatcactttgcgtaatatggacatcctgagaaaatgaattcttttagtccatgaatacaggatattgttccatttatttgtgtcctgttcaacttttttcatcaatgttttataattttcagtatataggtcattcacttctttgattaaatttattcctaagtattttatttttcatagctattataaatgagattatttcttgattttgtttttagatagttcactgttagtgtatagaaatgctgctgatttttgtatgttcattttgtatcctggaacattcatgaatttgtttgttatttctaatgggtttttggtggagtctttgcagttttctgtaagaacttgtcatctgcaaacagggacaattttacttatttctttaaaatttggatagcttttatttctttctcttttctaatttttgtggctaggacttccagtattatgttgaatagaagtggtgagtgtcggaaaccttgtcttatttattgttctagaagaaatgcttttgacttttcactaatgagtatgatgttagccatgggtttttatctaacttctttattatgttgaagtacattcaatacttaatttgttgagcattttttcaatcatggaagaatgttgtattctgtcaaatagttgttctacatctactgatattacgtgatttttatttttcattctcttaatgtagtatataacagttgttgatctacatatgttggaccattcttgcatccctaggataaatcttacttgatcttgatgaatgattttttttcattaaaggattattgaaatgattgagtttgtttcataatattttgttgatttttttcatctatgtttattagagatattgactggtaatttcttttatcttagtgttcttttctggctttagggttagggtaatgctggccatataaaaatgagtttggaaacatttcctattttaatgtttttggaaaagtttcagaagcattaatatttattcttctttaaacatttggcagaattcagcagggaagccatcaggatctgagcttttctttgatggtagacttttcaatatttatttaatcttctaaattgtttgattctgtttatattttctatttcttcatgattcagttttggtagattgtatgtttctagaaacttactcatttcttataagtgattctatttgttgatataaaattgtgcatagtagtctcataatcttctatgatattagttgtaacacttctttaattttctttatatgaatcttttttgtgttttcttagtttagttaatggtttgtcaattttgtttatcttttcaaaggaaaaaactcttagtttcattgatcttttttatttttttctagttcctatttcatttatttatttatttattttgctgtgatttttattatttctgcctcccttctgctcactttggactcaactttcttttccttctcattctccttctccttctccttccttcctttccttccttccttccttccttccttccttccttctttccttcctttcttcctccttcttccttctttctttttttctttctttctctttcttcttctttgtttcttgagatctaaagttaggctgtttatttgagaacgttcttcttttttgaagtaaccattaattgcataaattttcctattagtattgttttgttcaacccataacttttggtaggttgtgattccatgtttatttttgtcaagacatatttaagtttctcatttgaattattctttttgtttaggaacagatagtttaatttccacatctttgtgaattttcaatttttcctcctgttactgatttctaatttactaccattgtggttggcaaagatgcttgatatgatttcagtcttcttgaatttttaagacttgttttgtggtctagcatattatctatcctgaagaaagttccttgtgtgtttgagaagaatgtgtatgctgttgttgttgaatggaatgttttttatatgtcttttaggttcattgatataaagtgtaggtcaaatccaatgttgttttttttttaatagacattttatctggatgatctgttcaatgttgaaagcaagggtattcaagtcccttactattattttattgtagtctatctgtcttttcagatctattaatattttctttatatatataggtactctgattttggtgcatatatatttataattgttatatccatttaatgatttgatcttgtttttattacctaatgaccttctttttgtctactgatacattagattaaggtctgttttgtctgatatagccacccctgatctcatttggttattctttgcatggaatatcattttccatcccttcactttctatgtatgcctttaatattaaagtttgtctcttatagggagtctattgtttgatcactaaaaaaagtccagttagctaatctgtgtctttttatttgaaaatttaatccatgtaagtttaaagtaattactgataaatatttaatcttgctattttgttaattgtttggtgattgttttgtagttcttttgtttctttcctccaaccttgctttttactttgtgttttgttgtatttttatagtggtatgctctcattcttttttctttatcttttgtgcatgtactagaggtttttatttcatgattaccattaagcataaaatataatattctgatttaagctaataataacttgaatttaatcacctacaaaaactatgctttttcacctttccattacattttatgtaattgatgtcaacttattttttatattgtttttagaaaatgtattatgactatagatacttcattacttttttcttttaaattttatactacagctaaaagtgatttatataccactgttactgtattactgtattctgaatttgactatagatttacatttactagtgagttttatattttcatatttttaatgttgttacttatcatactttcatttcaaattgaagaatttcctttagtatttattgtaaatcaggtcaagtggtggtggactctcttagctttttgtgtgtcttgaaatgtgtttctctctatttcacttctgaaggacacctttgctgatgtaaaagtcttggtggtgtttttttcctgtaagcaatttgaatacatcatccttcttcctcctgttttataaggttgttgttttttttaaagggggtagggatttccattaatagcctaatggagattccttgatatgtgatgattctgttatctcttactgctgaagattctctgcctttgactttatttatttatttatttttgagacaggatcttgctttgttgcccaggctagagtgcagtggtgtgatcatagctcattgtaacttcaaattctaggtcaagcaatcctcctgccttggcctccccaagtagctaggactacagatgcatgctaccacatccagttaatttttttagtttttgaagatatggggtctggtagctaggactacggatgcatgctaccacatccagttaatttttttagtttttgaagatatggggtctcgctatgttgcccagactgatcttgaactcctggtctcaagtgatccttctgcctcagcctttcaaagtgctgtgattataggcatgaaccacccagtcctgtttttgacttttgacaattttattatattttgtcacagagtattttttggattcatcttacttgagatttttttaagtttggaaatctggatgtctgtaaccttcccaatatttgggaagttttcagccagtatttctataagtaaactttttctccctttgtcacatcttctggtgatcccataattcatatgtttttatgtttgatggtgtcacatagattccttatgctttcttcattttaaaaagaatcattttttgtttttctaactggttaatttcaaatgatctatctctgagtttgctaatttttttcttgtgtatgattgagtctgctgtttaaactctctattgtgattttcatttctgtcatattttgtagctcttggatttctattttgttctttttattgtttacattttcttattaagcttctcattttgttcatgcattatttttataattttatttaattgttggtatggtttggctgtgtccctacccaaatctcatcttaaattgtagctcccataatttctcatgttgtgggagggacccagtgggagataactgaatcacgacggcagtttttcccatactgttcttgtggtagtgaataagtctcacgaggtctgatggtaccccattcacttggctctccttctgtcttgctgacaccttgtaaaaagtgccattcaccttccaccatgataatgaggcctcccccgccatgtggaactgtaagtccattaaacctattcttcttcgcagtcttgggtatgtctttatcagcagtgtgaaaatggactaatacggttgtctatctatgtttccttgcatctcataaagcatctttagcatcattattttgaattctttttcaggcaatttgtatttctccacttttgggcgttagttactggagcttttgtggtatcatatttttctgactttttcttaactatatagccttgcaccagtatctgtgcagctgaggagcaaacacctcttccagtccttacaaaatttgacagtctgtatatgtctttataagtccttctcctgttgggtccttgggctgatggaattgcctctgaaattatggttgaatggaattggagttggctcatgtggctgatgctgtttctgtggtagggtctgaagatgatgacactgctactggggctctagcaagtatgaattctctccatttcctaggtggactgcactctctccaggaccttggttggtagggcttacactgagatgagggttcagagttaacagacatttggtctgtggccacatatatggactactgtggcttcttctgcattcttgtaagggctgccactggatttctgggtgggtcctttagcagacagacagcacttccctggtctgtatccgagatggactgggactgagtcacagagctgcttcagggtctacacctgaggccaaggtcttcatatctgtctctgggatatcatacgtgtgtgtttactagcacgttctttggtgggtacacctgctctcagattgtagttgacaggggatacaactgatttatagggctgtttcaagatccacagtgggactaatgtcagcaggttagcctgtaggggcagtaacagacacgcccatctgtaggtccctgggaaggcagaactgatttcaggctgcagtcaagatgagccaggcccaagatccagggccatttcaggttctactgtggaactaaagttgataagcctgtcctggggactcagatgggcttgtttcccagtggtgccctgactaggcagaactgttttacaactgtaaataagagatactgggaccaagatccaaggctgtaccaggatgtgctgttggactgagtctgacaagcttctcacagtggcagaggagttagtctcccagcagttccctgtgtgtgtgtgattgtttctaggccacagcagagaggggctggagctgagattggggacctgttcaggatctgctttgggataagaccaacaagcctgtcacagtggcacagatcagcaagtctcccagtgtttttgaagcatagaattttaaattatagggtatttgaacttttgtctttgttagaattcttactatatttgaaatctaatctataacatatctattaaatttctttaagtataattatgctgtaaggatacaaagaaaattaaatttacatgatatcctaacctctaggggttgttacaagtatatgacagttgatgatgatgcaagcaaggaaataatgatatagcaagggatgggcataggaacataaactgattttgaagcaggtactaccattggctactctttggttttatgtttctaaagtgtttttttttataaacaacttctttcaataactttttttgcatctttttttatccttattgtttggttttgcttataagttgatactgcaactttatattctagggggcagaaatatgttggcctcattatgttcctttagtgtatatctagaatataaaatcatcatcatatataaaattttaaacaaaggccactgtataatgccttcataggtgctggttcagcataaaaggatagccacaaatgctgacaacaacagaataatttcagcactgtcatgaagtataaattttaaacaattgaatttaaaatgcatttgtgctattttactctgaaatacagtgccacaagggaattctctcacaatgagctcacaaaaagttagcgtcttagaaattattgaatttactgtacaatggtaattcttttaagaaatgtggcaagcataactagtatccagttttgccataacagataaatgaaaggtttatccatattttaagatattaatatacatcgttttagtgtaactctgaatatgacagtattaatatgaaactttgcagattaatattaaaagacatcatgatatattcattatttttgaagttacatattactaatatatcacggtgtgtctttactacttgatgacagtttcctttattccctgcagctctctgccttgtgtttcactctgtaattctcacatcttatgttcccacagctaattctacaaacttaatgaaaaaactgtgtaggtttatttaaatattctttatgaagtaaactttatacctttttttcttttgagacggagtcttgctctgtggcccaggctggaatgcagtggcgtgatctcagctcattgcaagctccacctcccgggttcacacccttctctcgcctcagcctccctagtagctgggactacgggtgcccaccaccatgcccagctaattttgtttttgtatttttagtagagacggggtttcaccctggtagccaggatggtctcgatctgctgactttgtgatccgcccgcctcagcctcccaaagtgctgggattacagtcgtgagccgccgcgcctggccaactttatatatacctttatgtaaaaatgtcttctagtagaaaaacaggttcttagaaacctttctagtaccaaaagtaattttatgtatgcatatggagatgtgtgtatttattttaatcatctgttttttcaaaggtaataatcataagcaattagcaagaaacttagtgttctacagtatttcataatacggcaagtactgatgatttttcaaacatctctgttaaaatataattcatacatttaaaaaattacaatttgaaagtatacaattcagttgtttttactgtattcaccgggtcatgcaaacataattataatctacctttaaaatgttttcatcacccccctctaaaaagccctcagtcattagcagccattccccttcctcccttgtcccccagccctgcctctggtagccctgggcaatcaataatctacttcctatttctataggttttattcttctggaaatttcatataagtgaaattatcaaatatgtgatctttcatgactgacttttttcatgtagtgtaataaaggttcatccatgttgtattatgtaccaggactgtactaatttttattgccagacaaaattcaattataatatccaattcaaatatggctatatcatattttgtttcttcgttagttgatggacttttgacctatttccattctttggctattatgaataatgctgctatgaacattccgtgtatgttttattgtggacatttaaaaaaatcctctttggtatatatttctagaagtagatttgctgggttatatgtaaattttatgtttaatattttcatggactaccaaattgtttccaagaatagctgcatcattatacatcttgaccagcagttcatgtgtgtttctatttctccatattccacaaactcttatcattatctgtcttttttgttatagccctcccagtatgtgtgaagtgatctcattggagttttgatttgcatttccctaaggagtaatgattttaaatatctttttctgtgcttatcagtcatttgtaaatctctttggaataatcttctttggaatattcagatatttttctggactttttttagttgggtatttatctttgttttttgtttatttttattattactattttttgagacagagtctcactctgtcgcccaggctggagtgcagtggcacaatctcgactcactgcaacttctgcctcccaggttcaagcaattctcctgcctcagcctcctgggtagctgggactacaggcacatgccaccatacctggcaatttttttttttttttttagtagacatggggtttcttcaccatgttggccaggctggtctcaaactcctgacctcaggtgatccgcccgtctcggccttccaaagtgctgggattacaggtgcaagtcaccgtgccaggccatgtttttattatttaatagaagagttctttatattctggatacaaataagaaatacaaattgcaaaaattttattccattctttattgtcctcttatttttttgatggtatcatttgtagcacaatatttttaaagactgatccagtccaatttatatttttgttttttgtgtgctcctagtactaaaacaattacctaactcaaggtcacaacgttttattcatacatttttctggagagctttataattttaactcttatatttaggtgtcttatgtattttgagtgatgtttagggcatggtctgatgtgtaggagtccaagtctattttttttaaacatgcatatctagttgtcctgccatcatttgttgaaatggctgttcttcccccatttacttattttggcacccttgacaagaatcaattggccataagtgtaatggtttatttttggactttcaattttcttccatttatacacaatttatatttataccagtattatgtagttttaatattgttgctttgtagtaatgtttgaaattgggatggctgagtctccaactttattcttcttttaaaaatgttttggctgtttgagactccttgtaattatatgtgtattttagaatcagcttgtcattttctacaaagaagacagctcagattctggtaaggattacatgaaatctatagagtaaatttatatatcatcttaccaatattaattcttcttatccatgaacatgggctgtctttcaatttatttataccatctttaatttttaaacattttataattttttacagtacatcttgtacttcttttattaaattatttcgtgagaattttattttaatactattttatatgaaattatttttttaatttcattttcacattgtttattgctagtgtatagaagcacaatagacttttatacattgattttatatcctgcttacacattgatttggtatccttgcttaattaatctattagttctaatagactttttgtggattatttaggctatccaagatcatgtcatatgtgagtcgtaatagcttcacttcttcctttccagtctggatacttttaattctgttctttgctttttttttttttttttaatagctacttggtttgataagaatctccagtacaagcataaaaataagtggcaagagcaggcatccatgtctcattcctgattgcagtgggagaaaagattctgttttttactgttaaacatgttagatgtgagtttttaaaaaaatgcccacactatttatcaagtacccgtatttgtgcacccttgtcaagagtcaattgtccataaatgtaatggtttgttttgggactcttaatttcattccattgatatgcattgtatatttatgccagtatcatgtgggtttaatagaaatagagaggaagttctttttatttctagttgagtatttttaatgatgaaagaacattggatttttcaaaataatttttctgtatttattcggttatttttgtttgtttttctttttttttttctctctctactggtctttttccttttagtgtggtacattgcatttactgatttttgtatgtgaaaccaactttattttcctaggataaagcccactggatcatggtgggaatctgttaatgtttgcctaaatttgctttgctaatattttgttgaagatttctgtaaagttggtagtgatgtctccctttcattcctgattaaaacatatgttttaaaaaatgataattatgaccgggtgagaaaatcttcatatctttgtgggtctgtatggtttgtgtctgtatgtaatttcagaaaagtaacatgcatgctagattaactatgtgtatagttagatatttgtatatgtgtataagacttgcagacattttcccttactgcgtttatgtttgtaagtttatatttataaaattgaatataatatcaatgaaaaatttccagttgtgctattggcataagattgatacctttccaaatcaagggtcccataagaaaattgcaaaattcagcatcgaatatatcatacttggtgctgcttccaaaaatatacaaatattcagaaatatattttaaattggatatgtgaggcacctatcacaaaatgtcatttataacaaattatgctactttacaaattaagataataaatatttgttgacaaaataaatgaagtaaagacagcatgatgtatgttcaaatactgtaaaatttagttaccttttccaaatacagactcagaaaaaatgcagttttgtttattttatgtaagttttactttctttgatgccctttaagtaattgcacttgagctgacttgatatcaactgagaagcaaggaaaatatcaaaaagtaacattatttaaaatatattattttgcgtttataaataggcacaatttaacagtacagatcttaaaattaaaattatttaattagtattatcttcatttcatatttgaaaaagtgtgagtttgtgtcattaaagcactaaaagatgcaaaacctatgcaaacaaatgaaagtaaatatattaacttttctcaattccctaccaaggaacatcatgttgtcataactatatgtattttatcttcatagaattagttataagtagtaaatgcatgttctttaaaagtgcccttagataaatgttgtcaaattctctatatccaagaaatcactaccacaatcaagataaacattttttttcaccccaaaagtttccactgtatctcctccccatcacttcctcacctgccccaaggtgcagccaaatactactttttaatttcttttggtcacaaatataagggtttttttttcttttaagaaaatattttatgctttatgggccattcggtctgtgtgcagcagctcaactctgcttctataaaatgaaagcagtcatgtatactatctaaacaaatgaatgtggctgtattccagtagaacttatttcatatacacttaaatttgaatttcatgaaattttcatgttatgcattttttcttcatttttttttcttcaaccattaaacattttaaaaatctaccctaagctcatgggtcatacaaaagtaaaagacaagctagatttggctcatgggctatagtttgatgatccttgctgcagactgtatttgttatttctaaagttttgcatacataaaattaaatagaactttcgtttctgatttctttcactcagcatttttaatttctctttttttttttgctgagtagtattttattgtctggatataccacattttgtttattccatcacacctggtttttttctagtttgtaaggagcaatattatttgttaatattgttacttacaatattagtgttaatatttatgtgtttatatttatgtgtaagtgtatgtgtgcatgtcttgcatttctcttgggtaaatactttagagtggaattgctttttgtgctatcataaatttgtaaacgtatgtgtcaccttataggaaattgtcaaactgtttttcaaagtaattgtatcattgcatatttctgtcagaaatttatgaggattttagtgtttcattttattgtcaacatttagtgtcgtcaacctttttacattttagccattatagtatgtgtttgatggtatgtcttgttgatttacaattatatttgtctgttggctaaggacattaaatatcttttcatgtgtttattagcaagttgtctatcttttctgcttgtgcgtatgaagtatctattcagatcttttgtccacttttaaaaactgggctatttttcttctttctgttaaattttaagaagtcttataatatttcacatagaagatctccctcagatatatggattgcgaatatttccctcagcctatgacttcacttttcattttattaagagtatcttcttataaaacgaagatgttttaaagtagataaattatatgtttttttctttgatattttatactttttgtatcacgtacgtgaaatctttacctaccccaaggatgcaaatattttttctctgtttttttcttccagaaattgtatagtgttaactcttacatggaaatttgtgattaattctgagtaaaatttgtgtgtaatgtgaagttgtgatactggttccttttttctcttccagatgtccagttgttctagcaccatttgttgaaatggcaattcttttctcattgaattactttagtacatttgttgaaaactaaattgatggaatatgtgtaggattgtttctgtcttctctattctggtccattgatcactctctttggcctaatgtcattaccaaactttcttaattgctatggttttaaagcacatcttgaaattatgtcttttaagtcttctgtcttcgtcttttttaaatgctttttttttcttcatgttttaagatgtatataagttttagaagtagcttgcaagtctctacaaaaatagccggctggaattgtattgaaattttataaaatttgttgtataaattttgggagaaatgatactttaccaatacgtaattttctaattcatgtgcatggcatatctatttatttagatatttaaaaatcctttcagtagatatggttgtcggtgtatagagcttgctcatattttgttaaatttgtctctaaatatttcacaacctgttgctaataaatgatattaatgtttgcggcagcgctcctttcacgggggcaccagctgcggggggtctgtcccttgcagatccttgacctggcgacggatgaataatgtatacttgacccacagatattctgctttgccaatccagttgagggtgttcaagctgcttacagactccccactgagtgctgtaaacagttgtgactgccttgatcagctagtgagactcgcatttattcagtaagactgattaacaaaggcttgagtcaacaccagtagaaggtaactgacattgtggacttctcctccagtaaaaagcacttaagcacccaaggtacatcaaaggttagtcttttttttttatttttattttattattattatactttaagttttaggatacatgtgcacaatgtgcaggttagttacatatgtatacatgtgccatgctggtgtgctgtacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgaagccataaaaaatgatgtcctttgtagggacatcatgtcctttgtagggacatggatgaaattggaaatcatcattctcagtaaactatcgcaaggacaaaaggttagtcttaagatcagatgagtaaacaagctagctaggtaaactactatgccgtcctttgttgctgctttaatttgtttaaaggtaaagggaccaggctgcctttagccagttctattaccgaagctatgcaaacttctcggcctttcaagatttgtgtgtctctataactatctctgatatttttcctaccagcctgattgaacccctacaaatgttaatttcaatttctagttgcatgttattactctattaatataattgttttctattgaggtacaattcaggtaacacaaaattattatgaaatccacaatccagtggcatttaggacattcacagtgttgtgcagccaacacctgtatcaatttccagccatttccatcactgcaaaagaaaacccataaccattaaacaacccagccctgggcagctacaaatctgctttcagactttatggatttacctgttataaatagctcctataaattgaatcatgtaatatgtaatcttttgtgtttggctttttttcactgcatatttttttaagattcatctatgtagcatgtattagtactttatttcttttcattgctgaattatattccattgtatggatattttatcatttataagttgatgggcctttgggttgtttccacttatggctattgtgaatctgatcactcgtatcactactgtaaatctactacttatgttatgatatatagtatcgtcatcatcacttttgaaggaaatttgtgtttattataaatttttagttttattgtgtgattaagtgttgttaccactttgtgtaaggtactgatgttttcctgtgacataatgcatgattatgttttgtgaatgttttatgtgtagtgggaagaaggcgtattctttagtatcaaggcataagcctggaatctattcagctatcttgttataatatctaacttagtgattattttctttaggccttttacagtttttcatattttatatctactgttttgtactaagagtggtgtgctggtttctactaggtgtggtgtgctaaagtctttctatttgtctccttactccttatgtcttctgtgattttgctttgtaaacatagttgctttgttatttgtcactgaaatattcataactgttatatattcatgatgacttttagctttggtactaaaaaggtctttgtcatatttaatgcttttttggtttaagttttattttaatttaattgataccaggtttgtaatctctgcattcttattgtttccatttgcctggtaaaccttctctatctcttatttttagtttttctgagtcacttggttctaaatgtggctctactttagcgcatgtagttggttgtgctttatgagacaaaatagataagttaagcctattcatcttcattgttattattgataggttattttttctcatttatgttatatatacacattatttataatgtgtatcatattatatttgttgtgcttatttctctgtgatgtgtttctctgctctttaattaaaaaataatatttacattcatggagatttgtaattttgttccattactcacctttgtttttatttatgttttgaattttatttttaattttaattgacaaataataattatatgtattatatgtttgtggggtaaaatgtggcatttacattttgatatatgttttcattttggaaggatgaaactaagctaattatttttgtgttaataacatttaaaatctactcttagtaattttgaaatatatattctgtccagtagattactaaagcttattcctcctaaccgaaattttgtactctttgatcaacctttcttctttccccttccatcgctcctaaccctggcttgtggtaatcatcattctactttcttcttctatgaatttgatattttttagatcccacatataattgagatcatgtagtagttgtctttttgtgcctggtttatttcatttagcattaattcatcttgtctttttaaaagctgaggccgggtgcggtggctcacacctataataccagcactttgggaggccgcggatggcggatcatgaggtcagaagttcgagaccagcctgcccaacatagtgaaaccccatctctactaaatatacaaaaattagccaggcgggcattagtggtggtgggtgcttgtaatcccagctactcgggaggctgaggcaggagaattgcttggacctgggaggtggaggttgcagtgagccaagattgcgccattgcacttcagcccgagactccgtctcaaaaaaaaaaaaagctgaatagtattcaaatgtgtatgtgtatatatatatatatatatatatatatatatatatatatatatatatatatttcatccaatgatggacacctaggttgcatctatattgtagctattgtgaataatgctgcagtgaacacaggagtacgactatctctttggcatacttatttcatttcctttggctatatacccagaacaggagttactggacgatatggtaattgtaattttacttttcagatgacactccaaactcttttcataatgactattattttaaattttcaccaacagtacacatggttcctttttctgctcatccctgccagcatttgttaaatttcatcattttgataatagccacttaaacacgtgtgaggtgataactcattgtcattttaatttacattttcctaatgattagtgatagtgaacagtttttcatatacctattggccatttgtatgtctgcttttaaaaaaaatttatttaggtcctttgtccattttaaaattgtgttctttcttttcttgctattgagttgcttgaatttcttatgtattttgaatattagcctcttaccagatgtatgggttgtgaatattttctcccggtatgtggattgtctctttactctattgattatttcctttattgtgcttaagatttttagtttgatgcagtctcatttgtttatttttgcttttgttttgcatgtgcttttgggaaaaccaagaaatttttgcccagatcaatgtcatgtagcatttcccttgttttcttctacagttttgggacttacctttaagtctttagtgcattttgagttgagttttgtgtattgaataaggttctaatctcattattttgcatgtgaatatctagttttccctgcataatttattcaagagactatcttttctccattgtgtgttcttgacacttttgtcaaaaatcagtagattgtcagtgcttgagtttattgctgggctctatattctgttcctttggttgatgtttctttttctttatgttggcactatgctgttttgtttaatataggtttgtagtatattttgagatcaaatagtttgatgccttcagttttattcttgctcattaatttccatatgaattttaaaattgctttttctctttcagtgaaaaatgccattggcattttgtcagaaattgcattgacttagtatattacttttggtagcatgggcattttaacaatactaattatcccaatccatgaacatgggctacctttccatttatataagtcactcgctatttctttccttaatgttttgtggttttcagtatttagagcttttaagtccttggttaaatttacttccaagtattttttatgctatcatgaatgggattgatgtcttaatttctttttcagttagttcattgttagtgtgaagggatgttattgatttttgtatgttgattttgtattcttcaactttactgaacttctgtatcagttctaacatatttttgggggaatctttagggttttctgtagacaagatcatgtcatcagcaaacagaaacaatttaactttttaattaactttttaatttcctatttggatgccctttatttcttcttcctttctgtctgtttgctgtggctagaacttttagtactacattgaacagaagtggtaaaggtggacatccttgtcttctttttgattatagaaaaaagctaaactttttacctttcagtatgatgttagctgtgggtatatcataggttgatgcagaagtaattgtggaatatatgacctttattgtgttgaggcctggagcctgacaatgcagggactagtctggtagtgggatgggtctggattctgatactgcagtggccagcatggagcttgggactgtggggtcatgcttgaccttgggttcagtgaggcagatctggtgttgcagtccaatgaaaagttgagtgcttatttcattcttccttgacttaggggtatcttgctcagtgttgtgctgcttgggcttgtgggaggggtaatatggataatattaaactggcttttctacactattcaatgcatttttttttttctttcggactgcagtaaggtggtataatctcttgtctggattccttagctgttgggaaggtattatgatgcatggatagtttttcaaatgaatgtttctatgagagatgaacactagaaagtcttattccactatcttcctaacatcactcctctagagttttttttttaatccagatatatgggggttttagtagagttttatttgtttattattcatttttgacttaattgtattgtcatcaggactcattgtatgatactatttttaggaatttgttgcagttatcttcatttgctaatggcaagttaaatattataaatgatttatatatgctggtttttaaaaacaggaattgataaacataaaatttagggtagtggttacttctggtgggaagaggcagtaagaaaggttaagggagcaacacacagatcgatacaagtagtagcattagaaatctagtccttaaattagatagtttaattatcccattatataaattactaacagttttacaagcagaaaatgtacatgctatttaaaatcaccaccataatcttttgtcttcacaaaataataagcagtactttttttcagattttttcttatatagatgtaatttatatcattcccaagcaagacatagagtataatcaaaatacagtagttttctctgtcactgaccctttaaaatatattcagtgcaatacatttttcccttgatcttgtatgaaatctcagactcactcttagttaatataaggaactcctgagaatttaatttgcaaacacgtgtgtaagtaaataattaaacttgtctagatcagataaaagtaagaactctgaacatattttgaagccaaattttctcttctcctctattccatatgttctttcattcttagcctagtattttcctcctttcctggctcaataatttttttgatctttctaggggagaggagaaaattatagtcttatgtgtgaagaatagttgtcatatttagttaaggtcctctgtgtgagagatgcacaatggctgatccattctcacataaatgtctttgggggctcttctgagtcttgacctttctagatgcaattctcgtgatctgtgggagacacatactttcttcctgttctggcaacttttacttcagttttcagttgaagtcctccagcacttccaggcaatcctgttggtcagaatattaagtagatgctggctagctggaagaaacatactttctttttcttgacttcagtgttagtacaaatatttcctaaaagtaactgtttctatttgtccttccacctcagttaaatagccatagctggtcacacctaattcagaatttcctctaatatgccacctagattttaaggggacccacagcagactcttcaaaaacttctgtgaagtcccactcattaggcttgtgtaagaggacagacaaccactcccttggcaggcagaagactggattactaacactgaaatgggcttttctgataatccccatccaatctttccccctttcactctttttgccccttttattgactctatctggttcaaagattactggttttgaacttttgttttagtctcttcttttgaaaatgttcatattggtcttatatttcacttaggtatacagtatctattttctttcagagactcaattgaactagcaatatgattatctggttacatttgtttgcatttattaattcattaacatatatgttagagttactattgatactggaagaaaaataatgaaaaagttgaacattgggaaattttgactcattcacttaattttatatggctctacaattcaggaaaagaccatatcatttcatttttgtcaatagaatggtttagctaactggtagtgtacaagaacagcagtagttctcattaggtgtttttgaaagagttagtgacaccatcagccttgtctgtttagaatgtgttattggattggagaattaattgtaacctggaaatactgaaggcaaagatatctgctatgtgattatattgttgtcagtaagagaaagtggatgacaatactttgtggtggctgttagaatgaaaaggaggggtcagatacaagaaagattatacatgtagaaattaaaatctaccaattgactggatgttggacataattaagtgtgaggtttatgtcctaaataattgaacagtgctctttaagaaaggattgcaaagtaagaaaaggagacaagtttatatgaaccaaattaatcatgcaacttttacaaaatggaaagtttcgtctagtactctaaaaggatgatctaaaaagatctaaaaggatactctaaaaggatgaggatgatctcagaaacttaaaagggtgaatttagaggaaataaatagatgttcttttttaaaacacaatctgcagctatgtttttattattcttaccagtagtaataacagtggaagtaatatctgccaattattaagtgctcaatatgtgttatgtgtcttaaattacattacctcatttaattttcacatcaatcctggaagctaagtgctgttattcttcttttgcaaatgaagaaattaagcataaacaggttaagtaaattgtccaaggtcatatagtgattttagatgtaaattttgaacccaagctgtttgagtacaaagctctggcactaacgctttgaaactcactttattaaagaaatataccaaagtgaaaatggagagaagcccaaagaagaattagataacagttatatccacagtagacttcaggatatcccccaaagactttaaggaatttcacaaaattttcagaaaagtgaatttacttccctttaattaaaaataatttatactatctggtaaccttagtttttggatggcaagaggaagttacaggacataaaaataaggtaataataatacttgaaatgtgaaatgtgcatgtttgtgatgtagaatattcaatatcattttggttttgacttacagcttgtacatgcagtggccatgcaaatatctgtcatctgcacacaggaaaatgtttctgcacaactaaaggaataaaaggtgaccaatgccaattgtaagtaagaatgactttttagaactttcgtggattgaatttgtgttgttgaagtaatttttatgttttactttttaatttagtgttgtgctagttaggcatacctttattacaatttttaacttttattttagatttgagggtacatgtgcaggtttttaacatgggtgtattgcatgatgctgaggtttgggatatgattgatcccattatccagatactgtgcatagtacccaatagataattttaaagtactttttccccttcctgcctctctctctctagcagttcccagtgtctgttgttcccatctttgtgtccctgtgtaccaatatttagctcccatttataagcaaaaacatgtggcatttggatttctgttcctatgttaatttgcttaggataatgtatccatgtggcagaggatatgatttcattttttatggctgtgtagtattccatggtgtatgtggaccacattttctttatccagtccagtgttgatgggcatttaggttgattccatgtccttgctattctgaatactgctgcagtgaacatataggtgcatgtgtctttttggtagaatgatttatttttctttgagaatttacttgcacctaatgaattctctttaaaaattaaaccttttaaagaacaattttgtagaggctttaaaacaaccccatagaacatgttatcttttgcatttctagaaaaagatgcattcttaatcttatgtatcaaatctacattatctttacacttttctttcatattatacctaatataatgtctctatgccgttcttttttcagtcatttattattaattctgataattaattccaattcttgtcctttaaccctttcagctggttccttatattcatcttcttctcttttctctgttctttcagtatgcaggaaccctctactgctactctcctctctgtactttcatgaatgatttttgtcttagcatttagtttttattctaaaattttattttccttcaaaaattaactttaaaaggcagcattttaggctatttaaattgttttttattctttttcttgtttatctatattattaaaatcaaatttttatggttttgaattatatatgtacaaatacatgtttatattaggtatatatgtactgtatttgacacaaataataaattccaaccataataattacagaaacatagggaaagtttaataaagaattcttcaaaactataaatatataaaaatttatacctaaagtctattaagcatggaaaatgatccttttatttttatttaaaataaatatattacttgttgcagagttatcctaaatgtttcaagttaggtgattatgtctttgcttagccacctaagtattacagattttcaaattcagacaaggtaagcacaatcagtttttattccttctctatagtctgaagttaaatacaagttcacagcaaaagatcttgggggaattcctattaaggaaggccattttggtcttaaaaccaacggaattaaatcattgtcttctgttctaagatcaaggatgcctctaatactttgcaacactaaagcttgattataagtaaggccaacttcatgggcacgtggcctgtgaatttatacaggttcccacacttacaagggcagcacacttggtttagtgctctgctatcatcatcttgaaattcttaataacttttaaataagaactctacattcttcttttgcacaatgttctcctattccctgcaattatgtataatagcatgttctggttataagtaatgtttctcttgattaacttctattaaatatgttggttggatagcagtgtgcagcaatgaaaatattttctgtagaccatagtggcagtattacagataaaaataatatatgagattctaccatgatagtaaacactgtcaatcttcttagtatagttttacttaaatagtatagccatataactatccataataaatagttctttgatacagtattgcagtaacatatttttgtttacagacaaaagaaagcagaattttaattcattgaaatagtgagcttgtaagcttagctaaaatagagttataagatttggcatatgtgcaaaatattagaaaatcaatcatatagttcttaatgataaaagtacattttccccgttctcatttatggctttttatgaagaggataataatggaatactaatttgtaaagagtattttgtaggtggtatttgtacacagaattccattcatttacttttttgtttatttagcttttgagtatggagcaataaagaataggctcattatttttagagcaattaattgctataatctgcttatacctgaaaaaaatggtttgttaggaaggagagctactccttcaaatcagtaaacaattattaagtgagtacttgatactactaatgaagatgaataacatatggtttttgttgaaagtatctcagactagcagtgaagacactgaccaaaatacagtataccaatttcttacattagtgatttaatatgcttatgaaccccttccacttcttaggataatttctgtttggttttaagtatttagtcagatatcatatcttatatattcttaataaccatcctaaactgaaatcggttctcttcatatctgttaatttcttttcttgcattatttgtgtacttgtctgtgtcctttactagagtgaacttttggggggaccattgcaacaataccacaatgtaagtgttcaataaatttgtttaatagaatggaatgaagaaagtattgatggagcactgaaaagggaagtattaatttattttggttggataagaaaaatttaagtagaggatgtttgaactagaacctgaaggagtaataaaatcaactttctgggaaaagaaaataggaaacaaggggaaatgcatcaataaaagcaaagaagtagaaatgaacatgatcatagcatttccggtctttgctcaagaatgttgagagctggaaaaatattgcttctacccttacaatgaaaggggaaaaagctggataaactgtaaattcatgagttttcttgaaaccattggagaactgagaaaacagggtaatcaaatgaccacaaatctaaagagagacaagagactgcagagagatgagacatgaacattggcttacctggagcaaaatcatctggaaactgataagaagagatcagctagggtagttgatatttggcggggattaggtatacactgtcaatagtgtgaagctcctgggagccacagaaattggtagagtatggagagcatactctttgtagagttttcaagccacctactgtggctgccattcccttccaccagttgctcaggtaaaaaaaatgaacattttaagagagcattccttgtattgtaccttgtggaagggattggcagccgcagtgggcagggcatcagtagtacagtcaaaatattcatttagatgagcaccaaatgattcattttgctgtagtaatgacagttttcagtctttttttggcccaaaacacagctgatcgtcaaaaattgtaacttaaaaatgaatttccatttgtgtcatctctgatttttttgtgcagtggtttttagttttccttgtagagatctttctcttgcctgggtgttttcctaggcacacataattgtgtggcagttatgaatggaagttctttcctgatttggctctcagcttgactgttattagtgtataggaatgctattgatttttgcacattgtatcctgatactttgctgaagttgtttatcagctgaagaagcttttgggccgagactatggggttttctagatgtaggatcatgttgtctgcaagcagggatagtttgacttcccttctttttatttagatgcctttgtttatttcttttgcctgactgccctggtgagaacttcagatactatgttgaatggaagtggtgagagagggcgtccttgtcttgtgctggttttcaaggggaatgcttccagcttttgtgcattcagtatgatgttggctgtgggtttgttatagatggctcttaatattttgaagtatgttccttcagtacctaatttgctgagagtttttaacatgagtggatgttgaattttatagaaacccctttctgcatctattgagataatcatgtgctttttgtgtttagttctgtttatattatgaatcacatttgctgatttgcttatgttgaaccaaccttgcatcccagggataaagcctacttgatcatggtggataagctttttgatatgctgctgaattgtttgccagtgttttgttgaggatttttgcatcaatgttcatccaggatatccacctgtaattttctttttttgttgtgtctctgccaggttttagtatcaagatgaggctggcctcatagattgagttagggaggagtcccttttcctcaattttttattgaggagagtatatctggtagaattcatctgtgaactcatcatgtcctgggtttctttggttggtaggctattactgcctcaatttcagagctgattattggtctgttcaggaattctgtttcatcctggttcagtcttgggagggtttatgcgtccagaaatttatcctttttttattttctagtttatgtgcatggaggttttcataatgttctctcatggttgttcatatttctgtggggtcagtggtaatacccttcttgttgtttctgattgcgtttatttgaatcttctctttttcctttgttagtctagctagtggtctagcaattttattattttcttcaaaaaccagctcctggatgcattgatctttttatcttttgtgtgtgtgtgtgtctttatctccttcatttcatctatgattttgtttatttcttgtcttctgctagctctgggatttgtttgctcttggttctgtagttcttttagttatggtgttaggttgttaacttgagagctttctaactttttgatgtggacatttagtgctataaatttctctcttaagacttcctggaagacaacctaggcaatgccgtttaggacataggcatggacaaatatttcatgatgaaggcaccgaaagcaattgtaacaaaagcaaaaattggcaaatgggatctaattaaagagcttctgcacagcaaaataaagcattaacagagtaaacagcctacagaattggagaagatttttgcaaactatacatctgacaaaagtctaatttctatcatctataaggaatttaaacaaatttacaagaaaaaaccaaccccataaaaagtgggcaaaggacacgaacagacacttttcaaaagaagacatatatgtggccaaaactcatatgaaaaaagttctacatcactgatcattagagagaattaaaactggacctcttccttacactgttaatgcaaaaattaactcaagttggattaaagacttaaatgtaaaactatataatttgattgtgctgtggtccaagagactgtaatgatttcagttcttttgcatttcttgaaaagtgttttaattctaattatgtgattgattttagagtatatgccatgcagtgatgagatgaatgtatattgtgttctttttgagtggagagttctgcctgtatctatgagatccatttgatccagtgctgaattcaggtcctgaatatctttgttaattttctgtctcagtgatctgtctaatattgtcagtggtgtgttaatgtctcccactatgattgtataggagcttaagtctctttgaagatctctgagaacttgctttatgaatctggattctcctgtataggtgcatatatatttaagatagttagattttcttactgaattgaaccctttaccattatgtaatgctgttctttgcctttttgatttttgtgaatttaaagtctgttttgtcagaaactaggattacaactcctgcttttttctctttttcatttggtaggtagatttttctccattccttagttttgaggctatgtgtgtcattgcatgtgaaatgggtttcttgaagacagcataccaacgggtcttggatctttattcggtttgcctttctatgtcttttaattgggggcatttaacccatttacatttaaggttaccataaaatatttaatttccaacagaatttaacaaagacattgttatgtcttatatgcagtaagtgtactaactaaatgtattttggttggaaaaagataaacattgatttattaggttaatggttcttggtggagatggaatagcaccccctagaacttcataggttttcataattaattattctaataattggggagtgctactggcataagaggatgaatagtcacagcctcttattagaatgggcacttacagagaccaggaaataaataaaatctaagtccaaatatgtttcattgagtacagtagatctacaaactcactctgtagtcattttccctgttccttagttcataattaaaatggatgtatgtagcagccagcagatgtctcatattggcttcctgacctgtggagaaagagccagtaaggtagagaagggccaagagaaagaaacccttgaaactaattccattcattctggacccagtcaagatggcaaatcagagatctcatgtcaagacaaatagcaggctgctgaaatggagaaaatgagggattatgatattctcaaatatgagctggatcctatttataagtgtagtgccaaaataattccctagcttaaaatgtggacagaattgtgataaaatctaacagaaaatatattttctttcttgaaatcctaccacatgtcaatgtatacattctgtttctggtatgtaaaaagactgtagagactatatcatgtcttaggaaacgggacatatttgaaaaggaaatagtaatataagagccagtcaagtcatgttgtagacctctggaacattatcagagtcccctgtttaaaaacaattgcaatctcccccacagtaattttaccatgtagtttctaccgcatacattttatattatagcactatgaaattttaacaaatgcataggacaggaataatatgataattttagttcctatattatgaaattcagtagtactcataatttggcaccaatttaatatgtttttgtttttatctcttaagaggtatctcaaatattctccagacacattgtatactcacagatgtgtgtgagcaggatagctattggtgatgagattttcttaaatgaatatctcttggtcaaattctgaataatattataaaaggtatattttcaatttacatgatagttgcagttgtagaaaattcaatatgtgttataaatatgcaaaactactttgtgtttatatgtaaaatggagttagattccaggctgaaatatttatgagcacatttttcacctacttaaacatctgccatgttattctaaaattatatgagattttgatcccttttttattttgtggaattactttgtatttttgtaggatgtctgcacccctggtttctctttcattccattcagtaaattccagtggaactccataattatggaaataatgaattgttactcacaaatttatccccactcacaaccatgtgccttaaaaattagtgttttcccttatctagccaaaaaaagtttattgtttcactgtttaatataagagctcagatcattttattgatttctggtgaaaagtacatataaatggcactcttagatattttgttggtagattagtcaaaattgatgagttgattcaaaattgttttactctctgttcacagtaaattgaagataaacttctcaaaggcatttggaattaaaaataccatttcctaagatatatggcaatattactaatcaggatcttaattgtgctaattaacttataactggctccccttttctgttccttatacctttcccatttactgatcttacaacttcttcatagctacttacttcaggcttaagaccctggttctcagaattagggcacagaagaatctcctgggatatggtgactaaactcctgggatgggagccaaaattctactttactaatagtaaattgtgaaataaaaattcttgatacattttgagaaatgttgccgtaggaggatcttcctgaacattttttttcctccttggcttacctttaggccagtaatatctaagattattacccatttttctctatcttgttttatcaagtctcttttgtttgtttgttttgtgaaattgccttaatgatgatgccaatgaattcctttccgttttaggaagatcaaagttgtgccttcttttctagaacagattctggcacatactagggactttagatttttaaaaataatgtatcttggatctttatttttcctaattactctcatctttttttttttttttttttagtctgctatatggggaaaagtacatcttttctctatgtgacttaatctacattgttataatagagactacagaggaagaataattttctgtacagcctgcctgcacataggttatcacctttataaacacaattggataagtaactagtgactatggtcttcaaatactgacactaactttttttttgtttgttttgagacaaagtctagctctgtcccccagactggagtgcaatggcacaatcttggctcactgcaacctccactctctgggttcaagcgattctcatgcctcagcctcctgagtagctggactacaggcactcgccaccgcacccggctaatttttgtatttttatgagagatggggtttcatgttggccaagctggtctcaaactcctgacctcaagtgatccgtccaccttggcctaccaaagtcctgggattacaggcatgagccagtgcacccagcctccaacactaaatattgttaagatttttctaggttgttttgttgctgtatttgcaactgcagataagactaatggtttctttgtgataatgagttaagcagccttgatgtctaatatataagatacttgaggaactcttatgcttgctttattctgtaaacatttattcactgagaggctatgagacagtaccaaaagcatacatctgaaaatatcagttcagaacgcatgttactcatgttaaggttggccagtatgaaaccatatatggttttgtccgatttctacccttgaggaatatgttttggtaacaagtctaacttgagcatataacttcctatgtcaggtaaatgtttgagttcttttggagtatgacttaatgaatttaaagctcttggattttaggaatgtactttcaaagttaaatgttagttctcccatcagtctttctataccaacaccttgtccctcaaaactatactagattgaatgtcatttaatcgccaattttgaaaacattctgaacacaactcagctgtatttcgcagcctccattgcagttaggttggaagtcatgttattgggctctgtccggtagacagaagtaacacccaccacttctaggcctggctcttaaaaacctcatgtgccatacaccctctgtttcctcattcagcagttcaatggagaggaagatgaggatctgaaagattgcagaggctaggaatagcccagatcctggaagactgcatggaccaagaccttttctccaaatccattccacactggacagtgtcttcaagctggaatcaaacttattgtatagaactgctgagattttaaggttgcttgctagagttagcatattcttccatgagtaattagtattcccttagcatctagcttgacatccttaattactgtactttcatttaaataaccttaagggtcctgttcattaagtgtgactgctggagtaggttagtgaacagtgtggtggtatttaggtttaatttgttctttaatccccattcatctcttaaaacttgcaaaaacctcccagctttttttttttttttttaaatcaaagctgttctcatttaaagctattgtttgggagactagtatagtccatgatttccaacttgattattacattcacataaggcataaaagttaaatggctttatttaactctagatggtcagaatggttcccaatacatgatagaattgttggaattgctaataaaaaagaaaagtgcacagtaaagaacagagtatcaagttaagatttaggatatactacctacaagttggaagaaattagaaaaagaaacaaatgtgtatgtcaaagaaagagacagcactttaagcatttattttactttgatcagtcttctatatatttattattaagttatcttgaaatatcaggggatgaaataaatagcctagtatgtcccaacttaacattgtatgaagaaataaagttttaacatttaaatgtagaaaatatatctggtatatgtgtaggtgttttatcaaaatatggactctcatgtcaaatgcatgtgtgttataggatgaactactgctatacactagtatgtccttttgatttatttctggagctccagtgtagtggctatgttgtatagtttagcacttctggttttatggaaaaatggtaagtgactgaacatatttcagtgtaatctctttttataacaattttcttttttgtcttgttttggcaatttgccggtgcaaatatgatatcctttctttattgttaataatgtttgtcctctcacctcaacataatgttttgagatttatccaagttgctgcattcagatagctgtaatgtgatcctattcaatgttgtagagtatttcattatataattataacacacttcattcatttgcctgttttctttttttttttaattatactttaagttttagggtatacgtgcacaacgtgcaggttagttacatatgtatacatgtgccatattggtgtgctgcacccagtaactcgtcatttaacattaggtatatctccaaatgctatccctcccccctccccccaccccacaacaggccccagtttgtgatgtcccccttcctgtgtccatgtattctcattgttcagttcccacctatgagtgagaacatgcggtgtttgtttttttgtccttgcaatagtttgctgagaatgatggtttctagcttcatccatgtccctacaaaggacataaactcatcattttttacggctgcatagtattccatggtgtatatgtgccacattttcttaatccagtctatcattgttggacatttgggttagttccaagtctttgctattgtgagtagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgttttctttttttgataattccagttttgtttttcctttttcaccattactgttaatgttttatcagtattcttatatgtttcctggcttacaaatgcatacattttgttgagtgtgtattcattattcatattttcaactttggaaaattaactgttttgtaaagtgattatattaaattatacccattccaagtctttatgaattttattaatgctccacatctttgctgatagttggtattccaaggcattttaattttgacacttctgatagatgtgtaattgctatgttcttaagcttaaaaaattccttagttcttaaaagtttattatgtttaatctttaaaagtttcatctctttaatcaccggtggaattttctctttttatgatgtagtattatctcaagtttcttgtgatttttctgctggattctccttaatcatttttagtaatattttatacatgctatgtacacgtcttttgttggtgatatgtttagtaaatgtcactctgtggttggactttcatgccaatttgtatgtctataatgagacattcttaattttaatataatccagtatatccatcttttccctatggttagtgcttttttgggttctgtttaaaaattctttctgttctccattatcaagtagtattcagatagccagttggtcatggaatttatttttggcctgaaggttttaactttcatccaatttctttaaaagagataaactattcagatttttgtttcttctagtgtctgttttgttcttttcctttaaaatattttcatttatttatttaaattggattttatttttaaattgacacgataatggtacatatttatggtgttcataatgatgtttcagtacatgcagtgcataatgatcagatagggcaatcagcatttataatctgtttgtgttaggaacattaacacaaattatctttccagcgatttgagctatataatgtattattgttaactatagtcctcttaaagtagtatagaacattagaacttattcctcctatctagttgtaatgtaatatgctttaacaaatctctccttatttctctttccctacacccttcccagccactagtaccttctgttctactttttacttctatgagatcaactttttttttttagcttccacatgtctaaagacatgcagtgtttaactttctattcctggcttatttcacttcatgtaatgtcttccagttccatccatgttgccacgaacgacaggatttccttctttttaatggctgaataatattccattgtgtatatatcctacatttcctttattcatctattgatgtacacttaggttgattacatatctttgctattgcaaatagcattgcaataaatatgacgatgcaagtatgcctttgacatactaatttattttcctttgtataaatacccagtagtgggaagtctgcatcatatgtatggtagttctatttttagtattttgagaaatttccatactgttttccatactggctgtactagtttacattcttatcaacaatgtataagagttcctttttaccacatccccaccggcatcttatatttttgtcttaaaaagacacagccattttaacacagccattttaactggggtcagatgatatctctttgtggttttgatttgcatttctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagccgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgatttgcatttcttgatgattagtgatgttggccattttttcataggtttgctggtgattttgtatgtcttgttttgagaaatgtctgttcagattatttgcccattttacaattagatcgtttgttttcttgctgttgcaatgtttgagttccttatgtattctggctcttaatatcctgtcagatgaatagtttgcaacccattctgtggattgtctttttactctgttgattgtttcctttgctgtgcagaagttttttatcttgatatagttatatttgttaatttttgcctttgttgcctgtgcttttgaagtcttattcataaaatcttttcccagatccatgtcctgaagcattcccctggcgtttttttctagtagttttattgtttctggccttacatttaggtatttgatccatttttccgttgttttttgtatagggcaagaggtgaggggtctagtttaattctaatgcatatggatatccagttttcccagaaccgtttattgaagaggttattttttctccaagtcatctttgttcttggcatctttgtcaaaaatcagttggctgtagatatgtaatttctgtgttctccattatgtttcattgatctatgtgtctgtttttatgccagtacctgtcattttggttagtactactttgtggtatattttgaagtctggtagtgtgatacctccagctttgttcttttttgctcaggattgctctgactactaaaggtcttctgaggttctatacaaattttattttattacttttttctatttctgtgaacaatgtcattggtagtttgaaaggaattgcattcaatctgtatagctttgtgtaatatggccattttaacaatattaattgtgattcgtgggcatgagatgtctttttatttgtttgcattctcctcaattttatcagtttattttgtagttttccttgtagagttctttcacctccttggttatatttatttctaggtacttttttgttagttattctagatgagatttgcctcttgatttctttttcagctactttgttgtttgtatattgaaatgctactgattttttaatgttgattttgtaacctacaagtttagtgaattcattcagcagttctattaaataatagtgttttgggagattctttaggattttctgtacacaagatcatgtgatctgcaaacaggacaatttcacttcctcttttccaatttggatgccttttatgtctttttcttgcccaattgctctggctgggactttcaacactatgttggataagcatggtgagagtggtaatttttgtcttgttttagttcttactgaaaaacaaacaaacaaaaaaacaaaaaccaagagcatgatagtaaaacaggagtagattaaccctgataccaaaaccagacaaggatacaacaacaaaaagaaaactataggctaatatccctgatgaacatgtatgcaaaaatcctgaacaaaacaaaagtgttcagcttttccctattcaaattagtgtttggtgtggtttgtcatgtatggcctgtattgtgttgaggtactttccttctatacctaatttatggggagttttttttatcatggagagatgttgaattttgtcaaatgctctttctgcatcttttgagattatcatatggcttttttccttcattttgttgatgtgatgtgtcacatttattgatttgcattgtgttgaaccatccttacattccagggataaaccccacttgatcttagtgtattatctttttatatattgttggatttgatttgcagtattctgttcaggagttttgaaaatgtccatcagtgatattagcctatagttttctttttgttgttgtgtccttatctggttttggtatcagggttaacctagtcctgttttactatgatgctcttgtttactgctattttttcatttatcagtttggagatttcagaaagtttagccatttctctttaaaaattgctacttttttttttttttaacagagtcttgctctgtcactagactggagtgcagtggcacaatcttggctcactggaaactctgcctctcgggttcaagtgattctcctgcctcagcctcccgagtagctgggactacaggtgtgcaccacacacccagctaatttttgtatttttagtagagatgcagtttcaccatgttggccaggatggtctcgatctcttgacctcatgatctgcccgccttggccttccaaagtgctgggattacaggcatgagccaccgcacctggcctctctctctctgttttaaaaatattatatgatagcattttggtgggtttctttagggaaaaaaagagaaaaataagtgtgttttaccttttatatctttatatcttcatttaaaaagaaatattttattttcagagacagagtctcactcaacttgtcatccaggctggggttcagtgatgcgatcttggctcactgcaacctctgcctcgtgggttcaagtgattcttctgtctcagcctcctgagtagctgggattacaggtgtgcgccaccatgccctgctaatttttgtatgtttagtagagacagggttttaccatgttggccaggctggtctcaaactcctgacctcgtgatccacccacctcggcatcccaaagtactgggactacaggcatgagtcatcatgcttggcctaccccttcatatttaatcataaaaatgcaaaattatttagcagattttcagctgttttaaataatctgtaatattttaaaattatggctgttacatgccccttattttagtctctgagtaaaaaaattatgtatcttgacaaggtatatgtatatatttaaacatttgaatatatatttaatatatttaatatctaagtgttcgtattataaattcaaatatttaaataaattaaatatttaaatttaaaattttaatttaaacatttaaattaaaaatactttaaaacttataaatgtagaattattttatattttgttttatacaaaatgtgtataacaatgttagcgtttacataaatgataatcattatttaggtgacatttaatgagattatttacttcttcaaagtctgtaatacatagttcagcctaaatctgttttccatgaaagtccagctgcttgattagtttgcttagtggaaaaggagtatgattatctctttgcttagacacagaaaccctttgaaattacatttttaattaagccattacagaagacttctaaaggcttttaatgtttttatcagtcttgaagggttctgagtttttaaaatattatttagctcaaatatcagaaatattaacatgatttatgttgtaaagtatcaatttgtttaaggaattattatttatatttaaatgttttacattttatttacctgttgtaatctgaagttgaacttgctaaaataatttatgtctcaatttgcttttttattatgtgaattagattagtggttcatgttcatacctcaagtaaatatattgaaatattttatattataaaattctatctataacaaaaattttatgttgggcagctcctatattgaccattaattatctatgacttctggtattcataccattgtgtagttccatttccttccttgagtgtgggcaggacctgtgcttgcttctaaaccagaaaataatgcaaagttaatgggatattactcctattattttgttacattacatggtaaaagtgatggttttcacttctgtgaatatgctgtgaagtctatgcttcctagaaaacttgctctagtgattttttcttttgctggctctgagaaaaatgtagctgagagtatcctctagcagctgaggatagccaccagccaatagcaagtgaaaaaccaaggccctcggtcctatagtggtaaggaaataaattttgccaaaaacctgagggaaaatagaagcaggcatatgcctagttagtcctctgattaaaaccagtcccagctgacacctgattgcaggattacagtggaccctaggtgcagccaacgtcttgattgcagtctgctgtgactctgaatcagagaacctggttatgccatgctcagactcctgatccacggaaacagtgatataataaatgtgtgttgattatagttaccaaatttatgtatttttattgagcaatagataactagtacaaatattatatccaagtactctgatattttatttactgaattatacaactctacattagatatttttgtaatatattccttaagtgttttcagactaggaaggagatttctagtctttggtagatattttcttgaatggggaaaataatttcaacaatgcagattaagacttttcctagaacagagcatttctgaagaaattttacctttgtgtaaataaacacagtagactgttacagaataaatgagttaaactattttaattgatctgagtaatttacattttatatctgcaaaattgccttaataaggtatttgtaattttgttatattgttttcttcttatgttgaaaatagttagatcctccattctgatttcttaatttgcatttctttgggggatctacaatgaaattgatggattatgataatcttgattccagatcatattattattaggttacatcataatccataacggatatgccaaacattttaatatcacctatttataacaggttagcacagttttatcaatttatttttggcatgtgaggaatgaggtggggagtcattggtttgcatagcattgcattgtgtataagtaatattttatacatttgtttgggatttcatctgttttatcctttgtaatgagatattttcccatgagtggtgactctgctattagaatcaatttgctagcctgtgaggatcttggattttgagtggaagtataacaagtaagcctgcattcttttttctcttttgtcttttttaagtgaattaaacgtggaacaaatttatctgataggacgtgacattaatgaaaataaaaatttgtttattcttgcctaatcttaatttttatgatgatgtttaccaactcctatggtagactccttcacatttaccagacagacctcaacatttttctataaacaagacccttcctttcttgtcccatttatttatctatttattattggaatggactcatgaattcctgtttttttcccaatgatttataattcactaatgtttttaaccactttggtgctcacattgtccaagatttggccagtaggagaggcttcaagctagctcttttgtttatgtgacacacctatcattttgtgaatacttccttactttctggtataagaagatatttcaggctcatcttattcctcttctgcctcagttgtggaatcagctgtatatccttttggagctctagttccttgtaatggaatatcatattagagaccaagatcttggtgctaggtatgctttttgctctttgaggtatctttacttagtgggttgtttggtgaacaaagttaggaaataataatttatttatgtgcacatataaatatacatatgtgcacatacatgcatacatatgcatgtatatacacacatataaatattttagaaagcatttcttcataccaaaacttccaattcggatctatttctgcaaggcttttgtaccttctccggctcagtatttgttccttcttctacagtaaatgaacactgacttccaatgacatcaacatatttacttgtttgctcaattctatattgtaatctaaaatagtttcagatttactttgcttatatcacttcagtaagaaaacctacataaaagattctggaatctgatttcaagcttccctcctccaccttgccctgcaccaattcggagtatgtagtcaaattttgggttcctaagttactttgaaccttccttccctccctcttctcttactccctcccttcctttcttctttcattccttttttccctcttctcttcttccccttacctctcctcctatttccctccttttttactttctttttccatcaatatagagataggattcacttgaagtttattaggctcttatttctacttacttctaattttatgaattttttcctttcccattcttattgtattaaaataattaattaaatatgttgaacattaataacctgaaactacttccagtatactcagagagattattgttcatttctttctccctcttccagtaggtaaccaattttattgttttctggtttatccttcccatctttcctttcataaaagtaaagctgtatgagctgtgtgtgtttctgtctatgtgcgtatcttatatttatatatatagttattatttcaccttcttacacaaaagctgacatattattagatgtattttagatactcttttgagttttacattttttttcttctttataatacttcctggagctcagttaatatcagctcataaaaatgttcatttttttgttctgttttgtttagagatgtatagtattccattatgcatatgtaccataggttaacaaatctattcggggacatttagacatttttctggtattttgcaattaaaattacgctacactgaataaactcgtatgtatgtagttttataatattggaggtttttcttaagagcaaattcctttcaatgggattgttgggtcgaagaatacatgcatatgtagttttttagatattgtcaagttgtcctccatatgaattttctcattttctattcctactagcccacatgggatggcctattcatctacagactcataagcaggatatattgctatgcatctgaaattttgccagtcttgtggagaataatttgtgtagttttaatttatatttccattattataagtgaagttgaatatttttcatgtggttaagagccatttttatatcacttttgtgaattgtctcttcatgtattttgccagtttttctataaaattattagtttcccccttatttttaaagagttctttatgaattagggattatagctctttttcagtgagacataagttgcacatatttcctcccagtttgtcatatgtttcttgacagtactaattgcactttttttttttgctatgcagctttcttaaggtagtcatatttcttagtcttttaaaaattacatttggaattttattcatggttaggaagccttttattttgtaattaattatgtaattaacttgtcctttattatgtaaaggttttattatgtaattaacatcctttttttactatatcgaaaattttattttttacgtttagatttatgcttcatttagagttttattttgtttatggtatgaggattggatctgatttgatagttttacaatagctatcaagttgtcttaatttattatgaggactgtcttactccagtcatttaagacaacttttatcatttactagatttttagcatgtgatagttgagcctgtttctggaatttctattgtacacatttggtctatttatgtgctagtaccatactatttaattatagagactttgagtatattttatatcttttaggtctacctctcttcaaagctcatctttttcagtgtttttctaattattcttgtatgtttacttttgtccctaagcattgagatcaacttttctagctcctataaaatctcattggagttttcattgaatcacattaaagttaaagattatctttgaaattaattgctattctgatgatgttgaggtgtcctacaaaagaataaataatgtctttccacttatttacatctacttttgtctttttcaagctgagtttcatacccaaaatcatattgttatgtttttatagaaagtatttatttcattagctttttggaggtacctgtgtttccttaaatgacacatggaattaaactaccaaaaattggtgtttaaatttaactcataaaatttgaaaaccattttaatacattcaaaattatttcaaaaattattatttgttaatataaaccactttagataatatatgtttctaatttgcttttttgagctataaatatttaatagagaatgtagttcttgtattggacaccttccagaattctgcaaagtctttcagtttgattcttaacaaggtggtgttggtttgttttttctgttaattttctgtgcttgactattgaaaacttagaattgggatgccaaagttacttcctacacaagaacatatagtttcatccttccaagaaatttgtagtttagagaaaataaaatttcaaccattcctttgtaaaacttatactgtgttgaaggtaaatatattatagtaattttcagttcaatatatgattatgtaatttgaataaaccaaatattgttaacaaaaaagaaaatgttataactttcatattagagaaatgagtttgtatccttgagctttttaagtcaatatctcagtattatcactttgaaaacacttgagggagagtgataccagcaagatggcagaataggagataacctactaatatttcttcacaacaacaagaactctgcacttatctactgacaaaagtcactggcaggagcctcaggagtcaggtaggagggtgtgaaagcccactggagcccaaggcccaaagagggttgttttgagaatgcagactggcacccaggtaatagatgcattaattttgcttccaggttcaagcccagaaatggccctgatccccaagggatttgactacagccctgtttggccttgagcctgcaactaaaatcatcttctaaggggtctaggagcaatcatgtgtactagtgtaagagacttgtttgcccactgatatcagtctctgcagtgaacctagaagtagtcctgtggctcgactccagccctctacagttgagttcccagcacagaactgctcacacaaaaccccagagggagacttgcccatatcctgcagattgtgagtctgagcctccttgataggcttgccaaacttatctttcagtagtacccaggttgtcatctcacagcacatcctgagggatccagtctgacccccagctccccccactgtagtcaggtaactatcatatctgtgcagggacctgctaggagatgtgcaaccatctgaggaattgaggtgggctatccaacctttgtcccacagtagatcctgaggggacccagcctcagatttggcccctcctgctgcagttggtgacatatctctcacctgttcagagacctcctgggaggcatgattgtctggggcactgggatagtcttctgggctaggtttcctggccagctttcccacacagcccagttaccctccttggatcttccctaggtccatctgccctgcagagccctgccaaccttggagccctcctgagacttgtggcagatatgggcttagactgccctctagtgtttagggagttgcagtggtcatgggctcagagaacacaacagtcagtccccttagaaactctggaaggccctctgaagaaggatgagcaaaaacaaaactagactaggaagactggaataaacacctgatctctcagtgcacacacattgttgcatgtccataagcatcaagatcattcagggaaatctgatctcaccaaacagacaaaataaggtgccagagactggccctaaggtgatggagacatgtggtctttcagacaaagaattcaaaatagctgtttttagaaagttcaataaatttactgaagctcaaacttcagtaaaattcagagaagcaatcagaaatacatgaacaaaacttaagagattgaaatattaataataaaaacaaatggaaatcctggaggtgaatgaaatgaatgagtgaaatgaaatacaatgaatgaaataaaaatggaatagagagcatcatcagcacaatagatcaaacaaaagaaagaattagtgagttcaaaggtaggctatttgagaacatagtcagaggtgaaagaaccaaaagaatgaaaagggccaaagaaagcttaccagatctgtgggacaacatcaaaataacacatttgtgttattagaattcaagaaggagttgagagacaaaggggccaaaaacttattaaaaataataacagaaaacttttcaagcctggggaaagatgtgaatgcccaattatagcaaagtcaaaggtcaccagattcaatcccaataagaataccacaaggcatgtcacaattaaactcacaaagatcaatgactaagagagggtctagaaagaagtgagaaaaaagaagcaaataacatttaagagagatctaatataactggcagcatatttctcagcagaaacctttcagggcaggagggaatgtgacaatatattcagaatgtggaaggaaactacctgccaaccaagaatactataggcagaaaaggtgtattttaaaaatgaaggagagaaggacttctgcagacaaacaaaagctgagggaattaatggccaccagaccaattctgcaaaaaatgctgaagagagctcttcaaacttaaagaaaagaatacttacattgattgttaggctaatactgtaattttgttgtataaaccacatttatctttgtataaagaatgaacgacaaaactataaaaaactacaataatttgttaagagatagacaatatgaaaaatataagctgtgacatcaaaattcaaaatatggaaggataatgagttaaaatgtaccatttttgttgttttcttctttcctttgcgatcaaaattaagtttttattggtttaaaataacttattatgactataagatgtttttgtgagtctcatggtaatgaaaaagctaaaagctataatagataacactaaaaaagtaaggaataaaacacattactagagtgaatcacataaccacaaaggaagcctttaagagaggaaaaaaggaaaaaatatctagacaactaaaaaagaagttacacaatcgtgatagtcatcccttacctatcaataactaccttgaatgtaaatggttgaaattattcagttaaaagagaggctgaacggatagaaaaatatgaccaaactatgctgcctacaggagacttactttacgtataaaacaacatgcatagattgaaagtaaatggatgggaaaagctatttcatggaaatggaaccccaaaaagaacagaagtagctgtaattatatgaacaaaatagactttaagttaaaaactgtaaaaagagacaaggccattatataataatagcaggggtcaatgcagcaagcagatacaattataaacatatatgtgcccactagcagaggacctatgtatataaagcaaatattaatagatttaaagggagagatagactgtaacacaataatagtaggggacttcaacactccactttcagcaatgtgcagatcgtccagacagaaaatcaacaaagaaacttcagtgtcagacaacactcttgaccaaatggacctaacagacatttacagagcattcggtctaacagctgcagaaggcacagtcttctcaacagcacatgtaacattgtttaagatagattatatgtaagggcacaaaacatgtcttaacaatttttttttttttttttttttgagacagagtctcactgttgtcacccaggctggaatgcaatggtgctatctcggcttagtgcaacctccgcctcccaggttccagcaattctcctgccttggcttcctgagttgctgtgattacaggtgcctgccaccatgcctggctaatttttgtatttttagtagagacggggtttcaccatgttagccaggctggtctcgaactcctgaccttaggtgatccacctgcctcggcctcccaaagtgctgggattacaggcatgagccatggcggcctggcctcaaatttttaaaaatcaaagtcatatcaagtattttttttctgaccactgtggaataaaactaaaaccaataacaggaggaactttggaaactgtatacgtacatggaaattaaacaagtcaatgaagaaattaaaaaggaatttaaaacatttcttgagaaaaatcagaatggaaatacaacataccaaaacttatgggatatagcaaaaacagtttttagaggaaagtttatagcaataatcacctatttgaaaaagtagaaatatctcaaataaacagcctaatgttgtacctcaaagacctagaaaacaagaatgatctaagtccaaaattatgagaaggaaagaaataataaagaacagagaagaaataaaggaaatagagactaaaaatacaaagcatcaagaaaatgaagagttggtttttgaaataagaaacgaaattgacaaagctttagctagcctaagaaaaaaagaggaatgattcaaatgaataaaatcaaagatgaaaaaggagacatcgcaactgataccacagcaatacaaaggatcattagagactataatgagcaatgatagaccaataaatttgaaaactttgaagaaatgaataaatttcttatagcttatcttaccaagattggatcatgaagaaatagaaaacctgggcagaccaataatgagaaacaagattgaatcagtaaaacaaagactcctatcaaaaaaagttcaggacctgacagcttcattgctaaattctagcaaatatttaaaaatgaactcataccaattactatcaaactattccaaaaaattgaagtagagggcattcttccaaactcattctatgaggccagcattaccctgataacaaaaccagacaaagataaaagtataaaataaaactacaggccaatatccctgatggatatagatgcaaaaacccataatacagtactagcaaactgaatccaacaacatattataaggtcattgaccatgatttagtgaaattcatcccagtaatgcaagtacagttcaaaccacaaaaattaataaatgtgttacattgcattactaggatgaaggacaaaaaccataggatcatctcaatagatgctaaaaaaagaatttgataaaatttaacattcctccatgataaaaccgctgaaaaattaggtgtagagggaacacacctcaacatatgtgcacatatatgcatccacagctaacatcataccaaacagggaaaagttgaaagctttccctttgaatgctgaagcaaatgccatagtatgatggcattcctatcaaactatgacattctttacataattagaaaaaattattttaaaattcatatggaatcaaaaaagagctcgagtagccaaggtaatcataaacagaaagaataaagctggggataccatgttaattgacttcaaactatattacaaggctgtggtaaccaaaacaggatggtacttatacaaagacagacacatagaccaatggatcagaatagagagccaagaaataattctgcataggtacaactatctagtcttcaatgaagctgacaaaaacaagtagtgatgaaaggactccctattcaataaatggtgctgtaatacctggctagccatatgcagaagttgaaactggacccctttcttacaccatatacaaaagtcaactcaaaatggattaaagacttaaatgtacgacccaaaactataaaaaccctgaaggataacctagataccattctggatgtaggacctggcaaagatttcatgacgaatatgccaagagtaattgcaacaacaaagaaaattgacaaatggcgcctaattaaactgaagagcttctgcatggcaaacaaaactaccagcagagtaaacagacaccttacaaaataggagaaaatatttgcaaactatgcatcccacaaggatctaatatctagaatctatatggaacttaaatcaacaagcaaaaaacgaacaaccgcattaaaaagtgagcaaagtacatgaacacacacttttcagaagaagacatacatgtgtccaacaagtatgtgaaaaaatgctcaacatcactaaccattagagaaatgcaaatcagaaccacaatatgataccgtctcacaccagtcagaatgggaattatttaaaaaaataacagatgctggcaaggttgcagagaaaaggggaccttatacattgctggtgggattgtaaattagtttagccactgtggaaagcagtttagcaatttctaaaagaactcagagcagagttaccatttgacccagcaatggaacacttgcagctataaaaaaagaacaagatcatgtttttggcagcaacatggatggagctggaggccattatcttaagtgaactaacactgaaggagaaaaccaagtactacatgttctcactttttagttggagctaaacattttgtacatacgaacataaagaagggaacaacagacaccagaacctactggagaggtggaggaagggaggagggtaaagttagaaacaacacctatcaagtattatgcttattacctgggtggtgaaattatctgtaccccaaacctctgtgacacacaatttacctatgtaacaaacctgtgcatgtacctctagtataacctaaaataaaagttaagaaaaatgataggaaaacaataatttattgtacattttaaaataaaacagtgtaattggaaagtttgtgacacaaagaaatgataaatccgtgaggtgatggatgtccttcttaccctgatgtcattattatacaatgtatgcctgtatcaaaatatctatgtaccccataaataagcacacttactatgtacccataaacattaaaaggtaaaaattggccaggtgcggtggctcaaactgtaatcccagcactttgggaggctgaggtgagtgaattgcttgagtccaggagttggagaccagcctggccaacacggcaaaaccctgtcttaagaaaaatacaaaaagctagccaggtgtgatggtgtgtagacccagctactagggaggctgaggtgggagaatcacctgagcacaggagatgaaggctgcagtgagctgagattgcaccactgtattccagcctgggcaaccgagtgagactgtgtctcagaaacaaacaagcaaatgaacaaacaaacaaacaagttaaaaatttaaaaagacacacaaactaatgaaacagaataaagaacccagaaataaatacacgcatgtataccatctgatttttggcaaaaatgccaagaatacacgttagggagataatattttctttaataagtgatgctgggaaaaagtttcattaagaagaatgaaactagaccccatctgtcaccacttaaaaaaaaatcaaaatggattaaagatttaaatgtaagtcctcaaaatgtgagactactggaagagaacacggaggtaacactttattacatttctctggggaaggtttttgtttgtttgttttggaaaacacctcaaaagcacaggcaacaaaagcaaaaatagagaaatgggattacatcaaaacaaaagcttctgtgcagcaaaggaaataatcagcagagcaaagagacaacctatagaatgggagaaaatatttgcaaactatgcatctgataagggattaatatccagatatgttaggaacccaaagaactcaatagcaaaaaaccccacaagtagtaaagagtggacaaaagatctgaatagacatttctcaaaagaagacatacgaatggctcactgatataagaagaagaaactcaacgtcactcatcattaggaaaatgcaaatcaaaatcatgatgagataccacctcacactagttagaatggctgttatgaaaaagacaaaaaaataacaaatactggcgaggttgtggagaaagaggatcttctatccaccgttggtggaaatgcacattaatacagctgtttgtggacaacagtatggaagtttctccaaaaattaaaaacagaatgaaaatatgtttcagtaatctcactactggatatttatccgaaggaattgaaattcgtattttgaagatacatctgtactcttacttttattgcagcactatgtacagtagccaagatatggaatcaatctaagtctgtatcaagagatgaatggataaaaatatgtcatatatttttggaatgtattttatccataaaaataatgaaatcctgtcatttgggacacaacatggatgaacctagaggacattatattatgtgaaataagcacagaagaaaaatactgcatgatctcacttatatgtagactctaaaaagactgatctcatacaagttgagagtagaattgtggttatgagaattgtggttgtgagaagctgtggaggattttgaaaggcttgggagggtatgaggagggtggaatggggagagattggtcaatttatacaaagttacagttagataggaatcacactttgtggtgctctattgcatatttctaaaactagaaaactaccatcaatgacaaaatcttaaaagtggtgtttggaaatgtcacagaaaacctaacacccaaagttcctttgtttcacagagtccttttcttccaagttagtgttttaaaggattatcatattttgactttaattttataattaatatacagtaaaatttactcttcaactcatttttttccatgaatataaaaactagctagcacatggctgaaaaatgcattgggaatgtaatctgattatttagcctctaatttttcactatttgactcttcattatatatatgtattctactattcctctgttcttatgaatgcttctgaaaaactaaagacattttagactcttttacctctttaaacttttaactagagttgaaatatatgtaatatatttatataaaatatgtatgtaataattacttaaaccatatgcaaatataatttttagtatttaaatattaagtcactttattaagttaccctggtgcataaattttataataatttattttggaggacgttccaagaaatgttatgcaaaaccatgctatatctctattagacattgtcaattttatttggcaaacaaggttttgtgaacttgaaaaattttgaaaatacttatgattttctcccactgctgtagttaactatatttttatgtattaaatataagagtacatgagtatggatgcgcatatgttctttcactttttaaaaatctgtttatgtgaattcaaagtttgagctcctgaatttaatctatattagtcaattttgtttgggttagagaaacctttttttccaattatttaccggaggagatctgtttttaaaaatacagattaattggtgtagaaactggtgtagaaaatttttttaactggtgtagaaaatatgttaatttcaaacaataccacaagtgtgaaaataatgtggatttatgaattccctgaattttcttctacctaaaaatatctctgtatcttatttcagactttcacttcttctgtttattaaggcaggatacatatcccaaagctcataattatatttcatctgccttttaacattccttatatgcctatcatgtatgtttattttctttttcttcactatttcatctctcactttttctcatatataaagctttctacaattaattcaaatttcaaacacatctttcaaagatgtgtttttgaaatttcaaataatggtatagttttaaatatgttttgatgtagaatataaatacttttttgcttgaagaaaaacatgaggcttttgaattgcattgtttaatagtaaatgagtttttgtgtttctgcagatgtgactctgaaaatcgctatgttggtaatccacttagaggaacatgttattgtaagtatatgtgtattcttcattttaaataattggtgcatactattagtttcaaataataaaggtcatcttgaataactaaaattgtcatgaatatcttgcaatttctatttcttaaattttataatacaactttacgtatattgctaagaaatatattctcttaattatatttggtacattttttctactctgagcagtaaaatagcaatagattttgttgtgaacatagaacaaagtatagaacttgagtaaactcatgtgattttaatgtagtccttttcattatgatggatttttgaagaacttgaattttataatagatattttgcagaattttgggcattactaaaaggctgcactgattttgtaccaacagatgctttcattgggtactgattatatggtaggtatatatttaacttttgttttgttttctgagatggagtcttgctcttgtcgcccaggctggagtgcaacggcacaatctcagttcactgcaacccctgcctcccaggttcaagtgattctccagcctcagcctcccaagtagctgggattacatgtgcccaccaccacgcccagctaatttttgtattttttgtagagttggggttttgccacgttggtcaggctggtcttgaactcctgacctcatgatccgcccaccttggcctcccaaagtgctgtgattacaggcgtgagccactgcacctagcttatctttaacttttaaagaaacagccaaatgctgtttccccaaatggttgtaccattttacattcccaccagcagtgtatgagagtttcagttcttccacatttcagaaacttttttagagttagtccaagttttagccattctaataggtgtgtaatggtatctaactctcattttaatttgcactttcctaattactaatgatgttcagcatcttttcataggattgtttgccatctgtatattttattcgatgaagggtctgttgaaatcctttgcccactttttagattgtttttatattaacaaattttccacatacttcattctagatacaagtcctttatcagatatatgacttgcaaatattttttactagtggtaacttgtctttttatcttattaacactattttcttgaagaacagattttaatttagatgaagcttgacttatcagtttgttcttttgtgaaatcttagcctaacaggtcactgtgattttccccaggttttggtagaaatattatatttttaagttttctatttaagtatatggtccattttgaattaatatttgcatatatagtaggtgatggattgaagttctttttttctccatgtaaatatttaaatgttcaagcacactttatgtgaagactatactttaatcaatgaatttctgtgcacctttgctgaaaaacacttgtctgtaaatgtgtgggtctgtttctggactcttttctgtttctttaatctatttgcttatttttatgctaacgtagcacatttataattaatgtgattttataagtcctgaaatcggttagtatttattctccaactttgttcttccttttcaaacttgttttgactactctttttttttttgcatttgcaagtgaattttagaatctgcctttcaattttcaaaaaaattgctataatttgttttgtgattttgtttaacttatagatgaatttggggagaattggcatgttaactatagtgagtctttggaattattgtattttttattttttctcaattctttaatttttactattaatattttatagttataactgtacacatatttcacatttttgtcagatttatccctgtatattttaaatttgtgatgctattgataatgttagcttaaaatatttcattcctgatttcctgattgtttctggcatttataattgattttatattggttttacatcctgtagctttgcaaaagtcacattttacttctactaccattttttgttgactctcagaatttctacacatacaatgtttcctgcaaataatagcagttggatttcttttcctctcttgatggttttctttcttttttctgccttattgctatagctagcacctttaataatgtgttgaaaagatgtgaacatgaaagtattattgtcttgtttctgatctaagagggaaagcattcagtcttttatcattaaatatgatgtaggtttttgctaactgcctttatcagattaaggaaattgccttctattcctactttgctgtacattttttatcagaaatggttgtttatgtccaatgcatttcctgcattaatttatatgattatcagaaatttctattttactttgttaatatagtgattttagtatttttaatttaatgaacggtatacagtataagaatatactaccatttttgtccattcataagttcatggacattgggatttttttctaggttttgtcattaagaaaaatgctgcagtgaatgaacattcatatggtctttatgtgaacatatgtttttattttccttgggtagattcctagcaatgtatagtttggttgtatgataagcttttgcttaactactttagaaactgccaaatggttttccagaatgttggtaacattttttaatttattctagaaaattttgatactagaaatttcattccttgacatcctcatcaatacaacattgtctctttgatcatagacattctagagtgtgtatagtggcattttgtggttttgttttgtatttctttaatgactaatagtgttgaacttgattttatgtgttgatgccttgaaaatgatttgctgggtgtgtaaaatttatccttttttcagtttttgttgctgttttaaattgtatttttcaaaattttgttttctactcttgtttgatatataaaaataaaattcgttttagtatattgatcttatattcattaactttggtgaacgcttactaaattctgtttgtagatttgcttggatttttaaatgcagttaattatattacatgaaaataagcacaattttcttcctttttcaatattttttacccttattgggatgttgagacctctatttctgggctgaatcacagtgatgataatagatatccttatcaggtaggatgtttattataatttatggaatattccttgtatcacattaagcaaattcctatcttattttgtgacaaggttatatcatgaataactttcttttaccttattaaatactaagttaaattaatagattttctcacattaaacatcttttcattctgggctaaaccatacttagtcatggcatattagtatttggatactgctaaatattagttgtttatattttaatttagaatatttttagtatgaaagaagacgatctcttttttgaatgttattttttctgactaaatgacctatgactgcagtttttaaaaattattttctggccgggcgctgtggctcacacctgtaatcccagcactttgggaggccacaaagggcgaatcacgaggtcaggagatcgagaccatcctggctaacgcgttgaaaccccgtctctactaaaaatacaaaaacaaaattagccgggcgtggtggcgggcgcctgtagtcccagctactccggagactgagatgggagaatgtcatgaacccgggaggcggagcttgcagtgagccgagatcgcgccactgcactccagcctgggtggcagagtgagactctgtctcaaaaaacaacaacaaaaaagttttccattctatatatctgcaattgtggtaaaagcttttaaaaatgaatttggaacaattgctatcttcttttaaaacaggaatagttaaaactttaaataaaaattaggtatttcaacaaaaatttttgggtctagtgctttttaattggtagttattttatttttttattttttgctatttcatagcattagcttttggttttatttatcttttctgtggatcttgttttttagttcatcaatttcagattttgtctttaataatttccttctcatatactgtttgttgttgttttgcctatatttgctatagtattttaaaattatcatttttttacagaatttatgaattccttttttatctttaaaaacgtaattattttcttagttcctttcttaagtgattcttattttttaacttttattttaggctcagggctgcatgtgctgcctgttatataggtaaattgcatgttgtgggggtttggtatacagattatttcatctcccaggtaataagtgcagtacttgataggtagtttttagatcctcaccctcctccaatccacaaaacatttgttaactatttttaattttttaaaaatgttactgagaatgtggcatataaaatcccaaattttgttaaggtatttttgccctttatgacacatttgatagggtatggaggcaattttgtttgtcacaacaggggagtgggacgtgggtgccgtgggcatctcatgggtagaggctagggatgctggtaaacatcctgcaatgaaaaggtcaacctccccagaacaaaaaatcatgtggccaaaaatatcaatagtatttaggttgagaaatcctgatttagaggcttaatcaaatttatatctgattttggagaaaataataattgtagatggtttggttttctttgtctagaagagtcatatcatgtctgttagtgtctcttatgttcttggcacacactgacgctcaatgtttagattttaattgatcaagattgaaaagatataatattctgccaggcacagtggctcacgcctgtaatgccaacactttgggaggccgaggcgggcgaatcacctgaggtagggagttcgagaccagcctgaccaacatggagaaacccgtctctactaaaaatacaaaattagctgggcgtggtggtgtgcgcctgtaatcccagctatgtgggaggctgaggcaggagaatcgcttgaacctgggaggtggtggaggttgcggagaactgagattgtgccattgcactcgcacctgggcaacaagagtgaaactaaaaaaaaaaaaaaaaaagaaaagaaaagatataatattccaatttcttcttcatgttttggtttgaatacttcggtaaaaacaaattttcgctcatcagctgtttggttgcttattgctacagttcgcatagggaaggcatgataaatgttacagtttttccctgtattttttatttattccctttactacttttatgtatgtatttatttatttaaaattaaaagttagctcaatatctttcaaaaatgacagtttttgtcactaatgaacttatagatccatacatgttttaatccgtgtgcaattattattcctactgatgctcagactgtccaattactgtgtcatttaaattatctttattctctagcttttccacatcatttttgtttttcttatttcaaatatcctggatttattttatagggatttttttctttggttttttaaaattagaaattcctctttttttgagcctttagtttcttttatctgccaaaggagtaactagttaccattatgaacacattatgtaatctctgtttattacaaatatactaatgtttaacccttttataaaaactagcataatttttcttctatgtcaatgttgtccaatacaaatatgatgtgagcctcatatgtaatttaaaattttctagtagcttcctttaaaaagtaaaagaaaatgagtaaaattaatgttaataaaaccttttttagcttaacacatctaaaattttttcattttaatgtgtaatcagttttaaaagtcattaagtcattaatgagatatcttactttttttgtactagtgtttgaaacaaagtttacattccatacttacatcacattttaattcaaatcagttacttttcaactagtcaatagccacatatggctagtggtgaccttattggacaactcttctctagattacataggatccctgcgttcttttagaaatatcagaagcataatggtaaagcactaggtggcactcttggtattgctgtgagacgtttaaagcttaatatttgaaaagaagtgatgcttaaaaaagaaaaggacaataactcttgtaataatgttaatagaaactattctaattttcaagattagatcgaaatttaagatgcaagtccacactgtaacttaaagcaattgagtgcaatgtggtattaacttaattgaaagtgatatgtcagcagttgtaatctatttacttagtagtttttcaaagttcattttaaaaccaaaaaccaaatatattataaagcatgcctcacaaaggagggaaaacgttcaaacagtgttaactaattttattggcccttgtaaacattgaattactcaatatatttttagtaaatacaaaaagtagtagtcacaaagtatcacaaagtagtatagtttttttttcttaaatgctttcttttaattgtaataacaattttaacaaagaaaaccttaaaaatgaaagactaggctgtagaaatgctatatagatgatatatttcaaaaagtagaatgagagtacataaagtcactttctgcagtcatttactttatttcactattgtgctaattctttaaatacatgtaatttgcaatgctcacacccctaattattgtgttttaatatacttccaagtaattgaacacattttatttcatcttttactctttaaaaaattactgttttatgttgaatttcttttattagagtttcttttatttagagttcatggtggaattttgtagtaataataaactacctattttgagagtaggaaatttaagttgaaaaagatgacttaaaatagtatgtcagtttaattacttaaaatagtatgtcatagaaaacaatgaaaccaattaatacttgaattgacccttatatttaatggaattatcctggtttttgttctaaaactgaataaaataattttcctgttttaaactgaacattttgttagtgaatgttttatatgactttttaactattggctataaattgctatttaagtaggatctggctgtttcatttgcacatggggcagagtgatcttaataaacaccaataatctaaattcttatatttaccagattgcagacatgatggattgaacagtatctgacaagacataaatgagtcacatttttggcattttaaccttgttctttgattcctcagtatttttattaaattttctgaagtctgtatccctgtacttttagatttttatttcagaactatttactcctttagcatagtccaaaatgatggataataaacatgattataagaaaatttaaaatagctaaaaggaaaaaaattgctattaagttaatgtagaagaaggatgaaaatttatttgacttatatattttacaataaaagtgttacattattattttcatgtaaaatcatagactcactgtaaaaaataataaaaaagtttaaggaaggaaataaaaatgtccataaaccttccaccaggtcccccaagttgagttgtgtagtatgtatcctttgtaagggtactcagctgagtggaagattgagagctgatatgctgtacttacctttctcactaagccatgtaccctagtgtggggctgtgtctgccttgagccagaggtatatagttctttatttgtgtgtaaaatgttgaatggtctactgaagggactgcctgccttctaaataaatctctgcatcatgtcctgagaatgattttatgtcatagaggtcataacatgcataatattattgtgaatgtttttcttatagatatatagctcattattagcatttagtaaataaaacatagtttttcccaaactggaaaagaacaaccacctgactttaaaataatgatcatactagttaacatttattgagaacttactatactagactgttctcagctttttatatgtattagcttatgtaatactcaaatgggaagggtatgcttattattcccattttatagataagaaaacagagatagagaaagctgaactaatttgtataagatcacacaggaaatagtaaaggcaggtttcaaccctcttaaccattaaagaagtggaaatcagtggtatatgtaagcaaaaagtttttatatgagtgaaataaaaacattatgctgaaggaaataagaggatctaaataattaaaaaatcatatgccattttttcaaataagaaatattcatccaaagatatcataacttcccaaaattgatataaaaattttatgtaattccattatagaatttcattcaattttttctgaaaggcatgcattccaataaattaccttaaggttcaagttaaataatacacttttagaatatccagttagattacaaacaggaagaatagtaagaaattcctactttaatagatatccaaacaaactgtaactctaactgcatccactggctcccaaacttgtattagaatatgccactaaatcaatgaacaagttggagtataagattaagttcctgataatttgggaatttatatggtactatggtttgaatgtttgttgcctccaaaattcatgctgaagtttaattgacattttaacagtattaaaacctgggactttttttttttttttttttgtgacggagtcttgctctgtcgcccaggctggagtgtggtggcccaatctgcaagctccgcctcctgggttcatgccattctcctgcctcctgagtagttgggattacaggcacccaccaccatgcctggctaattttgtttttgtatttttagtagagacggggtttcaccgtgttagccaggatggtcttgatctcctgacctcatgatccgcccttctcggcctcccaaagtgctgggattgggacctttaagaggtgactaggccatgaaaactccaccctcataggtggaatttgtgctgttattgaaaggcaacttcagttccttcttgttctctcttgccctttggccttctgccatgggatgacacagcaagaaggccctcaccagatgccagctgtttggtcttctactttccagccttcagaactgtgagcccataaatttatatttattataaattacccagtatgtggtattttgtggtattctgttatagcagcacaaaacaggctaagacatatggcaagtcattttatttgtatgtctttaatgacttaatttgcttgttcttagatatctcaaactttacgaagattatggctttcgcatttactacttttctctctcaagtactctatccccagctaatattccaaacctaacaaaaatgactcttccagatatcacaaaccttttgtttccatcctaacacttacatagtataaaattatctcagttgatttctgtttttaacttgaatttaggtttttaagtaaaatgaaattttactagaatcaaattctgtgaacactgtaccttgttttattggatctccatacttagaaatctgtatgactcataacagaccttcagttatgtttaatggtagtagactcatataagttattaatacataagtgaatatacatttattttagctgtatgagcaagcatttttattgttggggtacttgagcaaaaatgtccagagatcatattgtagattatcaagtaaaagttgctttaagtttattacggacatagggtaatactattatatcactgaaaaactttaagtatcagtcttttatttaaagaaaaaatgaatttcaaggtttgttttcttcattgaacatttctttcaaatgaaactaaatagatgaccattcatcattgcaggataattgaaagtttagtgattttgagctattatgaagtaaaaaaaggtggcttctgaataggtcatggcatattattaaaaatcccataaattagaaaaattaatgtatggcattggtgataatcatccattcttatgtatttaaaaaatttatttgtaagactgaatgaatttaaatgtatatcttaggtcatacaattagtagttttcagagtttggattataactgtgttttttctatgatatgatatctagcaaatgctgaacctacaaaacttgtgcaacagattttacttttgaaattgttctaaatgttccagattcagtagaaattcttaataattttcagcatggatagtacagttgagcaaacaaggaaaaactagtatttattaaatatttatgtacaaaacaattttatattaataatttcagtattcccaagggtgacatattttttctcattaaattactttctggaggattcgactgttagagcttggagagactgtcatttacttgcgtttactgacttgtgtttattcattctacatttacttattgactagctactttgttagactccatggataacaaagtgaacaaaatgttttttcctctattgaagcttatacactactagagaaaatagatattaaaccagttatatgattttcataggtgtgattttcgtaagagctctgaatgagaattatagagttttgggaatgtatttccaaactttatagagctttgggaatacattacaagagggcctgacctaatttgtgggatagggagtaggtgaggtaagggaatgattgagctttgatttgaagaaatgacttgataagatgtgatagtgtgagggtagataggaagaagtggaaccaaaaaggacagcatgtacaaaggttcgtgactagaaagaacatgcaatgtttgagttactaaaagaaaaccaatactgaaacacatagaatatacagagcaaaaataggaagcttatgagatctgcaagatccaaacaatgctatgctttatagaacatgtaagatacggtctttatcataagaaagataggacgccattgaagggtatttagaggagagaaaaatgttacattttgcttttaaaataatcagtctgctttcagtatgtaaaacagcttagtggcggcaatagagcatgaaatagaccatttttggtttattttttgaggcatcttcctggagctatctgtaaaatatcattacagcacattgagactgttaaaatacttgtacttttattcacatgggtttttatcatttactaaacaattgtctaagtttgcaaatagttgtatttataatcgtaccattgtttaaatgtttttggactctcgatattgttgtcaaagtctgtatgtatcctttatagactcctcaggatggctgactataagatcataaacatatgtttattaacaaacatatgaatataaataaacatacatatgggaatctgacttttgaaatccttcagaattcattcagaaataactacagtgaataaggcagtgaaataactttatcgaatgcctttattttatcagacagtcttctctaaggcaaatacatactcacacaattacatttaattcacagagcagtcctatgacataggcggttttatccctgttgtaccattgggtctcattaagcttagttaacttgtataaaataacctagttgttatatgggagattacaaccaagatctccttaaatggtatagatgatgctaaattaaaactgaaacgcaatattaactgaatcattaactcagtggaaaagcaaattattaagctgcagtttgtttctcaaaaaattcacatataaaatttcagaaacaattcaaaatttatatctaagaattcttcttcccaaataagttgaaatttacatgagcagtgccattgatacagcatatgcaaatcaggcttatttttatttgtcatcctaacatgcctgccatcttgcatctcagatataaagatatttccagtatacaccttgatgattttttttatcactggttactatcttcttaaaaaatacattatttcctgcagattttgttgcaagagtaaagcaaatcttaaatattcactacttgctcttcatcatcccaagcatgtaatgtactcagaaactttcttcttagtttctctttcaaaatgtctttttatgcatatacattttagtcatcactttccacctaatcattagtttttaatatctgacttctttaaacatcttgtatacgttaaaagccttttctctttatatatttttgcttaaactcctttttcatgcaatgtgttttactcatcagcttcatttagtatataatttgttcttgtagtaaatagaaaacacttttttgcactacggctgctagaccagtattgactaaataaccttaaaaaaatcaacttctgcatgttgaaacttaatcctgggcatattccagtcatataagactaggatgagagactgattatcttgtatgtttttgttagcctatatctaagaagtttgtgtattaagaatgaaatatgccatttttggagagaaacataactacagttgacccttgaaccccctgaggtatagaggcaccaaccccgcatgtagtcgaaaatctgcgtatatctttttactctccctgaacttaactactaataggatactgttggccagaaaccttaccaataacataaacagttgattcacatatattttgtatgttatatacattatatattgtattcttgacagtaaagtaagctagagaaaagaaaatgtattaagaaaataataaggaagagaaaatatatttagtattcattaagtagaagtggaaatggatcgtcataaaggtcttcattctcaacgtcatcatgttgagtagactgaggatgaggaagaggaggggttggtcttcctgtctcagaggtggcacaggtagaaaaaaattcacatatgagtggacttgcatagctcaaacctgtgttgtatagggtcatctgtatatcaatctaattatttaatatgtaagtatacatcatgtgaaaaacatgttgaagatcaaggattaaaacaaagaaactctctgaacattggtttacattttttttggcccaatagtggaaatactgcatgttcattctagaaaagagataaataaaaataaaaataaaaattactaatttttctacctagagaaaattgttgctaaattgtactagttttccagtcatttatttatgtattgatactctgtgttagggtgagtaatgcaccccgaaagatgtctacatcctccccagaacctgtgatacatacttaccttaaatgataagaaggagttacatatgcttaaactaaggattttcagagagactattctggactatcctggtatactcagtgtaataacaagtattcttatgaaagggaagcggaggaaatttgactacagtagtaggagatgtgatgatggaagcaagtggagagatgtgaaggaagggaccatgagccaacaaatgaggacaggctttggaagctggaaaaggcaacttttaccatacattgattattcttatatgaaagaattattattaatgtgtttaccaaatgatgattttctatttcatcatttgttttacattattaactgtaagggagagctgttccttctccttcctcattaatttgtttaattatttatttatatcggtatgaactcatggatatctatttaattttatgatttataagaaattactgtcgttatttattttgtagctgaaattgttccagatctggtcattaagatccccctcaatttggcttctgtgttttttaacataactccatcatttgttgagtgcatccttattttctagcactacaagatatttcgggcttaccttgtactttccctcttccatccctgaaatcaactagttcccatttccccaagatgccatggtttcttatattggagaataatatttagaaaccaaaactggggattatatatgctcattggttctggggttttattctttctttcttttaaaaattttatgggtttcctgacccatgcactagggtataacaatggtattacccgataccttgtcattaataacatcacctatgaaataccaaattcaaatatcttacacctttagtccttcttgctcactaagtaccaatgccataattattcaaactcattgaaatttgtaattcattaaccctacttgttttctcattttcaccctttcctagtgccctgctgtcttcttttatacccttaaccatgtgaggttttatgccattatagttatcagtccttagctaaaactgcatattttcttcccactcctgtttcttctatctacttgtgtagcaaaatccaaactggttaatccaactcttcactactctgtgtctgaactttcttcaccctcacgttgctggggggaaaaaaaaatcatatagctgtgttgactgtttggtcttgagctttatcaaaggaaaatgcaaaactacctggtgtttttcctgcatttcctttataatactctccaaataagtgttttaaaacttcatctctattctcaaacctttatctgcaccagctaataattttacctcctacttcattgagaaaatataagcaaatagatgcgaatgttcccatttttttttaccaccacaatcaccaaacttttttgcacctatacttattttctctgcctttagtttattatcgaggaaagaataactctgttcctaacaaaagcctatttttcaatttgttttgctctaaattttatacctttaactctttaagggactttgctcttccatttctgctttatcaacagttgcttagactctactggaccaatttccttagcacacatatacatgttttaatatatcttatgttaaaaataaaatttttctactccccttatacttctccaactattgcaccatttctgtattttctttcagatcaacccttctcaaaatagttgcctaaacttgtcaccaaatccttaccacccatttcctcttcaatccccacaactccatagacattgcttttctaaggaaacataccacagagtcgaacagttgaaacagtctatttcttgactttcctatcatactttccaatttttcctactctgtcactgactgcacctttttagtcttttttacttttttttccacttgaccttatcagttcccatagttttaagaagcatctaaattttgatgttccaaaacttgtagttttgatcacttttctgagctgcaaactgatttctctgactttctgtttgatatcatcatttagatattttattagaaagtcatattcagtattttcaaaacagaactctaagtttttcctcattttataaaacttcattctttactcagacttcctcatttcagtaaatgtacataatgcctatatacttgcttttgtcaaatatctgaaagccttctttgattcctgattccaaagacttctttgagcccccctctctgatacctttcctttctcaacccttactttgtgagggtgtttagtacttcagttggatttccttatacaatatatcccaaagatatatatctttctctcttctacttctcccaccctgtccaaggcactgtcattttgactctggtcctttttagaagcttccttgtgtagttttcccattttcagttttaattttcttcagacattctccaatcggccaccagggtgacatttaaaaattaaaaatcagaccatctcactacccagcttgagatctttcatggttttccatgatgtggcccttacctgctttctgactttatctcttacaaccctccacaaatcattctaagcacagtggaattatttttttttcctcaaacagcgcagcttcattttcatttgtgtttgctctctctctctctctctctctctctctctctctgtgtgtatgtgtgtgtgtaaacaatcaggaactttttcactgtaaacaatcaggaactttttcactgattgtttacatgatttgcttctcatttttcatttatcatttcagatgttgtttccttttgtgtgccttttgtaaagcaatcttctctgaacctgtaatagggattggtaagcttttgctgtaaagggccaaataatagatattttaggcatgacaggccagatggtctctgttgttcctactaaactctgccactgtagtagacaagcaaccatagacaatatgtaaatgattggttgcggctgtgttatcataaactatctacagaaacaggctgtggaccagatttggtctgtgggcagtaatttgtaacacctattccaaaacattaccttgcgatcttcatagcatatatcactctcttaaaatgtcttgtttatttgtgtgattatttttggctttctcttctattaatagaatgcaaactccataggaacaaggcctttgattcctcacttctatctgtctataattctgattggaattttattaatttaaaagattaatctgaggagaacatatatatattttcttaagtattaaaatttagaatgctccttagcagtctatttatcatgtatagttacatcttcttttatgacctaaaatagattttgtagttttgtaaattaaattttttgtagttttgtaaattaatatttagtttatttctgggatttcatttggtttggagatttttattagtttgctattcagaatggaatttttaaaccattacattttctgttgaatgtaaaacctctattgatgtaaaagaaaagctattgatgattatatgtgtttaaatttttgcatttttttggtgatttgatatcatcaaattattctgttgatgatttatagtgatgccattaatgacaaatttttggtctcaaagtctataattgaaataaatgtaattacacctgtttcttttgattagcatttgcctgatgtgtctcccttcatcctttcagtctgtgggctctctttttataggcatatctcttaaaaatagaagactttgattttgctgttttctaatctgtacatttttgtgattaatgatgagttgaatccatttatttttggtgttattattcatatctgaatctatttataccattttaattttttattttgtatttttactttttatatatttgtttttaagccttttatagcttttttggaaggggaaacatactgatatccccctcctataagataaggattttagcattctgtaactttttttgaaattcttttataaaaccacagtgttttgatattctctagactttctattcttggttattatggatacgcatgtttctttggacatcgcaatttttacaaagataacaaattcaccaaggtattttatcagccccatctccgtatcccttgatatattttttgctacacattctgtatttatctcttctctttttaagtctttaatcaaaaattgttttaacggaagtctgcatgtcaaagcttctgaattctctatgcctcagagtatttattattccttcctatttgagtgtatgcaactaataaagtagacttaatatgtggagcaaaaattgattaaactacaataaaaaattaaacatacctctttagagtatttctagatcaagcagacaaaattcagaaagaatatcaaagatctgaagaacacagttaatagaaatatgaattatagccataaagatttaaaagaggatttaaatttgcatttattttacagatgatataattgtttccataagaaatcgaagtgtctacaggcaaattattagaaataacaggaatgtttgtcaggttgttggatacaaaattaatattaaattgccttcttagacatgttcctctaccagctgttagggctaactagatagttacagtaattaaggcagtgtagagttgtttttcttttgttttttggtgcagggataggcatagtcactgaagtaataagataatctccaaataaaaggtataggtatttatatattaatatttaagtcatatctggctacattactgaattgtttattatttaatagctttttagttgttttatattaatttcttggtaaactgattctaggcagaaaaagacaactttgttttctttttaaaaatattcatatttctgtataattatatttttgtaatttacctctgtcatctattcaccttttttctttgccatttttgtatttgtatttgtctcttagttgtaatgtgtgtgtgagttgattttttttttcaaaactgatatgtagattatgtccttttaggacacctgtttacctgaaattattttattttattttattttatttttgaggtggatagagcaagatatttatatcttgctctgtcacccaggaaggaatacagtggtgccatcttggctcattgcaacttccgcctctcgggttcatgcgattctcctgcctcagcctcctgagaagctgggattacaggtgtgcgccaccacgccagcctatttttgtatttttagtagagatggggtttcaccatgttggccaggctggtctcgaactcctgacctcaggtgatctgcccgccttggcctcccaaagtgctgggattacaggcttgagccactgcacccgaccctgaaattattattatattgttcttgaatggggacagcattgctgagtatatattttccataaatattacttcttttttttattttgacatttatttctgcttaagagcacttggctgctgggcaaaatggcttatgcctgtaatcctagcactttgggagactgagacgggtagatcacctgaggtcaggagtttgagaccagcctggccaacatggcaaaaccccatctctactaaaaatacaaaaacaattagcaggatgtgggggcacacgcctgtaatcccagttactcaggagctgaggcacaagaattgcttgaacctgggaggcagaggctgcagtgagccaagagtgtgccactgcactccagcctgggtgacagagtgagatttcgcctcaaaaaaaaaaaaaaaaaaaaaaaaaaaaagccttggcatgttgcctaatcctactctgtaaataactcatttgtccgtgtgtgtgtgtgtgtgtgtgtgtgtgtgtgtgtgtgtgtgtgtgtacacttacctacatggacatgcctggatgtctgtaattttttttaacaataacttcatagagatatattcacaaaccataaaagtcaccattttaaagtgtacaattcagtagcttttagtatattatacacagttgtgcaacgatctgcaccatctaattttggaacatttttatcgctccagaaagaaagctgtacatgtcagcagtcacttatcattcttttttcaccagctagtggctaccatttatcttctttttgtctgtatggatttgtctattttggacataacaaaataaatcagtcttttgtgactgatttctttcattagcacagtatttttgaagtttattcatgttatagcagaaatcattactttatttctttttatgacaaaataatattttattgtgtgaacatatcacattttgtttaccattcagttgaggtacatgggttgtttttacattttggctaatttgaataatattggtgtaatataatatgctttttatatttatacaagatacttcctttaaatatttaggttttcttcatcaacagatttttttctttatttaatatatgtgctacccttcaactcattatgatctctgctttaactacattagtcatgcatacactgaatttttctgtgtatcatttctcttgagtgattttcatctctatttctattttgggaggctttttcgtatttgacctacatagcactatttcagtcttatgttgtattaattattctgttttctgattctcgtattaactttttaaattttgccattacattattacttttttgttcttccttttgtaatttatttagctctctttttattgtaatctttggtgttattatctcatctttcatctttaattttgtggagtcagtgttttttagattttattttctcttgacatgttccccatgggtattttaaatagctaaaaaaactctgtatttatattaattgtatctacttcatctgttgttgtcaaattgagattttgctctttttctcttcttaccattgcaagtcaaaataatgtaagaaaagcaaaaatgtttactacttttcctatgtttttgtttttatgatttaaaaaacatatgcaattggaatttggagcctgaagtatgaatggttttgtattctcctgaagctctacgaagctcatacaaaaagtgagaagtgtaaataagagaggtctttctttatatctattttacctatttttataaactatttttatataaaattgggaaattaattgtggatctccgattttcttggatttatgagaggtggtttgcttggatttatgaaaggtggtttgctgattgttcgccaaaatatttaaaagcagatacatatatcatttaaagtggttctaacctctgggctcagtctttaaaatcaaaaggttgatttatagatacttacagctttgattcttcaagccttgaaatacagctatttagtatttttttctattaacaaagttttccaaaaggtgttcctagcatatttaaacataaagaatagtttatctttttttaagttatggaaatttaaaatgtgttaaaaagtatagtatatatacttctattcatgtagtatatatatttcatagtatatagaatatacttaaaaattgtgtacctgttaccaagctttaataaagcttaacgccttgctctatttgctttggattttttaaaaagaaagtaaacatcacagatagagttgattttttttgtgtctttttttagatagagccaccaaactgtattttgttttgtccttattatgctaatgttatttgtttgcaatatatataataatcaatatttattgagtactttatatatgtcaaacagttataagtacctttaatttgttagctcacttaatcatccataaaaattaatactataccacattatttaaaatatataaaaattacatactctgtgaatcctacaaattgcttttatgtgcaacatatttgagatttatcaatgctaatatatgcagccatagtgcatttattttagttatgtagaatatttctacaggtataacatttatttccccattctccttttgatgcacatctaagttgtacttaatttttcaaaataatatataattctggaattaaaatccttacacatttctacttgaactggaagttctttgagatatacaagtagaagtggaattgtagatttattagatttttccaaattacactgcaaatatttatattaatttatgctccatcatggtatacaataattttcttccacttcctcaccaacattttatgtttttagtctctttaatatttgccaatctgatggttttgaaatactatcttgtttttacttgcattttctttatgactaattgaaacaatatcattttacatatttattgtgtatttaagtttctcttctttgaattgttgctcttattctttgtctttttcttattttgtagtttgtctttttcatattgttggcattttcttattgatttatactagttttaatgtaataaattctggatattaattttttgttcattattgatacagcaaatatcttctcatagtctatgacttggctcttgatctttgttaaaaatgacatttatacattcttctctttgctacatggcacctaccctaaactcgaatatcaaccacataattggatataaaacaatcctcagcaaatgcaaaagaactgaaatcataacaaacacactcttggaccatgtgaaaatagcagtcaggacaaagaaaattgctcaagaaattaaataacgtgctctggaatgacttttggataaataatgaaattaagggagaaatcaagaagttctttgaaaataatgagaacaaagctaaaacataccagaatctctgggatatagctaaggcagtgttaagagggaaattcaaagggctaaatgcccacatcaaaaagttagaaagatctcaaattaacaacataacatcacaactgaaataattagagaagcaagaacaaatcaaccccaaagttagcagaagacaagaaataaccgaaattagagctgaactgaaggaaatcaagacgcacacaaaaaaaaaacatttaaaagataaacaaatctaggagttggttttttgaaaatattaataagatatgttgcaagctagacttatttttgcagttgaaagtaatggcaaaaactgcaattacttttgctccaatgtaatagcgtgccaaccaacaacaacaacaacaacaacaacaacaacaacaacaagcataggtcctgatgaattcacagatgaattcaaccaagtgtacaaagaagagctggtactattcctacggaaactattccaaaaagttgaggagaagggacccctccccatattattctatgatactcatatggacaggaggcagggaaacactgggtagaagagggcagtccctgggagggccccaccctcaagcctggaacagtagcccaaagggagaaatttctatcaccatatttctgctcgaatgttgccttttccaaaatcgccctggcccaccccactcccctgattctgtacccataaaaaccacaggctccactggcagaggtgctgcagaaaaggagagaagagaagaagcagccagacattggagagaagcagcttgacttcagagggatggcttgacggggaatatcagaggagagcttggctggggagagcaagactccggggaaagaccaccttctcacctcatattctttccacctccccttcccactgcaagccactttcattggcaataaaatcctccatattcaccaccctccaatttgttcatgcaacctgattcttcctggatgctgaacaagagctcaggagccatgggtatggacacttgagctatttaacacttaagccttccgtggatggcaaagctaagaagacactgtaacacatgccctctggggcttcaggggttgtgggtaccccccagacactgccatggggctgcacagagttttgcttctgccggcacccagaagcattcatcccagttgctgcacctgctcacttgcatgctcctcctcccacaaggggttatttaagagctgtgggctgagtaagtgaggcaccccttttgtgagacccatgaagggtcagggaaaatgttctgtttcaatgccagcatcatcctcataccaaaacctggcagagacacaacaaaaaaagaaaacttcaggccaatatcttggatgaacatagatgcaaaaatccccaacaaaatacttgcagaccaaatccagcagcacatcaaaaagctaatacaccacaatcaagtaagtaagtaggcttcatccccaggatgcaagattggtttgacacaagcaaatcaataaatgtgattcatcacaaaaacagaactaaagacagaaacaacatgattatctcaataggtgcagaaaaggctttctataattaaaaactataacttaggtattaaaggaacatacctcaaaataataagagccatatatgacaaacccacagccaataacatactgaacagacaatacctggaatcattccccttgaaaactggcacaagacaaggatgccctctctcaccagtcttattcaacatagtattagaagtcctagccagagcaatcaggcaagagaaagaaataaagagcatccaaataggaagagaggaagtcaaactatccctctttccagaagacatgatcctatatgtagaaaatcctatagtctgagtccaaaggctccttcaacttttaaacagcttcagcaaagttgtcagatacaaaatcactgtacaaaagttactagtgttcctatgcaccaacaatagccaagctgaaagccaaatcagaaaggcaatcccattcacaattgctacaaaaagaataaaataccttagaatacagctaaccagggaggtgaaagatctctataatgagaattacaaaccactgctcaaagagaagacacagacaaatggaaaaacatccagactcatggataggaactgtcagtatcattaaaattgctatactgcccaaagcaatttacagattcaatgctattcccataaaactaccagcagcattcttcacagaactagaacaaaactattttaaacttcatatggaacccaaatagagcctgaatagccaaggcaatttgaagcaaaaagaataaagctggaggcttcacgttacccagcttcaaactatattacagggctacagtaaccaaaacagcatgatactggtacaaaaacaggcacatagaccaatggaacaaagtggagagccaggaattaggctacacacctataaccatctgatcttcaataaagctcacaaaaacaagcaatgaagactcccttttcaatcagtggtgctgggataactggctatccatatgcagaagattgaagctggaccccttccttacaccatatacaaaagttaactcaagatggattaaaaacttaaatgtaaaacacaaaactataaaaatcctggaagacaaactaggcaatgccatcctggacaaaggaactggcaaagatttcatgacaaagacaccaaaagcaattgcaacaaaagcaaaaattgacaagttggatctaattaaagagcttctgcacaacaaagaaactatcaacagaaactatcaactatcctgtagaatgggagaaaatatttgcaaactatgcgtctatcaaagatctaatatccagcatatatatggaacttaaattttcaagaaagaaacaagcaacctcattaaaaagtgggcaaaggacatgaacagaaactttcaaaaaaagacatacatgtggccaagaagcatatgaaacaaagctcagtatcgttgattgtagagaaatgcaaatcaaaaccacattgagataccatctcatgccagtcagaatggatattattaaaaagtaaaaaaataacagatgctggtgaggttgtggagaaaagggagcactcatacactgttggtgggagtgtaaattagttcacccattgtggaaagcagtatggcaattcctcaaagagccaaaagcagaactaccattcaacccagcattcccattacttggaatatacccagaggagtataaatcattctaccataaagacacgtgcacacaaatgtccactgcagcactgttcacaatagcaaaaacatggaatcaacccaaatgcccatcagtgacagatcagataaagaaaatgtggtatgcataaaccatggaatactatgtagccataaaaaatgagatcatatattttgtgggaatatggatagggctagagactattatccttagcaaaccaatgcaggtacagaaaaccaaatactgcatgttctcacttacaagtggtagctaaatgatgagaactaaagaacacaaagaaggatacaacagacacgggggtctacttgagtgtggagaatgggaagcgggagagacagctattggatactgggtttaatacctgggtgatgaaaaaatctgtatgacaaatccctgtgacctaagtttacctatgtaataaatcttcacatatacttctgaacctaaaattaaagttttttaaaatcaatatttattgtggaggggttttcaactttattaattttttcctttatgattgagatcttaatgacatgcttttttaaggtcataacagatgctctcttgtatttttgaaaagctataaagttttgcttttaatatttaggtctttaattagctgaaattgatttttatgtttgatataggatataaatccatactgtagtttttcttttttattgtttgttcctgtgccatttattgcagtctccctttcaccacagatttttctaaagtactttattgagatacaattggcatagaaaaactgtacacaataaatatccacaatttgataaattaggaaataattatacatctatgaaaccatcagcacaatcaagactataaatatatccatccaacaccttaagttatttaattaattttcttaaaacttaatataagacctaacttgttagcaaattttaaaaatatacaatacagtattgttaactataagtactatcctgtatagtagatcatcagagcttaatcattttgcataactgaagctttgtaccctttgagtaacccttccccttttctttctccctatcccagcacctggtaaccacctttctattctctgcatgtatgaatttgattattttagatttcttataaatgtgggataatacaatatttgttcttctggtcaggcttatttcacttagcatcatgttctccaggtctatctatgttgttgcaaatggcagaatttccatcctttttaatgctgaacaatatttaattgtatgtatatactacagtttctttatctgtcatctgtcaacaaacactaaggttgcttccatgtcttgtctattgagaataatgctataaggaacatagaagtctagatatcactttgagatcctgagtttagtttcttttgatctgtatatacctaaaagtgggattgctggaacagatggtagttctatttttaattttttgagaagacaccgtactgtttttcataatggcagcaccaatttgcattcccataaacagtatacaagagttttttagagaaatgtctattcagtctctttgcccagttttaattgggttgtttacctgatatatagttgtttgatttccttttatgttttggatatttaccccttgtccaatgtatgatttgcaaatattttctctcattttgtaccattttcttttgttgattgttgcctttgctgtttgatgtaatttcaactttttagtttgatgtaatttcagttgtcaatgtttgcttttgttgcctgtgcttttggtagtatgttcaagaaatcattgtgtactatgcagccataaaaaatgatgagttcatgtcctttgtagggacatggatgaaattggaaatcatcattctcagtaaactatcgcgaggacaaaaaaccaaacactgcatgttctcactcataggtgggaattgaacaatgagaacacatggacacaggaaggggaacatcacactctggggactgttgtggggttgggggaggggggagggatagcattaggagatatacctaatgctaaatgatgagttaatgggtgcagcacaccagcatggcacatgtatacatatgtaactaacctgcacattgtgcacatgtaccctaaaacttaaagtataataataataaaaaagaaaaaaaaagaaatccattgtgaagttctctgttgataagcatttcttctgtttccttataagagtttgatggtttcaggttttacatgtaagtctttaatccactttgaattgatttctgtgtatggtataagggtctaatttcattctttttcatgtgaatatgcagttttcccaacaccatttaatgaagagactatcccttccccattgtgttcttggcatccttgttgaagatcagttaactctacatgcatgggtttatttctgggttctttaccccgttacatttatctatatatcttttttcatgccagtaccaaactattttgattattatagccttgtaatatattttgaaatcaggggtatgatacctccagccttttttcttcttggtcagaatcgttttgactatttgggttatttggtggttccatatgaattttaggagttttttctttctatttatgtaaaaaaaggcactgagattttgacaggatttgcaatgaatctgtagatcacttttagtagcatggacattttaaccatattaatttttccaatccatgaatatgggatgtcatattatttatttgtgtttaatttcttttgtcaatgttttatagtttttaatgttcaagtctttattctctttggttaagtttatttataagtattttatttcttttgatgccattgtaagaatgttttctttaatttctttttcagatagttcattgctagtgtatagcaatgcaacagatttttgtatgttgattttgtatcctgcaacactgttgaatttatttgttctaacagatttttgtgtttgtgtgtgtgtatgtgtggagcctttagtattttatctacataatatatcatcagcaaacagagattactttttctttctgatttagataccttttctttttcttgcctaattgctctggaccttacttccaatactgtcttgaatagaaatggtgagagtggacatcccttccttgttctggaacatagaaggaatacttacagctttttatcattgcatatggtattagctgtgggctattcacatatgatctctgttgtgttaattttctcctatacctagttgttcagtattttttatcatgaaagggtgttgaactttgccagatgtttttctgcatctattgatgataacataatttttatccttcattctgttaatgtagtgtatcacatttattgatttgtatatgttgaaccatccttgtatctcagagataaagcctacttgatcatggggtgtggtccttttaatgtgttgttgaacttggcttggtagaccaatggaacagaacagaggcctcagaaataataccacacgtctacaaccatctgatctttgacaaacctgacagaaacaagcaatgaggaaaggattccctatgtaataaatggtgttggggaaactggctagccatatgcagaaaactgaaactggaccccttccttacaccttatgcaaaaattaactcaagaaggattaaatatttaaagtaagacctataaccataaaatccctagaagaaaacctaggcaataccattcaggacataggcatgggcaacgagttcatgactaaaacaccaaaagcaattgcaacaaaagccaaaattgactaatgggatctaattaaaccaaagagcttctgcacagcaaaagaaactatcaccagagtgaacaggcagcctacagaatgggagaaaatttttgcaatctatccatctgacaaagggctaatatccagaatctacaaggaatttaaacaaatttacaagaaaaaatcaaacaaccccatcaaaaagtgggcaaaggatatgaacagacacttctcacagaagatgtttctgtggccaacaaaaatatgaaaaaaagctcatcatcactggtgattagagaaatgcaaatcaaaaccacaatgagacaccatctcacaccagttagaatgatgatcattaaaaagtcaggaaacaacagatgctggagaggatgtggagaaataggaatgcttttgcattgttggtgggagtgtaaattagttcaaccattgtgaaagacagtgtggcaattcctcaaggatctaaatctagaaataccatttgacctagcaatcccattactgggtatataacctcaaaagtataaatcatactactataaagacacatgcacacatgtgtttattgcagcattattcacaatagcaaaggcttggaaccaacccaaattcccattatgttagactggacaaagaagatgtggcacatatacaccatggaatattatgcagccataataaagaatgagttcatgccctttgcaggtacatggatgaagctggaaaccatcattcttagcaaactaacacaagaacagaaaaccaaacaccgcatgttctcactcataagtgggagttgaacaatgagaacatatgggcacagggaggggaacatcacacaccagggcctgtcatggggtgacgggtaaggtgaagaatagcgttaggagaaatacctaatacagatgacaggttgatggatgcagcaaactaccatggcacatgtatacctatgttacaaacctgcacattctgtacatgtatcccagaacttaaagtataataataaaaaaataaatttttgaatagtaatatatgtaatactctctaatgaatatattctcaacttcgttgccctgtctttacttcatcctctatccacagacaaaactctaatacagtatcaactaatttctaagctttttttgaacactctgctgtagaaaaacatacgaatatactgatcagtctcacttcagatgcatgctcaccaatctcatactgtttcagcttcttcattcctgtagttcagcaagtgggagggagtggcatccagtggcttttttgctcccgttgttcggtgagcaggaaggaatggtgtgcaatgacttttttgctcccattgttcagcaagtggaatgaagtgttacagctcttttgttcctaccatctgcagcttggtgaatgggagggttacaggtcttttgtttccaccacccacagcttagtgagttctgagttcttttctcgtgaccatgaggaataaggtacgtggacaccggagagtgagtaaggcagaaaataattttgttgagcaacagaaggaaagctctcaagctctcagtggagagagggaccctgaaagtgggtagccctctgtgaggctgagtctggggtttttatgggcttaaaatgggggcaggctggtacttgctaattggtccataggtggtcttggaaaaagcagcattcaattagttaaaaggcatcatacaccaggaaccaatcgagagagtgggtgggttggcgatagaagttctcactctggttgtggactctatccagaactggcagttcaatttttcaggctttaggctgtctttggcttgaaggttggctttcaccggggacctgtccctgtccacctaggaatttgtctgtctcctgtcactacaaatactatatttcctcagtctatttactttccctctttttaatgactattttagatcttttctctgcccgcacatttcccaacccctcatcctccattctctttctcagctgatggcctttctgattttattgagaaaatggaagcaatataaagggagcttccaaatgatcccgccaccacatgtccctccctgctctctgttcagtatgatctcctccctgcatgttgtgtatattcagtctttatgtttttttcacaagatctcatcaccttttacctacctcagggaatagttccaaattcctcctccctctcctctctttgcaatttttccttttctaataatttttttccaattggcataaaatgtgttatttccccaatctaaaactgaagttttcttatgtgtcttgatcatacttattcttcatgctaatttttcatttctctgtatttatcaataaagcaataaattatttgaattgatttatagtcaatcatgttgtaatttctttataccataatagagtagttcattaatgcagcataaaaatttattttcaagttatgtacatttatggataaactagagacatgttttaaattttaaagttttatatcctgtaccctacttagctaagaagttcagagcatatttcagcattaagttacatgtttaagtgccaggtaaattttccattcataaccaaacacaccatcatgatttttgaaattctgaggagaaatatatctcctagttaagtggaaaattgtgcagttggtttctggagtactttcattctaagcagctttaaaaggaaacattttgtgtagaagtctaaattttctttctttatagtagtgcacattcattcattggtattcttattagacacttgaattgattaatactcctactaattttgttctagatctcagctttgtatttttagcctgattgacattaggattgatcattaccatacacaagatacttcatactgatctagtattttcaactctattaaatataagaagagagaaaatcatgcttgaatgcctggccaagaatgtggttgggcatatttgtggcagatgctggagtccatatagacagaaaaatgtctgtaggtctggggcattacagcctttactcaggactgtccagggtctgaagtctcccagttcctacctccaaaagggcatttatttcctggcttattaatgcttagttgcagtcttgaaaaaagaaagatgcttgagcagacaaatttgtggaaatagttttgaagtgcttgcttttccttcgtgatatttttttcttcattctaaatagatattctctttctcaagactgcagccctactttttgttgtgggaagtcagggaccccaaatggagggaccggctgaagccatggcagaagaatatggattgtgaagatttaatggacatttattagttccccaaattaatacttttgtaatttcttatgcctgtctttactgcaatctctaaacataaattgtaaagatttcatggacacttatcacttccccagtcaatacccttgtgatttcctatgcttgtctttgctttaatctcttaatcctgtcagctgagaaggatgtgtatcatctcaggaccctgtaataattgcgttaactacacaaattgtacagcatgtgtgtttgagcaatatgaaatgtgggcaccctgaaaaaagaacagaataacagcaattgttcagggaatacgagagataaccttaaactctgaccgctagttagccgggcagaacagagccatatttctcttctttcaaaagcaaatgggagaaatatcactgaattctttttctcagcatggaaagtccctgagaaagagaatgcgcacctaggggtaggtctctgaactggccctcctggggcgtacctgtctcttatggttgagattgcagaggtgaaataaactccagtctcccatagcgctcccaggcttattaggaagaggaaattcccacctaataaattttggtcagactggttgatctcaccctgtctcctgataagatgttatcaatgacagtggtgcccaaaacttcattagcaattttaatttcgccttggtcctgtggtcctgtgatctcgccctgcctccacttgccttgtgatattctattacgctgttaagtacttgatgtctgtcacccacacctattcgtatactccctccccttttgaaactccctaataaaaacttgctggtttttgtggctcatggggcatcacggatcctaccaacgtgtgatgtctcccccagacacccagctttaaaatttctctcttttgtactctgtccctttatttctcaagccagccgacgcttaggaaaatagaaaagaacctaagtgattatcggggcaggtcccctgataacttttgaatctcactcagctgcatttgtccaaggtgatcactactcagtcttttaaacattgtatttacttgatgtctatagcactaaattctgggtttctttttctctcctgagtagccatttctcagtctcctttgccagtttctcttcaggctctgattatttaacattggtctgcctcagggctaatctcttggacctcttgtctatctacgaagacaatttcctgccttcctggctttcaatcctatgtaatttctgataacttacaaattgttatctactacgcatgctcctgagcttgacttaacatctggctattcaataaatttctctaacttaatatctttaaaattaagctcctaattatttccccaagttccatcgcagtcaaacctattctccatttaagttaatggtgatttttgcttggtcttaggaaaaaattaaaaaaaaaaataaaactttgcctttctttcttaaaaaggctgcattcttttatagctaatcctgtttgctgtaccttcaaaatacattccctgtatttgaccacttcctgtggccttcactgctgttaccctggcctccattacctccttgcctgtattactggcacaggctttacgagaatcacagttaaggcttgcttttgctttgaggtttctgtacttgtcctctctgcctggaatatttttttctggtaaactccatggcttattctcttactagctcaattctctaaatgtttcttctgaaagctggaagcatactcctacctaacagtatctccctcctcttcactggtttattcttctccaaaagactgatgttcattcagtagagtattacttgcaagaggacagaaatttttatttttttattgtatctctagggcctagaacactggcacattgaattttcctctgcaattttttggcagtcagatgaaaattggaactatgacctactgcataattctcattatcagatataaggatacctataaattcttatacaaaatattgccttacactaaattatacaataaatatataggttgaatcttataaagtatacaagtaagcatacgaataatgccttaatagttttaaaaataaattcagttaatgtaatttaatctgtatgttctatattaataatttttaatggttaagggtataatatgaaaggtatgtatccaaaagacagaagtaatctatatttatttaaaataattggaaataatttttataaaagtagcagtttaatgttattagcaatacatcaccttcatgtaatatgcatagccactcatgacttatgacatttaaatgtttcaccttggttccagcattatgtatggacaaaattaaaaatatcttttcccagaattccttgtatcattgtgaataaaggtcatatctgtaaaatgatgtttatcatagaatcattttaaaattactaaaagtagaagtgaacacaatggaaaaacaaataaatacattatatgagaaatattatttagctatcaaacttcatgttttcaaagaattttgagtttgtgaaagttacaaagttttatgaaaatgtctatctttacagctacagaattctaactggaataaaatgcaccaaaatgttaactgtatttccttctagttataaaattatagataatttttattttattcacttacttttgtatagtttccagaatgtctataatgttttaactttgtaatagcatcagaaataataaataaaatttttaaggaattagtacttcttccataactatgttttgctttttgttgattgaggacaaagatttgtattttgttatacttaaatataccactagtatttaacaataatcatttttaatatcagtgtacaatatattgtaacctaaattttgctttttagacagtttttaaagtacatatcaggattgtactttttttcctccctacagacagccttttgattgattatcaatttaccttcagcttattacaggaagatgatcgccaccatactgccataaactttatagcaaacccagaacaggtgaggaaaaattgttatcttttaaagtataattattggacacaatttttttttcatatttcatttgattttacctcttctcagaattatcacattgtagggcctttgtagaaactactaatcctattaattttttctctcttcgtgattcaataatttgtgaatttgatatttcagattttgcaaatagccctatattttaaattaaatataatttgtcaccttatatatcttgtgacaaaatttatgcctataattatacaagcacggactgttcttatttaaaaataaaactcgttcgggcgcagtggctcatgcctgtaatcccagcactttgggaggccaaggcgggcagatcatgatgcccagagatcgagaccatcctggccaatgtggtgaatccccatctctactaaaaatacaaaaattagctaggcatgatggtgcgcgcctatagtcccagctactgaggaggctgaggcaggagatttgcttgaacccaggaggtggaggttgcagtgagccgagatcacgccactgcactccagcctggcgacagagtgagactccatctcaaaaaataaataaataaataaaactaatgaattcaaagcatactatattaaatgtattttactttcctttataccattccacagtaatatgatttgtcttttttctcagtcagtagtttatctgagttatatgaatgatggctcctttaatgaaattaccacatcactgatatattgtataagcttttgaagtttaaatatatgaaagattcattgtgaattttaatttcaatccatcaattcaggtaaagactcttaggttgtgtcgaaataacacacatattttgctatccatctgagactttattaatttgaaaatcctgagaatggaaatatcaaccatagggtttattcgggttgaattttagttcttttaaaactaacactcatacatttgaaatgaagttatgttaaatatatatattattattatgaattcatccatattgttaaatgatatgttaaatccatatcatatatttaatggtttttcaagtaggtgaaatgtctaaatatattaatactatgacattttgcaacttctttccttttaacgtagttcactggacttgctgacaactaatataatttcttaaatttttcttttccagtaaaatagcattctgtctcccccatcaccaaaaaaaagaacagttcattttacattttatgttactctttattccctagactttatgaatgactgtattcttggggaatacatttaaagttttgacttttaaataatgattttaaagatattttgtttcaaatacaagccgtccttcactgattatctgtttctacatagatatattaacaatctcagaaactacatttatcaatgtgataaagtttttatacctgcattataattaccattgactttttattgtagtaaaatagacataaaataacatttatttaaataattttaggtatgtaattcaatggcattaagtatatttacagtgtggtgcaatcatcaccatcatccacattttcattatccctaacagaaactctgtgattattaaacaataatgcctcattccacacttctctgcagcccctggtatctttattctactctctgcctgtattaattggcttactctaggtacctcatataaatgtaatcatttgtccttttttatctggcttatttcatttagcatagtgtttccaaggttcatccatgttgtagcatgtatcggaggtcattctttacctttagcttcttgattaatagtaattccaaacctgtggggttctttgaagatctaagaaatttgatgtaagagagatatctgactcaaaatgtgagagtgaataatattcctccacagtattgtccatagtgtcatatacttatgtccagattagccacaattctagtttgcttgtctttttgccattttctccttcaatttccagcaatcccaagtgctttccaatgtcccagctttgttttactttctactatcttgtccagttgaagccaagaaaccagaaaagtgttctgtgaagcttaacgatgcataactgtcatgagaggcatcgctaagaattcttataatatcattttgtgtaaccctctttaattaaagatatattcacctgggaataatctctgaaattattatgtattattggccaaggcttcttattctataagaaaataataataaaaagtagataattatttatacatttcctacattttgaaaaacagatttaattttaactcgctatccatcacttctagccagtgctttcatgtgaacaatttctgaataggtttctgtataacattattttgccaaacttatccatatctaacaaacaatgttctaaatcactgattttatcacttactggaataactacagtgtcactttttcagtacagctttttaaatcctaaatgctttttatatggctttagttatggtaccatataattcagcattgcctaaacttggaattgatagagaatgaactaaaaattcaaaaagagttttataggttttttaaatatcaattggaaattttgtgtgaccttttagcgacaacagttatgctcatattaatctcatccagcataaggtacatgtaattaagagacaatttcaaaagaaaataaagatttaagcctccttaagggtacgctgatttcaccatcctttactttcataaaaaagtgactttttggatccgtttcattaatagtaaaaaaatccactcctcagagcatgtcctttttttgagttcccagtcctctgggtgaagatgaagatgaagaaagagaagaaaaagaatataccctgtcactatacctaataacgataacactacaattataagcactatgggctgaaaccaaagttttttttccagaaattatttcatttaacgctcacaagagcttcttgagggaagtaattacatccccattttagagattagaaaaatgatttttggaaaggaaaagtaatttccccctaatcaatcagtctgtacattaaagacctgaaatttcaatctaaggttatctgactcttcactaattcttttcattgcttcatgaaaatgatttactgtatatgaaactgttattggattcaagtctggttactttattatgatgacataaatcaacatttgctaccagatatctacctttgatatctggattttccttaggactacattgtgtatatttggaagtatattttgtataccacaactgaacaacataatctattgaatagtccctgtctgcatgctgacataaaagtattctgcatttattgctacagtcaaagagttgctcagttatttttctggccttccattgaatttatgcccactctgtgttcacttatatcttaaaagaaataggaaaatctcaatatgtttgacagttttgtggcatgtactgcagaagggttcttaacagcttgtcaatagaattcagtattaattgataatcaatagaaaataagaaggaagttaacttccttcttatattcatgggcatttatgaatatcactatgatgcataatataatagccttctgatttactctatgtatttaaaatccaaggttttatttttctttgactacttcaaattctcagatgctttctccacaatattactatgtactactctaaaaatatgcatgacaatcactcaaccttattataacaaattttattttacatgctctttcaagatgatcattctttttgaaatcttatttgcctcctggaaactgtgacaatatcatttgatggatatggaacactgttaagagttcttcatagagaataagctgttcttccatgtagggaaatcattaagagtagatgttatttggaggtataagattggggcttatacgtctgtcaaatggtatggccatcacacatcatccagcagcctttgctttttatgatgttccttatttctcctgctattcatcagggaaaggccattttccttgtcagttttcccctaagactgttatatcagaaaaggggaatttagttgcttccatatttactttctcctaagagccacttagaaaattgggaatatattttctattggcttacctgctttatcatatttagaaaaatagtaaaacgaaggaattaatatattctctatctctcttactccgtttcactagctagatcttagcagtatagaattttctacaagtctttgtagagaatatttaaaataaagcataatacactcagtatctgaagctaaacttacccattatgactatcattctttgcctttccacaggaacaaatagttgtaaatatacctactttctgcttcttacgtcttggagtaagaaaatcacaaaaaacatttaaagaaatctcttagtcatatttccctgaaattaaatgtaaagagtctgtactccactaatgaatgacaagaagcgggttgaatggcataaaattaaattctcagtgttcctctctataactgtgtaaacaatgtgatctgctgtttttttggagtaggttcatcatttttacctgaaagttttaggttatgttatttttcccactagaaaatatgggtttaataataaaaatgtacacctaagaagaagtcttttaaaaaaataatcttatattgttataaaattgcttgggactaatccaaacctgtttcatttaaacctagcaaaaagaatcaaaatacaaatatcaaatttaaactaagtttagtctacagctaagcaaagagaatccaaataaaaatattaaattacaggagcctctggcttacatacaaaagaccaaattataatagagaagataaatgaggaacttgatatctacctttgaatttattacacattttcttcattaaaatgtataaatggcatctacatatattcagttgaatatttacaaaatctatagagtttaaggaataaaacagacataattaaatcagtagactaaatcatatatatctagtgtaattttcgttttttaaccttaatattttcttttctggtagtcgaacaaaaatctggatatatcaattaatgcatcaaacaactttaatctcaacattacgtggtctgtcggttcaacaggtaaaaaaatgttgatgtcatatctcttttacatgtgttcctatctggaagttgttctaacatgatctactgttaattaaatgtttgaaattttaaaaatgttatatgacaggattattttgctgttactggtaaaaataataagtagaaaaatgaatagagcttcattattttgttaactttctcctttattcaattaaaattagattggtaacaaatattatacactaaattaaatttttaagtggcagtgttataaaatgtgattttaattaagataaattgcttctttaatgactaaagagactgaaatttcaattatttgattcactattaaaactataaatttaattattaaccttaatatttatataaaacaatgaaattcttctgtacatgctgattacagtaaacatctattattgtcaagcttagaaaatataacccctcttgtcagcttcagtgctcagaggagttaaaaaactgatacataatatgtctttcataataaggttaataaatttaaattactgacttaaaaagtatatctgagaagctgttcagatttttatgttgaattatgaaatgtattcttactttaattttagttttacttttattctaaaaattttattggtatctattttctgtatcaaaggtatactgttgcataaatgtgctggaaattgtttcttttttatagaaaatttatggattcttagaaatttatatttgatttctgaaaattaaatcattatgctattttaatatgtagaatattatggatacatagaattcaagaattaagagctcttttgcaattcccaaatttatatattacattcaaaaaatgaaaattcaggcaaataggcattttgttactattagtgccaaacatacagtaaaatgttggcactatgggtttcattaaggaaaaattcgtaataacttgtactgttaatttgatagttatttctgaccagtaagaaaactgtaagggtttaaaaatgtgtctacaaaaatgtctataatacatttctaatcactttagaacaataattttagtatgcaagacatcacgtgttctttcagattcccagaccaaatctcagaaatttttatttatcagatttggagatgaagtcatggaatctgcatttaataaatgtacacaaggtgattatggaataagtggttagttaaaaattcaattacgcagtatactaattctaattatttttactattgattaaggtgaaagtattgctaagattgttggaaatgctttgttctattttattaacttcagtaaatatttattcagcactctatgtgtttaaccaattgagcatttagctcatgttttaaattgtggcctccacccaatttatttaaagcagtgatggttcaatttgtggtaagacaaataaattgattttttcccattttttaattggattgagacacacgaaaatatggtctgatttctttttaaatgctctgtggcattgtaaacagaatgagctcagtttctagagccacatatacctgagttccaactgcttagtagctataaacttggggcaaatgctttaatctttctgaggcttaggttgaaatctgaaaaatggaggtgataatacttctgggatattattggttttaaaaaagaatataaagtctctaagctagtgcctagtacatagcacttaatcagtggtagcatttttaaaaataatttttatactaaatttatttccattatatttatggcaaacttattttccttcattcaaaattataaacagtatattttgataattatttttataagagcaattataaaaaactataatatgcatttttaaattcataaagatatttcctaatattaattatttaaattatttacattttagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacaggtaagtgttaagagtatttacttctaatgaccataatatcattaagaaaagaatggtgcttttgtccaaagtgatgatatatgtacatttcctgacttgactaatacaaaaacatgcattgacctttgataaataaaggtctgcgaatgtctgtgatgatgaatttctctgtaaaaaccctcatggaaccaacaaactctatacttaaatttttcagtgattattatgtactaagcaatgtagccaactgaaatgttttggttttctgattaattatatactttaactgagggttaaataaatactgttctcatataaccccacttgaaattattttccgtttgagtagtcttatttttactttagcacattctgaaaataatctgatctttcattaaagattttgagttagcagtatttcagttacctctttaagtaattacctctcatcattaatttcctaatctgtactacatgtgtgttttacatttcatttttgttatagttagaggtagtctacttaagacgtcagatttacttctaggaaagaattggaatattctttctatcttatagtcaaggtttgtgttcttaatttatgttttcctgaaagaaaagcctatctattgggatgctgggatttgttcattcctttacaactgattgattagattgaatttacattagttattcgaatagcttatatatatcaatccttgttcatggcttttatgttttaaaatcttttaaagattttcagatcatcccttccctatatattagtaaattatagcatatgctctgtaactagaaatgtttgcaggttttatttatattaatttctatgtgatttgtggaaagaatgagtgatttttaaaatcatatgtttactggaaaaaatttttcttcttatttttaaggttgatgtaacacttaaattatggaaattattcaactgttcaggaaatatgaggataaattactattcagttcacttttgagaattaatttgagaaatttacttcttcattgtatagtgattgatttagatgctggtactgtcagaaaaatgccataaatatttgtttttaaaattttaacattaaggatgtgtaactttatttcctaagattcatagagaaatatttatcaaatttcacttcatttattcaattatgattgaaagggaaaagggttcatctatagcacttagtaattagttattaaaattgatatgattatattttaaattgcttcctatccttatttcttgtttatatacttttgaaaaaaaattacatagttattttagaatgtttttgaatacttaatggttaggaattaactttctaaattgggtttttttgagaacttactcttttggaagcaaaatcaaaatttgtgtaacgaggttgaaatactccactctcaaaataatacagtgtggaaaataattgagatggacaagatacgtaggcctaatttctcctctttattaaactcattatgcctatggaatatgttatattaaagcatggaagtattaatatatgtgtttatttataagactagaataaactttaaattataatattatacaaaacacagtaaaattattttaattatgattttaaatactggcagccatcattgtattccctttcaataagttcataagttttttagattccacctataagtgatatcatgcaatatttgtctttttgtgactgacttgtttatttagcatcatgtccttcagtttcttctatgttgtcacaaatagcaagatttcctgctttttaaaggcttaataatattccattgttatgtgtgtgtatgtacgtatataaatatatacatattatgaatatgaaacatatagatataaatcacgatttctttatgctttcatctatccatggacacagcttgcttctgtatcttggctattggaaataacgttgtaaagaatgtgagagtgcagctgtatctctgagatactgatttcacttgctttgaatatatccccagtggtgggattgctggatcattggtagttttatttttaatttttgggggaatcttcatacggctttacatgatggctataccagtttacattccaccaattgtgtgtaagaatttcccttgctccacatccattctaacacttgttatcttttgtatttttgataatggccatcataacagctatgaggtgatatcttattgtggttttgatttgcatttatttgatgattagcaatgctgagcaccatttcatatacctattggtcatttgtgtgtcttctgtggagaaatgtataatcaggtcctttgcccattgtttccattgagtttttgttttcttgctattgcgtttcatgagttccttacatattttggatattaacttcttattgaatagatcatttgcaaatttattttctattctgtaggttgccttttcagtttgttgattgtttcctttgctgtgccaggaagctttttttagtttgatgcagtcccacttgtttatttttgcttttgttgcctgaacttttggtattatatccaaaaaaatcattgataaagccaatgtcaaggagcttagtccctttattctgtttaggatttttataattacaggtcttatatttacatctttaatccattttgagttgatttttgtgtatggtataaagtaagaatccaatttcatcttctgcatattgatatcccagtgttaccaataccatttattgaagagactgtgtttcctttactatttattcctggcactgagtcaaagatcagttgacgctgtctatgggtttatttctagcctctctattctgctccattggtattagtgtatttttatgccagcaacttcctgttttgattactatagattcataatatagtttgaaatcagtaagtatgatgcctccagctttgttcttcttttataaaatttctttgactatttgcagtcttttgtggttccttttgaatttaaaaatttttttttctatatctgtgaaaaatgtaattggaattttgaaagcaattgtattgactctgtagaacactttgggtagtgtggccatttaaacaatgttaattcttccaatcaatgaacataggatattttccatttattattgatgttttgaatttctttcatcaatgctttataattttcagtgtacaggcctttcatttccttggttaaacttattcttaagtattttattctttttgatgctccagtaaatatgatttgtttacttaacttctgatttggagagttcattgttaatgtatagaattcaactgatttttgtatgttggttttgtatcctgcaacttgactgagttttttattctttttaacagtttattggtggactgtctagggtttcttgtgtatgagaacatgtcatctgcaaacagagacaggttttcttcttcttttccaatttggatgccttttacttttccttgtctaattgctttttctaggactaccagtcctatgttgaatagaagtagtgaaactgggcatttttgtttctttgctaaaattagaggaaaaaccttctgcatcttgccattgtgtaggatgttagctattggcttgttgtatgtgttctttattgtgttgaggtacattccgcttaaacctaatttgttggaagtttttatcatgaaacagtgttaataaactttgtcaaatgctttttcagcatctattgagatgatcatataatttttgtccttcattctgttaatgtggtatatcacattttgattcatgtatgttgaaccatccatgcattcctgggataaatcccacttgatcatgttttatgatacttataatgtgctgttgaatcaaatgtggttggctagcattttgttgaggatatttgcatttacatttatcaaggatgttggcctgtaatttttcttttttttccttatgttccctatggtaagctgtggtacaatagtattcatttttatttatttgttttccctcttactgttgctattatatttattttttaaagaacagaatacagcattattaactatagtcaccatgttgtacaatagaaattttcaacttagtccatctatttaactaaaattttgtgtccttttaccaatgtctctgaaatgccattgattttcttttcttgtagtctccttgcctgacttgggtgtcagggaaatgcttgccttacagcataagttcggaagtgttcactctacttcatctttttggaagagtttgagatggcttggtgttaatgctttaaatgtttgttagaattcaccagtgaagtcatcgattcctgagcttttctttgttggaaagctttttataattgattcaatcaccttagttatttttgatgtgaccaagttttctattttcacatgattcagtcttggaaagatgtatttttctaggaatttattcattcttttctaagttatttaatttgttggcatacaattccccacagtcatttcttatgaccttttggtatctatgatgtcagttgtaatgtctccttatacatttataatttgtttaagtcatgtctcttttttcttggttagtcctgtgcaaggtttgtcaatttttaaaattgttttaaaaaccaactgtttatcttttctattgtttttctattctgtatttcatttatttccaccatgatctttattatttccttccatctgctaactttgggcttcacagtttaacaattctattgccatttattgtaaggtagacctagtagtcatgaagttcttcagcttttgtttgtcagcttttatgtctccttcatttctgaagggcaacattgccaggtaaggtattcttggttggtagtacttttcttttagcactttaaatatatcatctcactcctcacctgtgaggtttctgctgagaaatctgttgatatccttagaagtattctcttatatgtgatgggtcacttttatcttcttctgcaattttctttttgagtttttacgattggattatgatgtgtcctagtgaagtcctttttagattgaatctgtttggtgatgttcagcttcatggatctagacatctgaatctctcataagatttgggaagttttgagccattattttcaagttaatagatgcctcgagtttagggactgttgtgggtgaaatagagcagggatggaagggagatatagaggtttttaaagagtatcaccagggatcttggtggtgttaggactcttcactgtcttgagtctggtggtggatgaatacatttttaaagcatccactaagtaaaatcaagtgttatataaacacaaagtaattatggatagttttcagcaaattttgacaaacaatgaaatttaaatttggtgatacaaacaagaatttctaaaatagccctttttgaataattacaaagtaaacagttcttcaataccctgctatcaaagtatggactgactaaccaaaggcattgacatcacccaggagcgtgtcagaaatgtagaattttagccctgtcgccactgaatgagatcctgctttttacccaaatccccctaggtgataatgtgcacagatgcttgcaagccattgtctaatagaaaaacaacaccaccaaaatcactccatttccttaatttgggaattgtctatagtattttcagttatgtctgtgaagatatgaaattgtttggaatttgaggattggcttaaattatggttcacagcataactcaatgaaatatttagtgttctttttccacttgcatctagattagtagagatatgatgtttttaatgtttttttcattttaatgaattttggagatgattgaaattagttaatatcatagtgaataatccttgtcttgttaaactactattttaattatgcatgaaatgctgctatcatttatatgcattatgtaatgtattttgataattaggcagctaatatgtagcaaaacacctttatacctatcagtttgtcagttatgatgtcagtaatgatgttctagttgttatcaatggaagtaatccagtgtcaatggattgcttcttaatcgttatagtatttaattctctgtggcatatctcacttatttctccatttggaataactgtttcttcaatttctgttgcatttgtctttcccatatttgtggtttcaatcaagttattcattcctctgagcttcaattacccaatctataaaatgaagattactagtggtacttaattatagggttatcatgatgattatgtgagatagttatgtgaaacaaaaccttacctattgcattgtaataattgttctaaattgtaaatagatgatcatcattttctttttcttcatcatcaccgtcaacgtcattggtatttaagagagctttttaatcttcttatcatttacctcacctttttaaaacctttggtgatttcccataatatttaagataaatttattcctttatcttttacttatctatattaggttgattacttctactacaagtcatacaaaaattataactgctcatcataacaaagacaaaatatttagtttaattcactcttgttttacatctttctatgttgagagtttaaatcgttgattttagaacttttcttttttctgatatatactctacagctataaattaacctgtatgcagtgctttgaccacattttacacattttggtatgttgtattttcatttttatttagtccaaaatatttcctgatttttcctgtgatattttctttgatgcataagttattccaaaatgttatttaattcatttcagggatatttcaggtgtctcctttttattaatttccaatttagttttcgctatggtcagagaaaaactatggttttaatcctttttaactttattaaggcttgtttttggcatattttttattttgcagaaaattcatgtgcttaaaaagcaaagtgccttctgctcttgttattcttttaatgtcagttggatatttatttgattcttattcaatgtctgagattattgctgattttctttctactttttctatcaattactgagaatattttggaaatttccagctatttttggtgttgtgtttctttttttaatattgtcagattttcttcttgttttttgaaattgtagtttttgtacatatacatttacataaaaggtccctttactgacccttttatttttatgaaatgttcttttttgtctttattaaatctgcatgccaaactactttcagctctccaaatatctatcctctgtcatttatttcattttgctgcttatttttacattctgtatttttatcttgcaaatgacctttctggccttaaccttttttttaactcttgcttagcttttgtctaattgtgaatataacctccccttatacctaactactagaaattactcttttcttacaactggcatattctttaacttatcacagtttatttatatttattgcttcacttatttatccattattagccctcaaactcctttacagagaaactacatatttttttgtatttttagtacttagctgaggtagctaaaggaatagtttttaaattgagagatgagtaatatatttctctggagaaaggaatgtacagataaaatatgctttcttatactcttaaaaaagttttaacatgcaatatagatagtttatgagtacaataaaagatttctcccttatatttacaaaaatcacatgggtttcttatttaataataacccaaattctttcttctcccaaaatgaaattttatagtaagttgttttgttaattaagattttgtgtaagaaacagaaatcgtgcatgactaacaaacagaagaaaatgtattgttagcataaggtgttgctaacaatatgaaagggaagaataaatcatcaggttttcaataagcagaaagctttcattccaacagttttcagtcatgtgcattagttgacattcttaactgggcatgcctgctatactgaatgaaatctcatgatttctccaacccatcctataaatattcactcaggatctaaaaatcttaagtgaatgagtccaactggcaaatttaggacacctgtctaacttcctcctgacccataatggtgcaagaaaaaaaattgtcctgggaagtagttttttggcttctctgctcgaagatatgggacttggattcacaaccccaataaggaaaaaaatatctgaagaaataattctttgtttggtcaggagatatttggtgatcaaaagtcaacaaatactcgttatcatggataaccttgatagaagcatattaatatctaataagactatccttctgaaatcagcatttccttattctaggaaaataatatgactataaaataatgtaattgttattaaagaaggcttcagttattgtgattcttaaaaatatttaattaatctgctgcaaagtgaattatatgtaacattttcatcaatgccaattctaatgtagatattcttatcttgcttccaggttacaattgcttgctttctcattgtcagtaagcagtaggtattaagaacacgggttctaagtcaaactactacctcaatttgaaattcttaaattacaagtgataggattgagaggaaggttttttgtttgttttttaagtcacagtctttccatttcttcctctgtcaaatgggagatgataatattgcctacctttattagtttttcttgctgtgtagcaaattatcacaagcttatcaggttaaaacaaggaccgtttattattttatactgtctgttggtcaggaatctgggcatgagttaactgccctttgttaaaccctgtactcagggcttcacaaggctgaagttatggtctgttgagctgccgtctcatctgaggcagaaggacttcttccaaggtcactagttgttggcagagttcagtatattgaagttgtaggtcttaggtttttctagttactgttagccaggggctcttcttagcctctagaagatggccgctgttccctgccacatggccctctctacaacatgacactgtgcttcttttaggccagttatacaatctcttttcctttaaatctctttcttcagtctgttataatggagactgataaaattcaataatcataggagtgactattctaccacctttggcatataatgtaacgtaatcaagggagtgaattttccattgtattcacagattccacctatacttaagggaaaggctttaacatatattgtattaaaatattagaaatgtgtatatgtttatcttttgaattagggtaaaaaaatggaaagttatttaaagtatatgaaaatagagtaaagatattgactgaaataatagtattatagttttgtcaaaatagttctttttatatcaaatatattttattacaatttatgttatcaaatatgttttcactcctactatctcctgtcctttcttctgtaaacccattagattttaattttacttttattaatttattctgtaaaacatttttatgtgaattacatgccaatcaagcaattattatggtataaagacttcatgtgggtaaagacagtgataataactgtttatttaaaaggcaggttttatcttttcagtctactagcatcattgttggcaaaattcactggttctattttcctttataattataaagatgtttgaggaatagatatctttgttaaggatttttggtatttacttgttaatactgtaccaaatttttgataactaattagaagttttttcttttactgttcctaaattatatgtgttgtaaaagtttcttgtagtaccatagtcttatatctatgaatggaattctagaaatcgagaaatgttttaaaatgtcaaatgcacaatatacttactagagtaggaaattttaagttggtggctatttgtacagaattaatcagacattaatttagccattgagatcctctgccatttaaacatattatttgattaatttatgtactttggaaagctgttttaatctaatgtaaatcaaacaaaagttttcttcattgtcttcaaactttaatagggtgttttatgttttaggttgccaatctctttagcatttaaatatccttaagatcctttagaaattctagtgactgtgagacatatagcagtgttatgtgataaatattccaataatatagtaattaaacagggaaaaaatctttttgttttgaaatgctgggaatcatgccattgagttcatttgcatgtttgtaatatgagattttattttggtagcacttgttcttcatgatttataatgtcatgcaattaaatcttgataataaaaaatagaaaaaagtactactgtagcggtagtgctaataacttcaaaaaaagtgtattgaacttaagtactttgtattctacaatagtgctgttcatcaacatttatatatcacagtttaaattaaattagattgactctcaattacctgtttctgagcaaactggctttgacaattcactattatatcaatctgcaaagtgatgtcataatttagattagattttttaatgagaatgatgctaggaattattcttcactttgcaattctaatttccattctatactggttaatttccttactagcattggttaagttatacagaacaaaatagaagaagaagtgaatcctagtgctgatgtctatacaattttatcacaaataaattagcattttcaacatagatgagtcatttgaacacacacacacacacacacacacacacaaaacagaaaactactggttaagtagatattaaagaggatgttttaacttatacatatgatttgaaaagtggctatcataaaaatgtgctgatggagttgcccttgtatatatatattttttaaattgacacagaacacttttcgttatttgtggttcttgtcttttaaattgttatatgcttgaagaagttatcatatatattttcaaatacacttttttcttttttaaaaaagtttcaattctttttgtcatttaaccaaccaaggtaacataaattcaaaaggtagtattagaaattgttaattttatcagttaaagatgtattaactatactaattagaaatataaatgtgaatgatataacaaatatgtaagaaacacatatagaggagaatggaagattttctaatagctataaaataatactggctatgataggtacaaatgttctcaaaattctcacaaggaagatatattacatttacactacattgacagaattgagtagtgaaaccagagaccatattgcccacaaagctgaaaatatttactgtctggttctttacagaaaaagttcgttgactttttatgcaaaatgctcttatctaatcccttatccagagctattctttacaaggaataaaattgtttgaattaggtgagatggtataaatgtaaaatctgcttttctaagaaaatttcttatgacaaacattttcaacttttccagtggtaaaataaatttgagtaaagaagatttttcatttctttatattataaatttttataaagtcattaattatattttgaaatctaatgaaactcttctaaaaattttaatgcggttttgttaaatattcataataatcccatagatatttttagatggttgcccttgtaatatagtattcttttataaactaccctggtttttatataacatattgtaaacaattttagttttaatataatattaattaatgtttttaatactataagaattttttcagatcatatacttccatagtctgttactggaaatttggagttatttttgttttaaaaaagagcaaggtgatgaatatctttgtgtgcattcatcttctattttagaaaattatttcttttgcacatatgtccccaaattaaattattgggttaaagtatataaacaaatttatgattgtatattatgcactaggcattattcaaggtattgtatatgatttagtgctgttattcctaacttataaaatatttttatctaaatttttataaatgaacaaaataacttgttgaatttcatacagtaggcaattgaattgagatatgagactggtcaatttgacaccagatcccattctaccactattaactcacacttctttattttactatcattttattagtattaatattaaggctgaacatttttctatttataaaatatttactgagaagaatttataaacaaacatatttataatcttatatttatatctcaggacagcttcctgaggatattttgttttagctctagacacgcttccattttaaacctaaactggaagtgtgtaaaagttagtcatttgaaaaaaatataactatacttgatttgtttgcaattacaattaagtattacctcttggggtttgttaagaacttctacttcagaaattgtttaaaaaatgacttaatttttggcaaaggtattaaagtatgagtactatattttgggtttgatttgtgagctactgatacctttaagaattcatcaatatccataatctcagaaggcagtatatttacaataatggatcaaatgaaatattaatatataatgacttagcatagcaaatatttcagaatctctcaatagataataaaggtatatgtgacttaagattatacttctacttggactcgtgtttcatattgttatataatgttactagaatcactaaataaatattgaattaatgcagaatagaggattacagcaattctttaaatattgccttacaaatgaatattcagcacgcagtgggttctatgtgtaaatctgtaggttgaaatttagaatttttactaatgtctttatttttgtaattgctctacaagagttgcttattcaaatggcaaagtaaacacttatgtaagataatgtaaattgtggtagtttcaaaatttccatgttcttttaacttttatgtaatttgacgagaataaaaatgcttcttttattaatatatttataatactgaatcatatgtttctccttattttgtactttgatgattggataaacaaatataataatttttaattaattatgtagtaatgaatttcttcattaataagcatttattgagttattcactttgagtagtctaataaattacagtaaaaacacatataaaaatagaattaataaagtttgaatcagtcccaagaattagagctttatttaagaatcattatttgttgcttcatataggaagctcagagaattgtaaagtagaatccaaaatttatacaaaagcggactttattctgtactgaatgttgttagtaactaaaatttaggcataaaagaagttagaggtgaaggtcttaaatattctttgttttagcatatacctagatattgaataattcgtttacatattctttgcttaggttcccagttctgtactaaccgtaaggtaagaaagagtaggggataatctgtttgctaatagaagagtatatattttatttgttaagtaaataaaatggtatgttttaacatttctggacagtttttgcttttcctaaaacattttggtcctatcaaattataaatgaaaattattatttgtaattattaatttaccaacccctgtgctaatggaaaaagaaacttattgcatgttgatctcctatggaaagacatctgctcttacaagtcagatatgaaattagttccatcatttatttcatatgccttcataaatcaacaatagtttatataatgaaagaagtcaccagaaacttgtattgcgtaaagaactgttctcaaactttcacgctgggaaaaaaattgtttagaaagagagggcatcttgactgaagctttaagcaaatttaggaaattataatgatgttgtctaataattactagagatatagcaaatatagattttcattgcttatattttatttaattctttcattccttcaactttcagcatacattttattggtcatttgtgcatatacaattttggcttattgccaaatatatttaatataatttgatgtaacaacaaaatataccacatgactatatgtacagacctaatttacaaattgtaactcagttatttctttagatttatcaattttattatacttaattttcataaaatctagatgttagaagaaatcgtgtaattatatgtatatgttgttttaattatttacacatggtactttaaagttaatgcaaatgtgattaaatgtgagtgttatgattccattttacttatgatttttaaagcattttatatgctaggtcaatgtttttgatagagtctacatgaaataaacttattgaaatattcattatttttgcacactctaagaaggaatcaatctcatatttgcccatgtttttagagtttgacatgcttttaggctaattgtttgtgagactgtaagaagcagagagagggccactactcaagtgaaatattcaggaagcatttgtaagaatttgtaagaatacagttgaataaacctacactaggtctctcaaaagcagagtgccttatactccctttcttgggataatggtaataattttgaaatgcaattgaagagactctgtttctgattatctttttttttttcagtaaatgtcaaatcttagatctttttcatatcttttaaaattctaaatctatatctcattgatattaggttatgaagtattctgcaaattaccaaatgctgttattaaatattatgttttttcattttgttttatcatattttgaataatcttccaattcactctctacttacagattatgctattttatattttaattttgagattttatctcaggtcttgtttgtgttcactcttttacagttaaaaaaaccaagaatcagtgtattaatatatatcaaatgcagtggcagaatatttaatttatcttaaataaattaaataggataaggtatcaagttacagtcttcatacttttattatatacagtatactttttaggactgtgtgtatttaaataagtcatacaatttttaagggtcatcttattttcccaatgagtgcttctttaacaccactcattgggcaaatgccttctttgaattcccatagcatcttagcttatatttattcttatagtatttgaacataaactctacacttaatatttgaatatataatatgtgaattgcctgtagttgtcttctgaggaatactacaaatttctctcagagttaaccatattttacagttcaaaaatctttccgtttttagactattcaaataatatgtttgttttagtgctttaaatttgctctatctatgctaattatgtgggggagactaagaagaaatgtaagatgtttattgacctaaagaatttaaattaggtaaaaatcaggagcatgcaatagggagaagattaattatgaaattgagagaaggagttggcaagaatcactatgtgagcgaaaatgagtgtaagctattaatgagccatcacttgatcatggtctgtttttttgtgtggtgttgctagtatttagtaggtgtgcattgatattaataagtgatattgataacttttttcctgtactgtctatgtcagatgtggcatttgtgttataatttcttcataaaaagaattaaaaagtgttccttcatttttattgttttataaaaatatatataacatttaaactacctggtctttgaaaccatagtagaatttccctatgaaacctctggtactggtattttttgtagagtaatttctttataacttcctctatttcatctacagaatcttttccatttaagctacttttttctaaatttatttatttctaattaacagataaaattgtatttataatgtaaacatgatgttttgaggtatatatacattttggaatggttaaatctagctaattaaaatatgcattacctcacatagttgtcatttctgtggtgcaaatgtttaacatccagtctctcaacattttttgagaatacaacatattatcattaaccttagtgaccattctatacaataaatctgttaagtgtattcttcctatgtgactaattttgtatcctttaaccagtgtccctccaaaccccctcctcaatcacccaacgtctttattttttttaagtttataaattattttattgtaagcattgctacaattatttgaatcttctagtgttacacattacaaatgaagatctttctttttttattatactttaatttctggggtacatgtgcagaatgtgcaggtttgttacataggtatacacgtgccatggtggtttgctgcacccatcaacctgttatctacattaggtatttctcgtaacgctatccctaccacagccccccaccccccaataggccctggtttgtgatccccgcccccactcctgtcaatgtgttctcactgttcaactcccacttatgagtgagaacatgcggtgcttggttttctgttcttgtgttgctttcctgagaatgatggtttccagcttcatccatgtccctgcaaaggacatgaactcatcattttttatggctgcatagtattcgatggtgtatatgtgccacattttctttgtccagtctatcattgatgagcatttgggttggttccaagtctttgctattgtgaacagtgccgcaataaacatctgtgtgcatgtgtctctataatagaatgatttataatcctttgggtatatacccagtaatgagattgctgggtcaaatagtatttctagttgcagttccttgaggaatcaccacactgtcttccacaatggttgaactaatttacactcccatcaacagtgtaaaaagtgtccctatttctccacatcctctccagcatctgtcgtttcctgactttttaatgatcaccattctaactgccatgagatggtatctcattgtggttttgatttgcatttctctaatcaccggtgatgatgagctttttttcatatttttgttggccacagaaatgtcttcttttgagaagtgtctgttcatatcctttgcccactttttgatggggttgtttttttcttgtaaatttgtttaaattccttgtagtctggatattagccctttgtcagatggatagagtgcaaaaattttctcccattctgtaggttgcctgttcactctgataatagtttcttttgctgtgcagaagctctttagtttagtttcccatttgtcagttttggcttttgttgcaattgctttttatgttttagtcatgagtctttgcccatgcctatgtcctgaatggtattgcccaggttttcttctagggtttttatggttttaggtcttacatttaagtctttaatctacctttagttaatttttgtataaggtgtaaggaagggatccagtttcagctttctgtatatggctagccagttttcccaataacatttattaaacagggaatccttcccccattgcttgttttttgtcaggtttgtcaaagatcagatggttgtagatgtgtggtattatttctgagtcttctgttctgttccattggtctatatatctgttttggtaccagtaccatgctgttttggtaccatagccttgtagtatagtttgaagtcaggttacgtgatgcctccaactctgttcgttttgcttaggactatctgggatatgcaggctcttttttagtcccatatgaaatttaaagtagtttttttttccagttctgtgaagaaagtcaatggtagattgatggggatagcattgactctataaattactttgagcagtatgtccattatcacaagactgattcttcctatcaatgaccatggaatgtttttccatttgtttgtgtcctgtcttatttccttcagcagtggtttgtagttctccttgaggaggtccttcacatcccttgtaagttgtattcctaggtattttattctctttgtagtaattgtgaatgggagttcattcatgatttgactgttattggtgtataggaatgcttatgttttttgcacattgattttgtattcggacactttgctgaagttgcttgtcagcttaaggagtttttggacggagatgatggggttttctaaatatacaatcatgtcctctgcaaacagagacaatttgacttcctcttttcctatttgaataccctttatttctttctcttgcctgattgccctggccagaacttccaatactatgttgaataggagtgatgagagagggcatccttgtcttgtggctgttttcaaagggattgcttccagtttttgcccattcagtatgatattggctgtgcatttgtcataaatagctcttattattttgagatatgtttcatcctagtttattgagagtttttagtatgaaaggctgttgaattttgttgaaggcctttcctgcatctattgagataatcgtgttttttgtcattggttctgtttatgcgatggactagtttattgatttgcgtatgttgaaccagtcttgcatctcagggatgaagctgacttgattgtggtggataagctttttgatgtgctgctggattcaatttgccggtattttactgaggatttttgcatcgatgttcatcagggatattggcctgaaatttttccttttgctgtgtctctaccaggttttggtgtcaggatgatgctggcctcttaaaatgagttagggaggattccttctttttctattgtttggaatagtttcagaaggaatggtaccagttcctcttggtacctctggtagaattcggctgtgaatccatctggtagtggactttttttggttggtacgctattaatcaatgcctcaatttcagaacttgttattggtctatttagggattcaacttattcctggtttaatcttgggagtgtgtatgtgtccaggaatttatccatttcttctagattttctagtttatttgcatagaagtgtttatagtattttctgatggaagtttgtatttctgtgggatcggtggtgatatcccctttatcattttttattgtatctatttgatccttctctcttttcttcttcttagtctggctggctagcggtctatgtattttgtggatcttttcaaaaaaccagctcctggattcatggattttttgaagggtttttcgtgtctctatctcctttagttctgccctgatcttagttatttcttgtcttctgctcactttttagtttgtttgttcttgcttctctagttcttttacttgtgatgttagggtgtcaattttagatctttcctgctttctgttgtgggcatttagtgctataaatatccctctacacactgctttaaatgtgtcccagagattctggtatgttgtgtctttgttctcattggtttcaaagaccatctttctttctatcttaattttgtcatttacccagtagtcattcaggagcaggtttttcagtttccatgtagttgtgtggttttgagtgagtttcttaatcttgagttctaatttgattgcactgtgtctgagagactgtttcttatgatttccgttcttttgcatttgctgaagagtattttacttacaatcatgtggtcaattttagaattaagtgcaatgtggtgctgagaagaatgtatattctgttgatttggggtggagagttctgtggatgtctattaggtccacttggtccagagctgagttcaaatcctggatatccttgttaattttctgtctccttgatctgtctaatattgacagtggggtgttaaagtctcccattattattgtgtgggagtctaagtctctttgtgggcctctaaggacttgctttatgaatctgggtgctcctgtattgggtgcatatatatttaggatagtcagctcttcttgttgaactgatccctttaccattatgtaatggccttctttgtctcttttgatctttgttggtttaaagtctgttttatcagagactagggttgcaacctctgccccttttttgctttccatttgcttggtaaatatttttccatccctttattttgagcctgtgtgtgtctttgcacatgagatgggtctcctgaatacagcacactgatgggtcttgactctatccaatttgccagtctgtgtcttttaattggggcatttagcccatttacagttaaggttaatattgttacatgtgaatttgatcttgtcattatgatgctagctggttattttgcctgttagttgatgcagtttcttcatagcattgatggtctttgcaatttggtatgtttttgcagtggccggtaccagtcattcctttccatgtttagtgcttccttcaggagctcttgtaaggcaggcctgttggtgacagtctctcagcatttgtttgcctgtaaaggattttattttctccttctcttttgaagcttagtttggctgtatatgaaattctgggttgaaaattcttttctttaagaatgttaaatattagcccccagtctcttctggctcgtagggtgtctgccaacatatccactgttagtctgatgggcttccctttgtgggtaacccgacctttctctctggctgcccttaacatttttttccttcatttgaacattggtgaatctgatgattatgtgtcttggggttcctcttctcgaggagtatctttgtggtgttctctgtatttcctgaatttgaatgttggcctgcattgctaggtcggggcagttctcctggataatatcctgaagaatttttcccagcatggttccattctccttgtcactttctgctataccaatcaaatgtagatttggtcttttctcataatcccttatttcttggaggctttgtttctttttactcttttttctctaatcttgtcttctggctttatttctttgagttgatcttcaatctctgatatcctttcttccccttgattgattcagctattgatagatgtgtatgcctcacgaagttcttgtgctgtgtttttcagctccatcaggtcatttatgtttttctctaaattggttattctagttagcaattcatctaaccttttttcaaggttcttatcttccttgcattgagttatgctcctccatgctcctttagcttggaggaattagttattacccaccttctaaagcctacttctgtcagtttgtcaaactcattctccatccagttttgttcccttgctggtgaggagttgtgatcctttggaggagaagaggtgttctgttttttggaattttcagcctttttgggctggtttctccccatcttcgtgtatttatctacctttggtctttgacgttggtgaccttcagatggggtctctgagtggacatcctttttgttgatgttgatactattcctttctgtttgttagtttttccttctaacagtcaggcccctctgctgcaggtctcctggaatttgctggatgtccactccagactctttttgcctggttatcaccagcggagccagcaaaacagcaaagattgctgcctgttcctttctcagcaagcttcgttccagaggggcacctgccaaatgccagccagagctctcctgtatgaggggtctgtcagcccctactgcaaggtgtctcccagtcatgatacactgggggtcagggacccacttgaggacccacttgaggccgtctgttccttatcagagcttgaacgctctgctgggagatctgctactctcttcagagctgtcaggcagtgatgtttaagtctgctgaagctgcccccacagctgccccttcctgcaggtgctctgtcccagggagatgggggttttatctttaagtccctgacttgggctgctgccttttttttttcagagatgtcctgcacagagtggaggaatctagagaggcagtctggccgcagtagccttgctgagctgcagtgggctcagctctgtttgaacttcccagtggctttgtttacactgtgagggcaaaatcacctactcaagcctcagcagtggtggacgccactccccccaccaagctggagcatcccagttcaacctcagactgctgtgctggcagcgagaatttcaagccagtggatcttagcttgctggggtctgtccgggtaggaccagctgagccagatcacttggctccctggcttcagccccctttccaggagagtgaatggttcttcctggctggcgttccaggtgccactgggatatgaaaaagaactcttgcagctagctcagtgtctgcccaaatggctgcccagttttgtgcttgaaacctagggccctggtggcatagacaccagagggaatctcctggtctgctggttgcgtagactgtgggaaacgcacagtatttggcctggagtgcgctgttcctcctgtctctcatggcttcccttggctaggggagggaaatcctctgacctcttggcttcccaggtaaggcgatgccctatcctgcttcagctcaccctctgtgggctgtacccactgcccaaccagtcccggtgagatgaacggtgtacttcagttggaaatacagacatcactcaccttctgtgtcaatctcgctgggagctgcagcctggagcagttcctatatggccatcttgctagcaaatcgtcaagctctttatttttaacaggatttctgaggtttttgtttagaagtctgcaaagtgatccctcattctattaacttgtattgtttcaatggttatttctttttttggaggtgggcattcgtccttgccttcttgatcattataactgacaatttacttacattgctaatgttttgaaaaattagagtttgatttaattaggtctctcattcttcatattcttgcatcattaatgcttactttcatctttgttatagtatttccttttttggctttctattagtttactttgaggttccttttatcatttctagagctttatatttcatttattttagatattttatgtgtatattttatatttatatttcatttactttatatattatatatattataattcatttcttttaattctttcatttttactaaagtgatttttttttttttttttgagatggggtctcactctgttgcctaggctggagtgtagtggcacaatcttggcccactgcaagctccgcctcccgggttcacaccattctcctgcctcagcctcctgagtatctgggactacaggcgcctgccaccatgccctgctaattttttatatttttagtagagacggggtttcaccatgttagccaggatagtctcagtctcctgaccttgtgatccacccgtctcagcctcccaaagtacagggattacaggcgtgagtcaccgcgcctggccttactaaagtattttttgatggaaatgttcattagcttcattttgtcattcatatgtatatgtaaaacaacatcactttgtactccataaatatatagaattataacttgacaatttacaataaaataaaaaataatctttttttttgctttgtgaaattgttatttatttcttatcaacttttattttagatttagtggtagacatgccagtttgctacatgggtaaactgtgttttgtggggatgtggtgtacagattatttcattgcccaggtaatgagcatagtacacaataggtagttttcaatcctcaccctcctcttactctccatcctcagataggcccttgtgtatattgttcccttcttcatgtctatgtgtactctatgtttagcaccttctcataagtgagaacatgcaatatttggttttctgctcctgcattatttcgcttaggatattgaccttcagctccattcatgttgctacagaggacatgattttgttctttttatggctgtatagtattctatagtgtatacgtaccactttttctttatccagcccaccactgatgaccatctaggtttattatgtgtcttttctattgtgaatactgctgtgataaacatacacatgcatgtttctttatggtagaacgatttatattcctttgggtacatacccaataatgggattgctgggttgaatggtagttctgtttaatgttctttgagaaattgccaaactgctttccacactggccaaacaaatttacatttccaccaacactgtataagttttctcttttctctgcaaccttactagcttctgttattatttgactttttaatagtagatattctgactagtgtgaaatggtattattgtagctttgatttgcaattctttaataattagtgatgtttagcatttttttcttatgcttcttggccacatgtatatcttcttttgaaatgtgtcagtttgtgttctttgcccacattttaatggggttatgttttttttggttgttaatttttaagttccttataaattctggttataaatccttagaccattgttggatgcatagtttgcaaatattttctcttattctataggctgcttaatatgctgatagtttcttttgttggaagctcttcagtttaatttttgtcaaaaattttgtcaatttttgtttttgttgcaattgcttttggcatcttcatcatgattttgtatcctgaaactttgctgatgttgtttatcagatctaggagcttttggtcagacactatgaggttttctacatatacaatcatataatttgtgaagagagatagtttgacttcctctcatcctgtttggatgcatttcattcctttctcttgcctgattgctgtggccaggacttccagtactgtgtcgaacaggagtggtgagagtaggcatccttgttttgtcccagttctccaggggaatgctgctattaatagcttttgcccattcagcatgacgttggctgtgggtttgtccttgatggctcttgttatttcaaggtatgttccttcaatgcctagtttgttgaaggtgttaacatgaaggaatgtttggtttaattgaaagctttttcttcatatattcagatgattatgtggtttttgtttttagctctgtttatgtgataaatcacatttattgatctaggtatgttgaaccaaccttgcatcccaaagataaagcctacttaattgtggtggattggatttttgatatgctgctcaattcactttgctagtatttttttgagaattcttgcatcaatgttcatcaaggatattagcctgaagtttccttttttcattgtgtctttgccagattttggtttcagaatgacactggccttgtagaatgagttagagaggagtccctccttctaaaattttggaatggtttcagtaggaatggtgccagctctttatacaaatgatatattttgtctgtgaatctgtctggtcttgggttttttctggtaggtagactttttatttctgattccattttggaactcattatttgtctgttcagcaatcaatttcttcctcgttcaatcttgggtcgttgtatgtttcaaggaatttatttcttctaggttttctagtttgtgtatatagaggtgttcatagtagtctctgtgggtgttttgtatttctgtgggaatggttgtagtgttatgtttgtcatttatgattgtatttatttggatcttttttctttagtagtatagctagtggtctatgagtcttatttatatttcaaagaatgaagtgggtttgttaattttttgtatgattttgtgtctcactatccttcagttgagttctgattttggttacttcttatcttctgctagctttgggttttgtatgcccttgtatatctagttcctctaggtgtgatgttaggttgttaatttgagatcattctaactttttgatgtggacgtttagcactaaaaactttcctcttaacactgctttaactgtgctccagagattctggtgttttgcatctttgttctcattaatttcaaagaattttctgatttctgacttaatatcattgattaccccgaagtcattcaggagtaggctgtttaacttccatgtgattttatagtttcgagtgatcttctaagtattgatttttatttttattgcactactgtctgagaatgcagttggtatgatttcagttttttttttttaatttgctgagaattgttttatggccagttgtgtggtcaatatcagagtatgtgctatttgcagatgagaagaatatattcttttgtttttgagtggagagttctgtagatgtatgttaggtccacttgatcaaatgtcgagttcaggttcggaatatttttgttagttttctgccttgatgatctgtctaatattgccattgggatgttgacatcacccactattattgtgtggttatgtacatctgtttatatgtctctaagaacttgttttatgaattgggtatttttgtgttgggtgcatatctatttaggatagttagttgttctttaattgtaaccactaccattgtataatacccatctttgtcttttttgatcattactggcttagtgtttgttttgtctgcaactataatagcaacccttgctgttttctgtttttcatttgctcggtaggtttttctccatccttttactttgagcctatgggtgtcattgcacgtaagatgggtcagcatgtaagctggttattatgcagacttgtttgtgcagtttctttatagtttcagttatctatgtacttaagtgtctttttgtggtggaaagtaatggtcttttttctccagatttagcactccttaaggatcttttataaggcaggtaatgaattccgttatttgcttgtgtgaaaagtatcttattttcccttcacttatgaagcttatgaaggaatatttggtttaattgaaagctttttctctatatattcagatgattatgtggtttttgtttttagctctgtttatgtgataaatcacatttattgctagatttttctccatccttttactttgagcctattggtgtgatgtgaggttgttaatttgagatcattctaacttttcgatgtggacgtttagcactataaactttcctcttaagtttggttggaaatgaagtttttgatttgagtttttattctttaaaattgctgagtatcagctcccagtctgttctggcttataaggcctctgctcaaaggtccactgttagcctgatggggttccctttgtagatgacctgccccttctctctagctccatttaacattttttctttcatttctaccttggagaatatgttgactatagtcttagggatggtcttcttgtgaggtatctcttggggttccctgcatttcctgaagttgaatgtggcctctctagcaaggctaggggagaaagttgctggctttctctccctgtctttcagcgacaccagtgagttgtagatttggtttctttacataatcccatatttctcagaggatttgttcatttttttaattctttaaaaaacattttttttctgattgagtttgtttggagaaccagtctaaaagctctaagatgtgttcctcagcgtggtccattctactgtgaatacttgtgcttgcattatgaaatttttgtagtgtgttttgcaactctatcagatcagtttggttctttcttataacggccattttatctatcggctcctgcattattttattgaaatccgtaaattctatggatgggtttcatctttctcctgaatctcctgaatctttatgatcttcataggggatctaagtgcagagtgcaaaaagcctgtggcagatatgtgagtccatggggactatcactcacttatcatttccccatggtggaggacatcccttggctcaatgccacttttgggcgggcaatagttctgtctcactcttttctgttctccatgggtcacattttttccttgatgaatcccaatgtgttcacctagatgttctagttgaagggctagtgttgctcaccactctcttctctccatgaaagtggtgcacactaattggttctaatcagccatcttgtaaagtctcagtgtaagttaagtttactcttttttttcttttttttttgagatggagtcttgctctgttgccatgctggagtgcagtggcgcaatctcggctcaccgcaacctctgactccctggctcaagcaattctcctgcttcagcctcccgagtagctgtgattaggggcatgtgccaccatgtccagctaatttttgtatttttagtagagacggggtttcgccatgttgtccaggatggtgtcgatctcctgacctcatgatccacccgcctaggcctcccgcagtgctgagattacaggcgtgaggcattacacctggcctactgcactttttaaaaatcatcaaagcatgaaattatctatgagtgagtgaaaactcattagaaagagtcttctcaaagaataaattactttatgccattaaattgataccaaatctgaatttgactagtgctcagcaacatcttatttcccacattagatttaatttaaatatagtaattacccatgacttaagaaaataatattttaaataccatagtaaaatatatgtccgatatttattttctttgcctattattattattttgcctaatatactctggtataaaaggccttccaaataccacagggtagaaaagatttttaaagttacaaataaattcctataaactatatatggcattacatgattttcaactttgtttttagctatattggataatcataagatttcattttttaaaaaattgaaaagccatgatctctcaacttgggttttaaaatttatcatgttttgattataatgagtcttaagctctatgatgccatttttttatgtagttaattaatggaaacctatgcttatcagggaaagacatcagcaattgtggggtacctaataaatcacctttgtaagatttttcttctggaaagcacctcactgttactacattctgtttcattagtctaacagtgaaaacagaatagcaactatctcttaaaaattagatactttctatatataagtatatactttaatatacaaaatataaatatggatatcaatattttaaaattttagtcgttttgtttccttaactattaatgtatttttataatgcaaatgttttattactcatttaataggaatatatatgcattaaaaaattaatgttttgggtagtagaacatgctttactcttagactgttggaaatacttgctactttcagcttttagacataacccaaatttctaaagttttaaagataagactgaatgataaagtcaatttagtgcatttcctttacaaaatgagtacctttggttacttaacacagtatgcagaaaaagataggttatgaaaaaattataatttctataaaatggtgttaaaagcaaaaattgctattatgaatctttgatttgtgaattgaaatctgagaatcttcaagaaatctcataaatatgcaaatactataattaaatacaggtatcattataattactaatttttatcttgtcattttaaaggttccgttttgttttctaacatttataacaatatttttttgacaaaaataggttttaacttcaagaaattatactcttcaagaaactaactgaagagattgggctcaattttaatgtagatataaaattctacatattttaactggtataatctttgtgaaaaagtaatgcttgttttctagtacagcttgacctttagctaaaatgaaactattttaagagtttttactttgaacattgagtgtgtgaacaccgaaaagatgagacaggtgtcagttaatttagaaagcttatttgccaaggttgaggacatgcacctgtgacacagcctcagaaggttttgatgacatgtgcccaaggtggttagagcacagtctggttttatacattttagggagacataagacattaacatatgtaagatgaacattgattcagtctggaaaggcaggacagctggaagcaaagatgggaagacttgaaggagggagagggttctaggttataggcagataagagacaaatagttgcattcatttgagtttctgattaacctctccaaaggaggcaatcagatatgcatttatcttagtgagccgagggatgacgttgaatgaactgggaggctggttggccctaagcagttcccagcttgatttttccctgtagcttagtgatttggaggcatcaaggtttattttcctttcacgtttactcctttttccttttaatcatcttttggagaaagcatttcagaagaaaataagtttctggtctcaggttttgtctgatcttttatggctaggatgctttattcctagacaggtaggtcccaagttattaggaaagctcattttttgcaggtgttgaagacttatgtttatgaagagaaaatagggggaggaagggagaaaaacaaccacaaacaaaggaacaatcctggataattgacgtaggccacagtactttgaagtccatccatcagtaggcatgtatgaatgtggcttatgtatgtaaatagattgctgttacattttctgaagtttaagttgtttagctttagtttgcagggcttcacgaaagcacagcttagttttcagtgactccaaattaggaaatatggggaaaaaataaggaaaacaaattgaaaacattagtttgcagatttgtagtcaagaaaaattagaatttggtccaaaccttagaaaataataaaaattgaaaaacattaggcaagactagaatctaacatcaggtgtcctatagtttttgaaatttttttttctccagtttcccgtgtttattaaagacaaatcatggtaggactgatttgttttattatacttgacctcattatttgtatatagtgcagcaagaataattttttttttgaaatggagttttgctcttgttgcccaggctggagtgcaatggtgtgatctcagctcattgcaacctctgcctccggattcaagcaattcccagccccagcctcctgagtagctgggattataggcatgtgccaccacgcctggctaattttgtatttttagtggagatggggtttctccatgttggtcaggctggtctcgaactcccgacctcaggtgatccgcctgcctcggcgtcccagagagctgggattacaggtgtgaaccaccacgcctggcccaaataattattttttttatgtaggcttttaaattggctttgatggaactttgtttcatagcagaaatttcaggtaagactttttttttttttttttttttttttgagatagagtttcgttcttgtcgcccaggctggagtgcaatggtgcgagctccacttactgcaacctctgcctcctggattcaagcaattctccttcctgccttagcctcccaagtagctgagattacaggcacccaccaccatgcctggcttatttttgtattgtttggtagagacagggtttcaccatgtttgccaggctagtcttgaactcctaacctcaggtgatccacctgttttagcctcccaaagtgctgggattacaggcgtgagccactgcgtctggcccaggtgagacttttttaaagctgtgcccagccatggatttgtaccattaaatacctatgagttgggtgaattcctcttctcttgaggtttcaggataaacttggggctcatgggcctattagaaagtgacattattttacttaccacaggttatgaaccctgttacagggactgtagacaaggtataaggccagtttttccatggggctgttattggctccataagttgtttgattccttaaaagaaagtacatcattcctgttaatgctttggtaaaaataacccatttcttcagtcatgtactgttacaaattaaaacagattcttattgcacattccatagttatatggaaataactatattgccataagttaagaatactaacaagtagtttttaaattctgtagaaatcaggtagagagaaacaaatgttgtttataggagtatactaaattattagaagctattaatagctttaaagaaaagttttcttgacattgaaaaaacaaaacaaaggattagcaatgttttaagcaaaaagttaaaaagagtactgtagtcatctattagttcagtccatgcagttaattcctgttctgcttgacatttatgaacatatcagctctccctgtgtcctgaaattttttcctctatttacatatcaaaatcttcaaagttatcagagattgcattcaagagcacctgttagagttttatagctgattataaaacccccttctaaagaggactaaaagaagacaacaattgtccttggattacaaaagttttaagatagccaaagtttaagacacaattaagtaaatttgttatgtctgtggcacacaataatttaacataacaattacaattattactgataatgtatactaagttatatcagaattatgggagttttccataattttggaatacatatcaataatgtatttatacaaatacagctcaaagaaaaccacgtgccattttgtacttgacaatgcttcttgtataatttttataccaattaagccaaattatgttttttttggactctagggaccctaatatcttaaaggattaattaggttagaaaaagacataatttataatttgattttggaaagtttgttaaatatcaaaggtttaaaacacttgatatagcaggttattgtaaaataagttattcattcaaccaaagtgataactcaaggatttttaaaaagaggcaaaaacccttattttttgagagaggagacttaattttacaaacaagaagccctagtaaaaatagcatgaagccaattaatttttttttaattttataaacaatttataaaattttaatcctgaccataggatataacttccataatcctcttataacctttattaaggagtcggttaatgctttaagaaaaccttgttaatctgacacagctgtacatatgctggtattgccttaatgtgcctttgacattaatgattgatttatagataaactgaactgattttatctttaaaaatggccctatagcattaggagaaatatcaaatgtagatgatgggttgatgagtgcagcaaatcaccatggcacgtgtatacctatgtaacaaaactgcatgttctgcatatgttccccagaacttaaagtataattttaaaaaaaggccctaacagtctcacatccccacctcctctgcgatagtttttgggccttgaggagttgaatagctttaatttctggccctgtatgtctcaggaatacagtttattttgactggcatcttttaccgggcctgaagataaggctgtaactgcttttagtgtttatgctttagcaggacttggtgtcctttttagactcaggatttaaaaccatgtaacttaatattacaaggactttaaaagcacatgaagaaggatacacatatgtaataaccttaattaaaaaaattaattttagttattttcctaagcaaaccaaaacttaataataatggcataggaattgtttcgataaactgtaaaatcttttaggccagttaccaaagggaaaagaaaaggccttttgcactgtacacaatattatgatggaagaaaatattttctttagagctttaagaaaatattgttagtctcaggcaataacaaacaggacatgaggaaaaaaaattatatgagctgaaaatgtgttgaaggagaagttttgctattttacacccttaaaaggggagagaaaacctaaaacggtgagatgcaatacaagttgaacattgtgttaaaaacaaattaaaatctcatataatttattgagtaaatcaatcccttaagaaaatttcattgttttaaccaattatgtagtgtatgagtgtttttgtatatatcaagcccagtctttaaaaagaccattacaatttccctttaattatagacaactttattatgtaaaagtttttatttttatttttttaataaattctcttcttgtgacttacccagactgttcatgacatgcttggactttctggtttgtcctgaacatcactttttcttaaacaaccagttattttattataggactaaatctaccctacaagattttttttcatattaaattatttttctttaagcttttttaccaaaaaaccctttttatttttacaacttcctttacatctttcttatttcctggttccttttaccttcttgtaatataacctttaaattagctttgaattagacaaaatttgttcaccttttcaaaaaggacacactttttttcaagaaagaatgtttttatacaaatatattattattggaaaatgcccaaataatgaaatatctattatttaatttaactttagattttaaattataacacttttgtttacaagtatttatcccattacatttacctaattattttctttttatcatttacctagattgtgtatgaaaactgaaatagtcattatttaaagttattgaactgccattgcaaaattgtacctgagacagtaaaaaagatttgatctaactgacttcatcttgattcttgttcattcctcggtattggctgaacaaactaaattaggaggaatttagtttatagtttagctttgaatcaaagatgaagataacattcccttcccaaaacaaaccgtattgcctgtggactagtccacctaaagccacagaattagaagttatggtaatcttactaaatttaagatgtatctatttttattaaactcatgttaatgtcttatttactaaagattatggaagcaaagattattttctcttgggctgggtttaaagtttatagccaaattttgacactgtatagtatttgaaaggaataagtatgaaattacttgaataataaatacaaagaatgtatgctggcaattcttaacacatttttaatattactttaccaataattttaaagctggcttatttattaaagattttacttaagttaaataaacttgaaaaagcatttgactagccttttcttttttcatgataaagtatttgatttaagcacttttattttcttaagccaattagagatcttttatatattttcagtagtgaaacattgtgtacacaacacaaaaatacatagatgtattaggcatgcctatagaagtacatctttagatttatagatttataaagacctttttttctatcttagacttttagattcttaataacatgttttataacccagagcagttttcagctaaatagccttaaatttgcatattaaaggagacaactcaggtgaaaatcaaattacaaaatttacataataaggtactgagacaaaaagtctggtggtgctagagggagattaaagatggatgccaaattaaacataaaattatagaaatctgtcatagaattgtataaggagaccaattttatttagatacagactacatatattttaactggatctttgagctctgggcagagcccacactgaatcctgggtctccaaaaagggagaataatcatgatcttagactagcatggcatccatgcttttacagtgcacttaaaataattctttttaaacaaagatatttctaagtgtttgaactgcatgcttccttaaaacccaaaagtagcctctgttgtaataggtattttagttaaaaaaatcaggttacaaaatacgaaagcaagcagtttatttaagagctgagacaaacttgtctgtatattcttttggtattccataaaaagcaaacaaacaaacaaaaaacagaagttcctccccaaaagggagctaggtaccttctttgatttctttaaggacccccaagatattttaaactattttaggtcccacatgtagtagatggtgcaagagaaaggagagagagtagatgtaaatggagaaaacagaattcagttaactgagaagaaaaaatattttgctcaaaaaaaggcaaggttctaggagagaaaaaaaaacatgaacgccttttaaatacaaacaggcacacaggcacacatacacacacacacgtcttggataatgacttttaattaagcttaaccactgagctcctttaaaaatttttttaaatctcattatcatatttcagctaggagaaattgctgctatttcagaagtaccaagtatcaaaccagaaagggctggattcaggaaccaaacccagggtgtcctggtggaagaaaaaaaaaaaaagaaggcagaaccttagctgttgaactccagcatgggtggacagccattgttctttcagtttggcctggctagtaaaaaggtggccttgttatgtaaataaagcccctttagtagttaaaattaaaaaaaaaattcatttctttttcccttttgctgtccattttctcccccactacaccacctttgtgtgcatgtgttgtggcagggtgtcaggggtggtggtggggaatttagccacttcagaggccttgttccccataatttggaattttccttcaaattttatcaagtctgatagagttggttaaacccaatgggaaaaagactgaaggaacaataaaaataggaacaaacatacaacaacaacaaaaacagttaaacaaacaaacgacagcaaacaaacacattatgtgattactgaatattgtaatggtaaggagaaattaagaccagctggttcttaaacttagccaagacaaaaccccaatttagctacttacctagggatgggtctcaggctgaagaccgtactctaccagcctagaagctggaaaaaaaactaaaaaacaaaaacctgaactcatcttccctgctgcaaatgagctcaaactccataaaggagttatctgcctttcatcatcatggaaacagaaaatcttgccttccttgttggaagcaagtaaaactccaaaaaagggaagttgtacggcaaaataaactttagatctcgaccaaattttgggagatcagggattctctggacggtatgctcccagacctcagcaaattgtcctattggagccataatgtttgcttatgctgatatcaagcaccaataggagatttgtgaaaggtcagaggcatctccagtcagaattgccttgtggttaccaaaatgtgaacccccaaaatctgagacaggtctcagttaatttagaaagtttatttgccaaggttgaggacatgtgcctgtgacacagcctcaggaagttttgatgacatgtgcccaaagtgattagaacacagtttagttttatacattttagggagacatgagacattaattaacatacataagatgaacattggttcagtctggaaagtcaggacagcttgaagcaaagatgggaagacttgaagcagggagggggcttccaggttataggtagataagagacaaatggttgcattcctttgagtttctgattaatttctccaaaggaggaaatcagatatgcatttatcttagtgagcagaggggcgactttgaatgaaatgggaagcaggttggctctaggcagttcccagcttcatttttccctttagcttagtgatttgggggcccccagatttattttcctttctcaagtgttacatctctagtagatactgcaattcaataagtaaaaatgctaggattttttgctagttactaggaatataataatcaaatgcgtgattgcaaatattataaagtcacatgaagaaaaaggacaggtaacctaataatgatagtacacactgtgactaattgttgttaggaaagtgtagtacttaagaactagagtcagaatgcactgattttcatttcagcttcactacttattgactgggtaaccttctaagccttgatttatcatctataaaatgaaattaataacattacctaattgatgaggtaattcggagtattaagtcagttaatgtacgaaaagtaattagcacagtgcctgggaaatagtaagcactttatgaatatcagctctttttagtagtagtattgtagaagtatatgtagagaaatcaggagtaaaatgaggattgccattcacacaaaatccagaactggtaggcaatgattctagaataagagttacccatgggtggaaggtataagggatgagggaaaagtttgtgccaaacagggttacagaggtttgctaatgtatgtcaagtttttgaaactgctggtataggcataccttgttgtattttacttcgcattattgcacttcagagatgttgtagtttttttactaattgaagttttgtggtaaccataggttaagcaagtctgttcgtgcaatttttccaatatcatgtactcactttgtgtctctgcaccacattttggttatttttaaaatatttttatttttaaaattattactatatagattatggcaatttgtgatcagtgctcctcgatgttacttttgtaattgttttggggtgccaaaaactgtacctatataaaacaagtcagcttaattaatgtggtgtttgttctgagtgctccattgactggaagttctgtctccatctccttaggcctccttttcattgagacacagcaatattgaaatcaagctgtttaataatgctacaattgcttcccagtgttcaaatgaaaagaattgttgcatgtcttgtcactttaaatcaaatgctacatgtgattaagcttagtgaggagggcatgttgaatgccaatacggccgaaatctaggcctcttgtccgaagaattagctgaattgtgaatgcaaaggaaaaattcttgaaggaaatgaatgctactttagtgaacacacaaatcataagaaaatgaaatagcctttttaatgatatggagaaagttttagttgtccgaatataagatcaaaaccactataacattcccgtaaacctaagcttaatttagagtagagcctaactttcttcaattctacaaagtctgagagaggtgaggaagatgcagaagaaaatttggaagccagaagaaggtggtttatgaggtttaagtaaggaagccatcttcataacaaaagtgcgaggtgaagcagtaagtgctgatatagaagatacatgtctaacttaattgatgcagtagctacactaaataacagattctcaatgtatatgaaacagctttctaaaagaagataccacctaggaattttatagcaaagaagacatgtaaatgcttgacatcaaaattcaaaagacaggatgactttcttgttaggagctaatgcatctggtgattatgagccttggtaatgagccagtgctcatttacccttctgaaaatcctacggtccttaagaattatgctaaacatgttctgcctatgttctataaatggaacaataaagccagcatgacagcatatctatttacagcatggtttactgaatattttaagcccactgttgaggcctactgcttagaaaaaaaagacttctttcaaaatagtacagctcattcacagtatacctagtcactcaagagctttgaaggtgatgtgtaaggagattaatgctgtttcatgcctgctaacacaataactgatacggtttgggtggtgtccccaccaaaatctcatgttcagttgtaatccccagtgttggaggtgggggcctggtgggaggtgattggatcatggggatggatccctcatgaatggtttagcaccatccccttcatgctgttctcttggtgctgatagtgagtgagttcttgagagatctggttgtttaaaattgtgtagtaccccctcttcactctctcattcctgctcctgtgcctgctccgccttcacctttcaccatgattctaagtttactgaggcttccccagaagccttgcagatgccagcatcatgtttcctgtacaacctgtgggtctatgagccaattaagccccttttctttataaattacctggtcttgggtatttctttatagtaatgcaagaatggtctaagtacaataaccatttggcagcctgtggatcaaggagtaattttgattttttgtactatttttattaaaatacattttgtaaggctatagctgacataggtgatgattcctctgatgaatctaggcaaagaaaaatctctggaaagaattcatcattctaattgcctttgataacattcatgattcatgggagtagatcaagatatcaacattaacttgagtttggaagaagttgattcccaccctcatagatgactttgaggggttctagatattagtggaagaagtaactgcacttgtggtagagatagcatgagtaatattgatagaattataagtggagtttggagatgtacggaattgctgcaatgtaatgataaaactttattaatgagatgttggtttttatggatgagtaaataaagtagtttctggagatggaaacttttcctggtgaagatgctgtgaacattgttgaaatgacaatgagttggaatatcacataaacttgataaagaagcagctggatttgaggattgactccaattgcaaaagttctgttagtaaatttttatgaaacagcattgcatgctgcagagaaatctttcctgaaaggtgcagtcagtcattgtggcaaatatcattgttgtcttattttaagaaattgccacaatcactccaaccctcaggaaccattaccctgatcaggcagcagctgtcaacactgaggcaagaccctccaccagcaaaaagaaaacatgctaaaggctcagatgatcattagcagtttttagccataaagtattttatatatattttcttctagacataatattattgcacatttaataggctacagcattgtgtaaatgttactgttatatgcactgggaaaccaaaaaaattttgtgacccactttattgcgatattaactttattgcagtagtctgtaactaaacttgcaacatctccaacatatgcctgtactgttatttgactgcagtgttaatgctattagcagagaaagaagcaaggctaagtttctaagattggtatatgatatgttaatgtgattggacgtcataaaagtgagggagaaacactgaggaaatttaagcaagggaattaagaagtgtttggaggagaatcacagaaacctcttttggggttaaagagagcactttgtcagttaagtttgtgtattaaaccatgaggaaagttatgagtgccttcattcattaggcatgtgtttgctatagaaagaacttaaactatttaatgtttataaacaatatccaaggatttatcatcagaataatatgctataatacttatgcagagctgtctggtatatttattcctcatgttttattccagaaatatgttttattttgtcttttacaattgtctattttctgtgtaaccatatttttaaaaatattaccttgtctgaattatatacattattattgtattaattatctgttgaaagtttatatggaatagatttcatcgtggatcttagtaacagctaatttaatctccaatttgaatttatttatattttttaaaagaacaagtaagaatataacctaataagatctcaagttgtttgcctgaaacagcccgattgtctttaagatatgactagttaactagcatcctttatgtaactatgcttttaaatccaaatagtggtttgcaagaccctctctttcccttcagttcgttagatgaacttgataattttagcacattcttttatattacattttccttttttgtttatctgaaatattatatcagagtttattatgtctggcaagctgacgttttgcacaaacacatcaatttatctttcataaaataagaaattttctcccacaaattttgacattttgtagtaaatatcaagctattaatctacttctctgtccaaatgcatttaatgcaacttttttataaaatcataaaatttaaaatattgatcattattattaattcattaaaaatatagcatatcttaaattcaagttttagattttggacatgttttcagtatgaatttacatttacatttgaattgacaaaatgtattatcagggttactgtagtttcagctaacttaatttttagcatgttgtcttatcaattattttgggggttttttaaacagatggggaagatgagaatatgaaattgtgtcactaatcagtctttattttgattattgtttgaataatcactgtataatgaataaaattattaccgaagacagaattacaaaggtgcatttatactggcttaagttttaaaactaactttaaatgtaacttgtgtaaacatgtcatatttttcatgggaataccacagaactaaatggaaaacgttatttgcaagagtcatgttctagccatggcatcaacaaataggaatcttcctaattagaacataatagattttacagtcataaatatcccataccctgagaagatatactttcatagaaaatacaaatttagaatattgttgccgttattgtctcactgttttttaaaagcagttggctaaataatcattcttttaagatggtatcatttttaatacattaagaaataatatttcatgtaatgccacctaattgagacacaataacatctgtaccttcttcctttcatagcttttaataaggatatttgaagtcctaagaatactcctgtgctaaatcttgctattgaatctatttattctataaatttcttgaagttatttatttatatttataaatatttctaaattacattcatttatttataataatttatttatttattcagtagttttattgagtgctttctatatactgtctaccaactactgttctagtcattggaagagtgctgtgaacaatatgaacaaggctactgttctcgaggagcttacattttagtggggaaaagacattttaactaatgatcaaccagtaaaataaaataattttagattgtagtttgaaaagcatagttttatacaatactatagagtaagggggtggtaaattactttacatgagtgtctttaagaagtgcaatatttacggtgagacctacatgatacagagcaagccatgtgaagaccagttgccctacatcacttaagaatgattctcctttgtgcttattccttttcctagaaaccaggcttgtccaacttgcagcccatgggccacatgcagcccaggacagctttgaatgcagtgcaacacaaatttgtaaactttcttaaaacattatgagatttttttgcgatttgtttttttgtttttagctcatcagctatcgttagtgtgttttacgtatggcctaagacaattctttttcttccactgtggcccagggaagccaaaagattgggcacccctgcagtttccagttttattagaaggggcctggaactgctgtatgctattgtagacagagaaaaactgagaatagccagatacacttgaacctaatgctgtgcttcatttctttctgctctctgtatcaaattttcctgtttgatctcagcacttctgcatatttttagatgttaaaaagcgatttcttgtcccacccacgtgagtagtagaagacaggatatttttcatgttcttttttctcatagcacttactgagttccaacatattatataatttattattatcgccatttattatctgctctcccactaagaattttttcactgctagcttttatttttaactgatacatccaagtacctggtacaatgcccagaatataatagatacttagtgatttatttgatatatgcataaatgtataccccttaaggagggaatcttgaaagagaatctgattgagttagtgtctgcttggcattgcttactaattttacaaaatcatccttgtatctgccttccatttccataattaattatatcttatttttaaagtatatacctgacaatggactgcaacagtattttccataggcaatttcctgtggaattttctatggaaagtctcgggtggaggaacattttgaaatatttgtacaacaaattgtagtgctgactcttctgttgaatagccagtatggaatatattcaacctgagcctgtagcctccagctgggactccaagtacaaaaactgcttgtgctgagtctacatttactcttgagtgccatttattttaacagatttgttactctgagtgtcccttgcatcagtttttaagaaagtctgtatttcagatggtactttttatagagactttacccatacacttcatcccaccattaatactcattattgtaaaaggtaggagagtattatctgtagcaggagttggttgaggtcttcaatcagtactttacttaatgttcaagtatcatgtgtaacctaatttgaactgcagctgttatttttgataattttaaaaacagtgttaattttgggaggtccaagtgtctcatcacccccaagaagtggtatttcagcttattctctgaaaacaagctggaatcaaaatagcattcatatttcttatgaaaacttttacatttgtctttattatgtttattaataggtaaagatagataatgtaattatttcaagttttagaatgttttggttctttacttcctgacttttacttgaagaagtagtcagtttcctctggctactttatttattcaaatattctttgggcagatgtaaaaaaaatatatagagatgtttcatgtgtgcctatgtcttgcttacttgcctgaaattatgatctttcttataaggtacttagttatatggacccacagatggcaggtaaaccataataaaattctgcagttccagcctgaatcatgtgcttcatcaatttaagtatattgttagtctgttggttactcccactacttatacaccatttaaattaaagaaatgccaaatcctttatatgttaaagaatggcagatatttgggagtgataatgagttaaatagggattgcacaaggggattagtgaagactcatatttgaatattatatattttaataatcaatgcttttttcccctaaaaatgtgccacttgctctttgaaaattttccatctcagttcctttccccacttttgttggaccttctttgttttgtctatatttattttattctgcttaatttcgattttcacttttagcagtttctcctcattatgagaccagtcctggaatagagatttgactggttgcttttgaaagttcatgtactccaactgttccaggcttctttagaacttcctcaggatcccttcaactaacctagtcttgtattgagcaactctacacttctgttttcacttccttattcaagttggcctggcctagttccagttaatacctttttgaaacttttgagttttcctattgattccctctttttcctgcctcatagacactggtaccttccacagcttgagtttgtcatttacccgtaccagtttatgttttgacatttaaggggatagatagtctgccacttacttttgttagaatagttgttctttttttttttttttttggcttttcaatttagctgctatatattttaatattggaagtcaaggatatcaaaaactatcctgctacgcccactgcccactcagaactctgtcccttggattgcatttgttaatttctaagtagttaagcttgttttggccatatgtgaaattatagttttaattttattttattggaatatgttaatgtaccttataaaagctaccatttagatttttaaaatactttctctgtacaatgtttattgtcttctttttaaaatgttctatggattaaaaatatattttaaatcatctgtgttcttgatgatttctgctctgttttgtaacataacttcttgaaagttcagcctgtagtttgtttctactttgtaatgttccacattctccttatattattctgtttatattaacatccccaccactctgttggaagttcatttgtttaaattactcatgaagttcatgttgtcaaatccagtagccatattttcatcctcgtcttaaccaacaaaatcaaccactactttcttcttgcaacatttctgttctttgatcatcttggcacaaccctttcctggtttcctcccacctacctttccacttcttttttttaagctctaatgatggggtggccctgaatatcctcttagagataatttctcctgcatctattctgtctcctagggactatcaaacaagtacatgatttaagatgacatttatgttcctttgatttccaaatttttaaatctaacctttcctgtgagcttcaagctagtagttactgtctactcttgaacatttaataggtatttcacatttaacatattctaagtaagtttttctttccttatttctcccttgatcctcatggcacttttctattctcaataagtagaaatatcatctttccacttgttcttgtgagagcaaactacaatagtcatgactgattcttctccttcattcacctgtcatatctaatctttcttcattcacctgtcaaatctaatccttcagcacgtctcctcacttctctctctaaattatgtacctaactacttatttttgtcttgatgactactacccttgtgcaagctactattgccttatgactagaaaaatcaaatatcctcttctcttatcttctggatttccccaattatttctttctcacccaacagccagaatgatatttttcttgagagttagatcatgtcattcccatagctcaaaactttccatgggttcccattgcccttataatatattccgaactctttgtcatggccaacgacctatgtgacttgctttttgctttctaatctgaatttatttacaactactctgtcctttgctcacaatactccagatcttatgacttttcataaacatgtctaacctaatcatcatctttacacttgagaaacctctaccaacagatatttgtgtgtttttaaacttcttatttggatataagctcatatatcacccctttagtgaggccagcagctctaaccaccggatccaaattagccgcaaatcctcctagctcatatcatctttgtttttttccactcaaaacaccactgtcaacaattgtgatatccccctacaagttcacctggttattttctccctcctgctattagaacataaaagccaaaataataggagctttgtcttattacaatggtgtagaacagagcttgtttagtgactatttcttgaatatttttacatgatttaaatgatttaagtagatcaattttgtgtctctttgatcagataacttttaaaagagatatgcatgttaataatttcttccaaaattttgccattatcaaattccccttatatgtccagagattgtgtttttacttacttggcctgtatttttggtgcatattgttttattattgttatgttttctttgtctcagtgttttatttgatcaggttttgcctttgaatttcactttgctattaatattggtttatatgttttattgtttttaagtgcctattatatcttcttacagtattttatattttagataaaaatgtgtcactgttctatatgtgttttctgctaaaaacgtaaagctgaattgtatctttactgcaaaaatctctgtctttcaatgtggattcaccctgttgacatttactgcaattgcactgtatcttattcagttaattttatgttatgtttattattttatttgttatttcatctgttctctttttttatatatttgctaatttattcaagcctttgttcaaggtccttatgcccccttttcatttaggtatttatcaacattgcgtaaggtttcctcctattccaatttgtcttaaataaactaattttctttattatgatttcaaaatattatcattttgaagatttttcctgttcttaattattgtttccagaattctgttaccatggatttaagttcttgttgacaatattctttgataagcttcctttctatgatattctatggacaaagacctgggaagaaaattcattcttttaaactttaaaagatgttttttctttaatcttttataatattttcacctataaccaatctcctatgccaattatctttcttcagcctttgtataagtgtttcataattcaatagcttagaagcttgtaggaaatgaatattactatatttaagcttacatgtacatgccaaagaatcattttctcaacttactgtaattctttacataagaaatactgacatcccttattttagaatgccatttaaattccttagtgttctttccttgcactggaagctgggacaattataggattaatttcctttgtttttcttcactcagggatcataatctctggccagttgtccaatgcctgaaattggttgtttcagatacttcacctagttttccagttgtttacagcaggagggaaaactcattccttttagtccattttcagtagaaattctattatgtttttgcaacattttcataaaatattattaaaagaaaaagagattttaatacctgaatggtttagcttcagcaatgtgggaaaactcacttatattgacatctcatttatacatgatacaaaagtttaataatgtttatattgtaacttttacatgccagaaattatggtaaacattaaatttctattcagttagattttctataacattataaggtagatgcttttattattaccattcgcatatgggaaaactgagaaatagactagtttttcaaaatatacagggctagtaattgaaaaaccacattacacaatcagttattctctatccagatgctatattgttgattgatatactataatacacttcctcaggacagatgttacagtatgatctctataatgttaacagaaatggagaacgacttcaactttttggctagtttcaccttttaaaattaacttcttattaacattaacaagttttaaaatgatgtgacatattttattatttgaatggtgtgtaacaaaacatttgtatatatatatgaagcttccccagatgaagttatatagggagaaaattccctgttttcttagctgagttgaaatgtgggtgttttggttaggcatatttaatctgtcatagtatttcacatgaaactcttagcgtgcatccttaaagtaattatataatagtttttaaaatatttaatgtcgtattctacactatgaccatcattagcagttggatatattaggtattctagatgaaattttcattccatcacatatttgatttataatatcatgatccaaatgtcttggtgatttagaaaaactgtatttacaaatgtcatgaaatatcaccacaggttttagagaagaacatactttcaattttttttattttgatttttcagattgcattctcacaacacaatacaatcatggaccttgtgcagttttttgtcaccttcttcaggtaaaagtttgctttgactgactttgaacttttcaagcctgtattctgatatatgtcctgtcaatctgttagataatcgaccaattctaaaaccttaaagtatcatagagtatgtcttgaatagctttatatgcttaaatatatcccacagaggagaggtaacatagctgaaatgtacttgtgcaagattattttgctgttatactatttaatagccaatggattcagtggaaagaggataactttgtgtcccccatcacataaataattatagcctgttttaattaatgaaattaacaatgcatgcaccacatggattagttacatctacaagaactaaaccaatttgtttatttcttagttaattttgttaattgtgtgacatattcgttgtaggttcataaaaagggctccacagtgaagcagctttgtaaaatgctacatgtcctaaagttaaatagtgctcttttggttggttttcaactggcattacttctcaaagcttttaaaatgctaatttgcaatatgtcattctacaagagaggttatagtttgtagcatttctcaaaacatgaaaactgttttcagggaacatttattttcatttccatgggatgtaaatgtagagactctgggttaggagtttaagttataaaatatctgtgttatgagatcgtagatcctctggattggaagagatcttatttttgttaacattattattcacgtgtgaagtttatgctggtcatttgggtgcctttgtacaaattagacaaatatgacttctccttctggcagatacagccccacatcatggcacacaaatttggaaatagtgcagtatgaattttaaccaacactcaccaacttggctgggctgccatacagtaaagacctgcacaactcaatccttagcacagatgatgtatttggaacttgtctaaacacaaagtaaccatcatctttttgattgtcttgtccagatatccataaagtatttgaatttctaataccttcttcactggagtcagcaaacattttccattaagggccagatagtaaatatttcaagatttgtgggctgtatggtcttcatcgcatctatgcaacttttctgctatagtgttaaagcagacaaagccaatatggaaacaaatgggagtggctgtgttccaataaaactttattataaaaacagctggtggattgaattcagcctgtggacataatttgcccaaccactgatcagttttatgcctgaatgcctttaatgacaggaagctcactagctcctcagatggcattttctatcatcagataacaaattgttctttataactgagctgaaatctgcctccctatgatatctctcctaattcctccatgtgggcccatatataacaatttcaatttctcatttccatttacagcccttcagatttgtaaagtattttctacggtttacacattccttgttcatttttctacttctcttgataagagaaacctttgccatattggtcagtttactctgaaaacaatcatgttcatccatgcaccttaaaatattataatttctataatgtatttctataaacatatttatcactaatatgtgtaaaaagtgcattcgtactttaaattgttccttaaaatgaaatttgaggaaacatcttaaatatgtttaatattttacaactttgtacttcagaaaacaaatgaattttaaggctattaacaaagttacagtatggttttagaaagtactagaaattacagttgaacaagcattattgaatgcattaaaacaacttttgttgttgttgttgttgttgttgttgttgttgttgagacagggtctcaccctgtcacccaggctggagcagtggcgctatttcggctcactgcaaccttcacctcccgggttcaagcatttctcctgcctcagctcctgagtagctgggattacaggcacgtgccaccacgcccagctaatttttgtatttttagtagatacggggtttcaccacattggccagggtggtctcgatctcctgacctcagatgatctgcccacctcggcctcccaaagtgctgggattacaagtgtgagccaccatgcctggtctaaaaaaaactttttgatgcagaatagtctggaagaaaattcactgaaagtttggttaagtgaaaaatttcacaaagttgaatatgtatgtaaattatttgaatcttgaggttttttattttaagcttttgaatttgtgtgcatatttaaattcaatagctcttttgttaagtaaaagaaaattactgttaatgtgtaccatgtcttagagatgatcctatttattatgttgtcatcatggacaatgtaaaataaaatattctaatctttgggtgtgataaaatatatttgatgggttttttgtcatttaaattcttccagtagtgaaatgtaaattagatcacttaaaaaactgggtcattgttaagaaaaatatggacaggatattttgaagcttatcaattattaagttttataaagctactgctaaactttaggagattttaaaacaggttaacatttatggagacccctcaatcaggccatttttactgttattgctgttattttggtaacagagctgagtgcgtcagctttgcagtttagccattgttctgtaggggctggttctcaaactctttgttagattttacctctatattgtgtgtagttctgatggtaaacataattgggccagtactagggagatcacttacagacataccctggctctgttcttaatgttttatgccatcttaagtaggtcactattttagtttgtttgtattgctgaaaaggaatacctaaggctgggtaatttataaaaagaggtttatttggctcacagttgtgctggctgtacaagaagtagggtgccagcatgtgcatctggtgagggtatcaaactgcttccactcatggcagaagaggaagcggagctggcatgtgtagcaatcacatggggagagaagaggtgacagccagagactcctttaaacagccagctctcttgggaactaatagagtgagaactcatttgctaccataaggacaccaccaagtcattcacagggagtctgcccctgcaactcaaacacctttcattaggctcaatctccaacgatgggtatcaaatttcaatatgtgctttggagggtcaaatattaaaactatagcattctatccctggcccctcaaatccctggtgttcttctcacatacaaaatataatcatttaatcccaatacttcccagaagtcttaacttgtttcagcatcaactcagaagtccagagtccaaagtctcatctgagactcaaagcaagttcctttcagctttgagcctgtaaaatcaaaatcaaattatttatctccaagatacaatggtggaacaaatattgagtaaacatctcattccaaaagggagaaactggtcaaaatatagtgataacatgctgcatgaaaatccaaaatatagcggggaagacattaaatcttaaagctccaaaattatctcccttggttccatgtcctgcaccctgggaacatggatgcaccatagccctgctctactaggcaatccctggtgggtactctcttcagggcctccaaccgcatatttctgctcagcattgcctcactagcatctgtctgcagggtctccacccctatggcaggcttctgcctgggcactcaggcttttcaatacatcccctgaaatctcagtggaagccgacaagcctctagtactcatactttctagcctccttcagtggcagtaggcacaatacctggggccatttgagcagcgagatgtggggagcactttctagagatggggcatggcaatgttgtcccaagcctgtcatccaaaaccataccatcttccttgggctcttggtctgtgatgggaagcccagaagcctgccagatttgtgaaatgccttcagggtctttcccccattgtctttactaatagtacctggctccttttattcatgctactttctttaacaagtgtttgctaccccagcactcttctgaaaacactctttccttctctgccacatggccaggctgaggattctacaaattgttatcccctgctttccttttgattatacattccaactctaggttatttatttgctcctgcatgtgaacataagctgttaaaagcagccacattacttcttgagcactttgctgcttgtcatggacacaatgtagcaaagttctttgacagggcataacaaaggttatctttgcttcagttccagtgatttcctcatttcagtctgagaccctcaacatggcctttactgtctatatttcaatcagcattttggtcacagccacttaaccaatttctaagatgttccaaactttccctcatttttctatcttatgagcactccagttctaaagccacttttacatttttaggtgtctttatagcaacataccacttcctggcaccaattttctgtcttagtccatttgcattgctgtaaaagaatacctgaggctgagtaatacataaaggaaagaggtttacttggctcatggttctgcaggttgtgcaagaagtatggtgttggcatttgcatctggtgagggcctcaagctgtttccattcatggtggaagaggaaggggagctggtatgtgtagagatcgagatcacatggtgagaaagtaggcaagagagaagacagaagttccagactcttttaaataaccagctgtcatgggaacatgagacacaacgatggcacaaatccatttatgatggatctacccctgtgacccaaacacctcccattaagccccacctctaacattgagtatcaaattttaacatttgatttggaggatcaaatatccaaactatagcagtcacctagcttctctaaatctcagtcctttcatatattgaactaaaggtttttttttcttgttgttgctgtgaaataatatagtaaataattcaaaaattgaaaagaataattttttaaataaactcttcttgtgtgtaaaatggaaaagtagatgtatctgagtcagaaaagtctgaattatttattttaaagaactaaattaaatggaaatttggtagagactactatccctgtgttagacttttagtggtggcattaattttctatatcattggatgacattatattttgtatttattaacttgtccagttgggagtagtttcagagattaccagttggtcttttccactatgactgatcttatcctataagccagggacacagtgtagaggttattccagctaccttgtacatcagttctatttatacacttaaagagtggggaaatgaccaatgggtggatccattgacatagtgggcacactgtgagcaagaatttagtcagaatttgttatgtgcccccaccccatgaacaccccaactctaataagaggacatgatgatattttgaatgcttggctatctgtgtctaatgggagtcaattaggccctcatgtctaatggtagtcaaaatgtctgcttattcctcctgtactgtatatatatcctcatgcatataccaatgtatataatcaagtttatggtgtaggtattttcagggatcattttacccacttttcaaaatgtttcagggaccttccttctatggactcagtcacctgattagttaatcggttttggattttaaaattagctgaaatctgggaactgtgaagagaaacatggccctccattgaagcaacaaccctcagtctcctgttccttcattcttacttaaaatgaaaccagatgttaaatagtaccactgttggctgcccacctattttcccttcagaataccatgccttattaataatccctacaactctttgtgagccaacccccttggcagttcgtccaatcttgttgatctaattatggtaattgtggtttctggattctggcagttaagcgctgacacctgtcgtctattacattgggtctccatctttttatggcaattaacaaacctagccctgtgactatctctcgtattttcgggactgctctgaagaggagagccagctctaagcctccttataatactggtgcctctcttatcagcatattcataacagccttaatgcatagtttgtcctctgagtcctcccatggaacacaacctggtagttcttctggcctcctataatataaaccattccagcatatccccttctctcagtgtttttataactttctcttccataagccaggacaacccaggcatttcaatttcacttgtactggacattgcatttttcaggcttctacgagtcactctagcaacaagtttgctccattccctggaatcctcagtagggtattacatctctgtggtcctgaaaatatgcaccaaaaccaatgagtttttatttatccagtcttaacatttcgttgccctttatcaaatatttaaatctggtcatacttccatggctcctgccagtacgtgctccctaaatcttgcatccgtatcaattgtgtaatccattttctttcgtatcaggctcagttgggtcatgctgtgatttaatccccctaatcagtctggcagccaagaaaagaagtggtgacagtttgtgagggggcacctgttacctaagagagaagagagctctttagtgtcttccagcataacgaaatgctaggtattgctagggaagcggttggtaaaaccaacatcctcagaagcattcattcatatattcctattccatatttcaggttcctaggtctcctgaaccatggccctttttgcataacacaacttctttggcttagcattctgtcatctctggagctctgcaactctacaacaattagatcatcatcctgctggtcattcatgttggcatttctgctatcagtcatcagggcctcatttaaagctatgaaagagacccactggctcttttatttagccagtaaatggtttgttaatggccttcagtctctcattatccctctgcaggtatcaatacaacataatgataatcattctactccactctcttttgaaggtgttttccccatcttccaagcacctgaattgctgtaccttcaagtattttctctatcagtgcattttctcaggtcaccactggtgaaatccagcaatttaagtcttctgccaggaactgtgttccacccaccaacatggatgttgtcctcttagcctgccaatcagtgagtgaatcagttcctcatctccatcttaccttctgtttacttggaccataagtcctctgagacacagaagccaagatgggattagataagcaataaacgtgttaggggaacttctgtgaggggaaattgggagaagggaggggagataatgggagaatttgagaccacaatgcctacctgcctttgtgagggagagaagcaagaaagggaaggtgagtgaaagagcctgagaatgcagggcacttctaagaatgtttaacaccagtggtgtagccttgagcaaaagttacccatcaaaggagtcttccatctcccaggaacaggcccgccttggtatttctgccatgtttagtccttgactaaggacagcccttgggaagcatgggctcagtgtgaataaaatgatggatttcagagtgcagtagctggggccactagtcagttatgctctctgccatcagggatcagagaggcacttttttttttttttcccccccgagatagggtctcactctgcctcccaggctggagtgtagtggcacaatctcagttcactcaacctctgcctcccaggctcaagcgatcctcccacctcagcctcctgagtagctgggaccacaggagcttgccatcacagctgactaagttttttgtatttttggtagagatggggtttcaccgtgttgcccaggctggtctcaggctcctgagctcaagtgatccgctcacctcggccttccaaagtgctgagattacaggcatgagccactgtccccagccagagaagtatatcttagtggttggcacaatggagttatttgttgtgtgatggttgatagaactgacctataaaacctgtaaaaaatgattttggtaatgtgtttgtatttatttttgtgtagtttatatttttgagggtagatttttaaatttgactaagtttcagtaatatttgtgtctatggaggtttttaattttttcctgacctagttggtaattggctttttaatggaagttgtactctttgtttcattttataaattcattgacatatttacaatattaatactctgaagtttgttctatattagaattgtgcctacccttttattgagaattttgcctatttttccttccttccctccctccctccctccttccctccctcccttccttccttccttcctcccttcctccctccctccttccttatccttccttccttctttccttccctccctccctccttccctcccttccttccttccttccttcctcccttcctccctccttccttctccttccttccttctttccttccctccctccctccttccctccctccctccctccctcccttccttccttccttccttccttccttccctccttcctttcttccttccttccttccttccttccttccttcctttcccttctcatttctaaaaataatctgcttcagctgcattctgtagacattaatatgtagtatgctggtctcatagaatgatttaggaattgttccttccttttcactttttgggaaaagtttgagcattggtattagttattttttaaatgggtagaatttatcagtgaagccattgagttcagggcttctttgttgtggtatatttgattactgattcaatctccttactggttataaatctattccattttctattcctttatcattcaatcttggtaggttttatgtttctagggatttgtccatttcacctagcttatccaatttattagtgtataattgttcatagtactctcctataatcatttttatttctgcagaattggcagtaatgacccgacttttcatttctaaattttgtaatttcagttttctttctcttttctttttttttggtcagtctaactaaaggtttgccaattttgttgctctttttcaagaatcaacttttggtattgttgattttctctattgtttttctattttctctattgtttatcttgctctaatatttataatttccttcattctgctacctttgaatttagtttgttctttttctagttcaagttgtaaagttaagttgcgtatttgagatctttcttcttttttagtatgtttataactaaatttcccttttatccactgctttacagtgttccatgagttttggtatgttgtgttttaattttcacatttctctaaatattttctaatttcattgtgattttgtctttcaaccattgatcaaatgtgtgttggtaatttccacatactttttaatgttcaagtttttcttctgtttttgatttctaactttatcccactgtgggtggtgaagatactttgcacatttatcttttaaaatctaccgagatataatttgttacctaacatatattctgtcctggagaatgtcttctgtgcccatcaggagaatatgtattctgttgtttttaggtagaatatcctgtatatatctattagatcttggtggtttattgcattgctctagacctctgtttcctttattatcttctgtctgattgttctatcctttactgagaatggagttgaattattgttttaatcatttggatttctctctgttcctattgttactttttgtcttaaagaacatttttaacttaaatatagtatttctttattagaatttgtctatgtctttttgcatatcttttaaaattttttctcttgttatattttgtgtatgtttcttttataccaaaaatatctggatattttggttttgttttaataatctgggaatctcttaattttatgtgacagggaaataaatggaaattttcttttttcttctcttctgatttttattaattgaatgagcttcttattaattgaatgagcttctaatgttcttttattttccttttagcagtttaagaattatagttttttttatttaatgattactcttaaattttaacaagcatatttccctaaccaacaataatattaatcagtatgtcttttatcctcctgaatcatataggagaactaaaaaacttcaaaacttttacttatcattgtctaatttttaaacgttttccaatttctaattttaatttgtgttttatttggtgatataattcacatataatacaattcaccaattgaaagtgcacagttattcttcaaccattattgcaatcaattttagaacatatcatcatccccaaaagaagccatgtactcatcagtagtcactccccccttttacatacccctagttctgaaaaatcactaatctactttctgtccatagatttgcctattctggacatcttatataaatggaatcgtacaatatgtgttcttttgtgactggttcctttcattagcacaatgtttcttatccgtaacgtagtatggatcagtactttgtttctttttattgctgaataatatttcatcttatgtgtataacacattttatttctctattagttgatggttatttgagttctttcttctttttcactgttgtgaataatactactatgcacatttgtgtgtaagtttttatgtggatatatattttcatttctcttaagtatataattaggagtagaattgttgatcacatggtaactctaggttaaacattgtgataaactgccaaacatttttttaaagaagatgtatcattttataatcttaccagcaaggatcagacatttattttttccacattcttactaaagtttgtattaactgcctttcttatagccatcttagtgggcataaagtggtaagagatgatgcatatttagaggaattaaaaatgaaagattaaaggaatctaaagaatacaacaggcaaagaaataataagagttaagcgcttgaaaaacaagaacaatcaaagatgactacatggaagcaagcatgcaagtgagcagaataatgcaaagttaagtatagtgttcatgatttgggaaaaataagactttttattattattattatactttaagttttagggtacacgtgcacaatgtgcaggttagttacatatgtatacatgtgccatgctggtgtgctgcacccattaactcgtcatttagcattaggtatatctcctcatgctatccctcccccctccccccaccccacaacagtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaagggcatgaactcatcatttttatggctgcatagtattccatggtgtatatgtgccacattttcttaatccagtctgtcattattggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgagtaatcgccacactgacttccacaatggttgaactagtttacagtcccaccaacagtgtaaaagtgttcctatttctccacatcctctccagcacccgttgtttcctgactttttaatggttgccattctgactggtgtgagatggtatctcattgtggttttgatttgcatttctctgatggccagtgatggtgagcattttttcatgtgttttttggctgcataaatgtcttcttttgagaagtgtctgttcataccctttggccactttttgatggggttgtttgtttttttcttgtaaatttgtttgagttcattgtagattctggatattagtcctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagggtttttatggttttaggtctaacgtttaagtctttaatccatcttgaattaatttttgtataaggtgtaaggaagggatccagtttcagcattctacgtatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattcacttggcgatgcgggctcttttttggttccatatgaattttaaagtagttttttccaattctgtgaagaaagtcattggtagcttgatggggatgtcattgaatctataacttaccttgggcagtatggccattttcatgatattgattcttcctacccatgagcatggaatgttcttccatttctttgtgtcctcttttatttcatcgagtgctggtttgtagttctccttgaagaggtccttcacatcccttgtaagttggattcctaggtattttattctctttgaagtaattgtgaatgggagttcactcatgatttggctctctatctgttattagtgtataagaatgcttgtgatttttgtacattgattttgtatcctgagactttgctgaagttgcttatcagtttaaggagattttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaatcttttctgcatctattgatataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaaggatattggtctaaaattctcttttttggttgtgtctctgcccggctttggtatcaggatgatgctggcctcataatgagttagggaggattccctctttttctattgattggaatagtttcagaaggaatggtaccagttcctccttgtacctctggtagaattcggctgtgaatccatctggtcctggactctttttggttggtaagctattgattattgccacagtttcagatggtgttattggtctattcagagattcaacttcttcttggtttagtcttgggagagtgtatgtatcgaggaatttatccatttcttctagattttctagtttatttgcgtagaggtgtttgtagtattctctgatggtagtttgtatttctgtgggatcagtggtgatatctcctttatcattttttattgtgtctatttgattcttctctctttttttctttattagtcttgctagctgtctatcaattttgttgatcctttcaaaaaaccagctcctggattcattaattttttgaagggtttttttgtgtctctatttccttcagttctgctttgattttagttatttcttgccttctgctaggttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctcttcttttacatttgctgaggagagctttacttccaagtatgtggtcaattttggaataggtgtggtgtggtgctgaaaaaaatgtatattctgtggatttgggatggagagttctgtagatgtctattaggtctgcttggtgcagagctgagttcaattcctgggtatccttgttgactttctgtctcgttgatctgtctaatgttgacagtggggtgttaaagtctcccattattattgtgtgggagtctaagtctccttgcaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgcctttttttgttttccatttgcttggcagatcttcctccatcctttcattttgagcttatgtgtgtccctgcacatgagatgggtttcctgaatacagcacaactgtatgggtcttgactctttatccagtttgccagtctgtgtcttttaattggagcatttagtccatttacatttaaacttaatattgttatgtgtgaatttgatcctgtcattatggtgttagctggttattttgctggttagttgatgcagtttcttcctagtctcgatggtctttacattttggcatgattttgtagcagctggtaccggttgttcctttccatgtttagtgcttccttcaggagctcttttagggcaggcctggtggtgacaaaatctctcagcatttgcttgtctgtaaagtattttatttcttcttcacttatgaagcttagtttggctggatatgaaattctgggttgaaaattcttttctttaagaatgttgtcctattggcccccactctattctggcttgtagagtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggctccattctccccgtcactttcaggtacaccgatcagacgtagatgtggtcttttcacataatcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacgtagttctcaagccttggttttcagctccatcagctcctttaagcacttctctgtattggttattctagttatacattagtctaaatttttttcaaagttttcaacttctttgcctttggtttgaatatcctcctgtagctcggagcagtttgattgtctgaagccttcttctctcaactcatcagagtcattctccgtccagctttgttccgttgctggtgaggaactgcgttcgtttggaggaggggaggtgctctggtttttagagtttccagtttttctgctctgttttttccccatctttgtggttttatctacttttggtctatgatgatggtgatgtacagatgggttttcggtgtggatgtcctttctgtttgttagttttccttctagcagataggaccgtcagctgcaggtctgttggagtttgctagaggtccactccagaccctgtttgcctgggtatcagcagcggtgtctgcagaacagcagattttcgtgaaccacgaatgctgctgtctgatcgttcctctggaagttttgtctcagaggattacctggctgtgtgacgtgtcagtctgcccctactggggggagcctcccagttaggcttctcgggggtcaggggtcagggacccacttgaggaggcagtctgcccgttctcagatctccagctgcgtgctgggagaaccactgctctcttcgaagctgtcagacagggacatttaattctgcagaggttactgctgtgtttttgtttgtctgtgccctgcccccagaggtggagcctacagagacaggcagacctccttgagctgtggtgggctccacccagttcaagcttcccagattctttgtttacctaagcaagcctgggcaatggcgggcgcccctcccccagcctcgctgttgcctagcagtttgatctcagattgctgtgctagcaatcagtgagactccgtgggcgtaggaccctccgagccaggtgtgggatataatctcctggtgcgccattttttaagcccgtcggaaatgcgcagtattggggtgggcttgacctgattttccaggtgccgtctgtcacccctttctttgactaggtaagggaatttcctgacgccttgtgcttcccaagtgaggcaatgcctcgccctgcttcggctctcgcacggtgcgctgcacccactgtcctgcgcccactgtctggcactccctagtgagatgaacccggtacctcagatggaaatgcagaaatcacccgtcttctgcgtcgctcatgctgggagctgcagaccggagctgttcctattcagccatcttggctcctcccaaaaataagacatttaatcatgttgtacataaacatattttgaaagagaaaaaagaagaaaatgtaactccctgaagaaaaaaggtgaacctaatttagtcacaggatctctacatcaaagagatataatcctagaatatttgccaaaaagttttttaaacaatgtgtaaggacactgtgaagaattacaaatacaaaaaagtctctgtttaaaaaaataagattatgatgatggatatggtaatggaaatgacacctgaagatatggattttgctaagtagaaacaataaatgatttcttactgtactggaagttcacttaggaattttctccatggtttttttgtggaatacagtagatacttaggacctaactgttcttgtaaaccaaaatatttaatgcggtgggagtaaactagtgatggtacgttttcttgcaacttagttaaaccagtgctccccatctagtttacaaagctgaggtttatcgtactagacactgaaatagacttctccaagagtcatatcagtaacttcacactttgacttaaatattgctttacacctcaaacttaacatgctttaaattgaatttactgtactgggaaacagtctctttttttccagttttctgtagctcagttataggtatcactatttaactcacttgaatacttgggactcatttaaatcctctttccttaatgacctacatgaacatcagttctaacttctttgtatcaatatattatatgtaaattagccaaagtggtaatttaaacataaattattaactccactgtttaaaatcttccttttacatttataattcaaagtatgagtattctcatacttaaagtataccagtcactttttcattgttagagggggcagtggttaattacttgcctttttttccagcatttttttggtccttattgtttgttttttacttctgttggaagcattttaaaatttctgtgcagtaaaattccttttgcggggagtacagttgtgtgagttttaacacatgcatcatttattataattaccagctctcccaggatacagaacaatgccaaagccccagtgaatacctcatagagccttctttgcagtcagactttctccccacccctacacgctggcaaccattgacctgatctctgttcttgcagttttgccttttccagaatgtcattcaaatggcttctttcccttagtctactgcatttaagattcatccaaggtgcttttttgtatcaatagtccatttcatttcattgctaagtagtatttcattatatggatatatcacactttgtttatccattcacccattgagagatatggattgttacagtttttggtacttataaataatgctgctgtgatcaacatacatacaagttttacacaaacataagttttcatttctctagcataaataccaggaagtagggttgctgggtcacagggtggatgtatattcatctttataatagctgccactgtttttcagagtgactgtacaattctgtgctgcgaccagcaaagctcagggttccagttgttgcacattctcaccagtgcttggtcctgtcaacattttttattttagccattctgataaatgtgtagtggtatcttgtggtaattttaacttgcatttccttaatggctaatgacgttgaatatcttttcatgtgcttattagttatactttcattttctttggtgaagtatttttcaaatcttttgcctagttttaattgctttttagttttgctgtttatttttgaatattgaatgttttttgtatattctggatacaactcttttgccagatgtgatttgcaaatattttccctcagtctttgaattgtcttttcattctcttaacagtatcttttatggagtgaaaagttttagtttttataaaattcaatttaatgcatttttttaaaaacttgattatgcttttgacgtcatatccaaggactctccctaactcaagttaacatagatttctttctaacagttttatacagtcaatgcactacataacattttggtctatgacagaccacatatatgatggtacttataagattatattactatatgtttactgtaccttttctatgtttagatacacaaaaaccattgtgttataattacctacagtattcaatacagtaacatgctatataggtttgtaccctagtaacaataggctataccaatggctttcatgtgtagtagggtataccatcagtgtttgtttaagcaccctctatgatgtttgcacagggatgaaatttgtctaatgatgcatttcttagaacatatccccattagtaagtgacacatgactgtatttttacattgtacctttagatctgtgatccatttcagttattttttgtttatgttgaggtgtaattcaatgctgattatttcacatgtggatatcctgttgttacaccatgatttgttataaaggaaaaacctttccattttgaaatgcttttgcaactttgtcaaacattcaccatagggttccagttccaggtaagattgtgtaaacacacatctctttttctctaagtgaactcaaccatgaaacctggacaaaattcatgggcagctatttggtatatgatatcagcaggcagagcagagaagaacaccagaattcaaagtactggtgaaccatctagaagtttgccatttttcccctttagtgccccctgacctgaagtcaatgcaatttgaaacttggaagtaactactatagtttggacagggtaaagtcctctagttctggcccatgatgtggaaaagggaactcttaagctcagagagaatgagggagacctccctcccattttttctctttttcctgaattcactcacccataccccaggcagtctgaagcaggaacatgggcagcagcaaaatggctcacagtgggaagcagtaagaaccacaatcccaagggaagggaatattcctctaatcatagtggagctctggctacagagagccaagataaaccctgttgatttccttcttgtctgtcctcccagctcaaaacatggtacaataggaaaagtgtgtagtttctgaccacatgatggaaaagtagagcccacaaatccagaaaggacctaggagataatggagatagaaaagccttcccatcaaatgttatggggtggggggagggggagggctagcattaggagatatgcctaatgtaaatgatgagttaatgagtgcagcacaccaacatggcacacgtatacatatgtaacaaacctgcacattgtgcacatttaccctagaacttaaagtataataataataaataaataaataaataaatatatagtgctttataaacttctgggatctctcctgagctgcctgtgtgctgatctgatcctaattaacattatcatacgaaagaattggagaactgagctcatagatagaactctgctttgggcccggactgaacagtgggtagccctcccgctgcactgactcaagaagcacttcaaaagctttggatgcattgtgaccatagcctccagatggataaaacaaattatctctctagagaatatcaacattatttataaataatacctcaatccctttgtaaagtcaaggtagcacaagagagatggattaaagggtacagtggaggccgggcatggtggctcacacctgtaatcccagcactttgggaggctgaggcaggtggatcacgaggtcaggagttcgagaccagcctggccaagatagtgaaaccccatctctactaaaaatacaaaaattagtcaggagtggtagcacacgcctataatcctagctacttgggaggctgaggcagaattgcttgaacccaggaggcggaggttgcagtgaactaagatcatgccattgcactccagcctgggcaacaagagcaaaactccgtctaaaaaaaaaaaaaaaaggggggagggaacagggctctaatggaagtagtcattcttaagttaattaccaagtcaaggactatctctcaatgtttagtgctttaagaaaactttcatcaggtactagatctattacctatgcgtatgggaaaggtgacatttgatccctgctttgaatataaaataaattctaggaggaaaggtaaaaacaatgaaatatctagaaggtaatgtaggaattattcttcataacattagaatatagaatggattcttaaagaggacacataaaatactataacaaaattagactacaaaaaaacctaacactttttcttatcgaaagacaccattagcattatgacgagtcaagtcacacagtagtacgaaatatttgcaaactgtataaaagccaaaggccttatattcacactatgtaactcatataaatcaattaagaatagtctgaaaactcctttctccaaaaatgacaatagactgacatacacttcacaaaagaagacatccaagtgtccaacaaaatatgcaagagtgctcaacttaatttttatctgggaattcaaattaaaaccacaatgtaataccattatatacctactacagtggataaaaagaaaaagacaaataataccaaatgttggagaggatgcagaactattcatacttttagtacactagaaattgatgtaatggctttgaaaacaagttgacattatattctaaagttgaatttacatatactctgtggcccaacaattccaagtcatcaaagtcatgtgaaccatatttatagaagcatgttttacatgccccaaactgggaataatcaaaatacccaaaaataatagaatggaaaaatatactcatataatgtggagcaatgggaaaataaaacgattgccaaaggatcaaaataggtaacacgaacatagtgttgaatgatagagacagaaacaaaaaaaatactatagtgttatatttgtaaaaaatttagcaatagacaagactgaagtatggcattaaaaataaatgtgatagttccttttgagaaggagagaatgaattaagttctgtttcttcaagctggtggtttcaagggtatattgtctttgtgataatttattgagctatatacttagggtttctctattgtgttatacattaatgatttaggaaaggttttcaaaataattaaaatttttgtcctaactatatggttttaaaagatgtgcttcaaaaaacatttaatgtaggaagaaacactgtatacattgtcctttgtcactttttgttgcaagtttggaagaataaggtattatccaagtaggctacttgtaataggacttacccaggaagattttccttattagatattagtctttctaatatgccatcagatgaggcttgagactactccattttctgtagagttttaggaaaaaatttaagagtgactaaagatgctctgtagcctcaaaatctgttacagattttgaggttctgttacagaaccgtggcagggaggttaatttaggtactcttctataaatttttcataaatgatatctagtagattttattctttcccagccttcatttaactccctccacgtggctgtgtagcaaaccatccaatttaaatgggatttatctctcactagcttcatgattgtgccaatgccatttattgcatcgtcaatgtttggtaaggagtgggcatgtataatagtgtattatacaagccttggaactgctgcgttcatttttgttcctaagaattaaagaagcctgaaaataaagttggtgcgtagtgttatgcatagtccagagaatcataagaaaatgtagctaggaccctgatcagaccaaacctggaacttttcttcctttggactttgggaagtgtcttagtgtgcttgggctgccataacaaaataacacagactaagtgggttaaacaatagaaatgtattatctcccagttccagagggtagacagttcaagatcagggtaccagttgttggtttctggtaaaacctctcttcctggctctgcaaatggctgccttcacactgtgtactcacatggcctttcctccatgcatgcaggaagagagggagagtatgcaagttctttggtgtctctcctttaaggacattaattatatcagatcagaatcccatgtttataaacttcatttaaacctaattatgtcctaaaggccctgtcttcaaatacagccacactggggggttagggctttaacatatgaatttgagaacacaattcagttcataccagggagtgtaaacttcatgtagatctcttctttataccagtttgagttaggttttctgttacttgcatttgaaataatcttaactaatagtgctcctaaggtacagtaactcttgcttaacaaccctcagaagtttgaccaatttattctatgcgtgtattatttaccacattcagccactgggcttttgatttttcatctttttcaaactgatgacttgaacatataagcaattttttctttttaatattcatatttttattgcattttaagttagaagtgtattctgttaatatgttcgtttgtaagaaaaaatcctttaaatgtcatgaaggtataaaattgaaagatagtttgtggaataacagttattaggaggtaaatttcttcatttcaacacaatttccctgtttctaacatttttcagtgaaatataataatatgcccaaaccatcttttaaaatatgtacttaagacttgacatttatgatcagttaacctcaaattgctataaaatagcgacaatattatctctttttacaattggccaactagattaccaccagagggtatttatttgtcacagcaacctgcattacaatgtaacgttatagcacactatgttacttatattgaattcttttaattttccctaaatgagattacctaataagttccatttttttacattaagaatcctttcaaaatgaccattttatgaataataaaatcaagttattgaaatatctctccctaagtttttatgcttcccttttttattcctgtagctgatatacttgctttttaatgtttgttttctttctttctttctttgttctttttactccctatttcctttgggtggattgtactgaggggtgttgaacctttcagatcttttgatattattatcgtacagcatatttttttttgaaaaagaaagcccaattattcccccatcaatatctatatcatggagcataaaagcttttgcataatgtgataggaaaagaagacctgaaagaaagcagtagatacttattttttctgtgacaaatttgccacagtaccaaattaaaacatactagtgttcaatgatacccattaaaccctttgatttaagagatagagaaaagctaactggaatacacaaacctacaaatatgtcacttaacataataaaagtttacaatgcttctgtgtcacatcaagtccagtgggcaaaaaaggagccagtggaaggtgtagtaggctgttcttgcaatgctataaaaaatatctgagtctggataaattataaagaaaagagtttaattggctcatggttctgcaggctttacaggaaggatggtgctggcatctgctcaacttctagagcagcctcaggaagtttacaatcatggtagaaggtgaagggggggcaggcttgtcacatggcgaaagcaggaacaagcaagagagttaaggaaggagaagtgccacacatttttaaatgaccagatcttaggagaactcactcactattgtgaagtcagcatcaagccatgaaggatcttttcccctgacccgaataccaggccccacctccaacactgggattacaattcaacctgagatttgagttgggacaaatatccaaactatatcagaagggatagcatggaatacaggacactgcttcacatggtcatttaagaaattcagatgatggaaattctgtcattcttcaggtgtccaagattgtcaataaagacggagactctctagtagtcaccaaaggaagaatataactttttaactatgctgaataaatatgacaaatatttattgtttgcctgtttgttttgctttttagcaaagcaagtgttcttaaactgttttttgtttgtatgtatattttttaagagaactgtcacttttgtttgcaatgtaatttattagaaatcaagaacatttataaagtattaccctatataaggataataatgccaaatgagacattcagtattagaaaaaatgatgttattcaaatcaatttaaaaaccaatttagggaggctgaggcaggagaatggcgtgaacccgggaggcggagcttgcactgagccaagatcacgccactgcactccagcctgggtgacagagcgagactccgtatcaaaaaaaaaaaaaaaaaaaaaaagaaaaatcatttatttagcaaaaatgtattgacacctactatctcccaagtagtaacatatattttactggatttttgatatttactggagattatgagaatattattttaaaaatattttcttacactgtttattgattttagtagccaagtttctacgtcacgttagctcttttactgctaacctaataggaattaccatagaaagcatctgacacaaacccttaaagtgtataactccttgtttcaagaaagtgagattatgaaaattgtatattttatgttgtccttatacatcattacaaaaacgataatcagttgagtcataaagtttagataagaaagaatttaagctcctcatgagaaattcaactagtattcccgtctcaaactgaatctttattatgtaactcttaaggaagaggaatgttgtgaattattaatcatataaaaatacattttggtatttaagttgtatctactgaatataagtaacttttctatatacactattatttgctacgacagattttctgaaagaaactgttgacaggatctggtatctggatgtaagggatgatataattgaaatgtaaattgtttttaacattttagctggaaagtaatggtgaaacagagaagtcaggggaaagggaagaacttgcaatttaatactttgaaccttagacagtttacttcaactctctgtgacttagctttcccatgttttaaatgaacacatgacagtatgcttgatctatcacctgtaattttaggaattaaacaggtaattcatgtaaaacactcagcatagtgcttggtacatattactcaatagatgttagttgcttttctaatcatgaacattattaatggttcagcttggacatggtaggtttgaggtgatattaatatttgtatcacagttcttaagggtatgatggtctgactgaaattcagaaaaatgaacccttagatcatatctaaagtgtccattctcagtaccatattttaagagttacattggccaggtgcggtggctcacacctgtaatcccagcactttgggaggctgaggagggcagatcatgaggtcaggagatcgagactatcctggccaacatggtgtaaccccgtctctactaaaaatacaaaacaaattaagtgggcgtggtggcgcacatctgtagtcccagctactcaggaggctgaggcaggagagttgcttgaacccgggaggcagaggctgcagtgaggctgagatcaccccactgcactccagcctgggcaacagagtgagactctgtctcaaaaaaaaaaaaaagttacactattattccaggtataacaagagaagtataaccactatgataataattcagactagagaagggttcctcaaccttggcaatattagcattctgggctaggaaaatgctgttggaagggcgacctatatattgtatgatatttaagtaacatcccactagatgcctgtcaagtgatgaaacccaaaaatgtctctagatacactgccagatatcgcctggagaacaaaaacattcctggttgagaaacactgtacttgaggcaatcctgcatacaagaaaacctgtatattctttaaatatataaagaagttttagcatacagcagactgattttgtttaacctagaaggcagacacagcactggttgataaaagttagaatattggccaggtgtggtggctcatgcctataatttcagcactttggaaggccgaggccggcagatcacctgaggtcatgagttcgagtgcagcctggccaacatggtgaaaccccatctctactaaaaatacaaaaaaattagctgaggtggtggcatgcacctgtaatcctagctactcaggaggctgaggtgggagaattgctgaaatctggaaggcagaggttgcagtgagccaagattgtgccactacacttcagcctgggtgacagagtgagactccatctcaaaaaaaaaatatatatatatatatataaatatatattttcaaaatttgaattaactagaaagagaatgcactaacttgtcagtcagcaacttctcagctacaatgagtatttaattaggtgctggatcactatcagagctgtactgggaatttccttcctgggagggacttgaaactaagaaatcttttatagccctttcaaggataagatgctctcattttgacaggtgtaaagatgcagatttggaaatcatttaaattgaggtcgtagttgaaatcaggaaaataactgagctttctctttgggggcaagagaaaagaagagcacaattgcatgaagtgaattttaaggaatatccgtaatttaaaagagggaatttggaatgtaacctatattcatttaacctatattaggttaggaagtattaaggaaaacaaaacaaaacaaaatgaaagaaagtattcaggagagagttttaaagaatgaatgattggtattgtcaattgagaagttaaagtctgataatagagaaagcaccagtttatacaatttctagaaaatcatggtgactttctgttgaaagcaaattctgagaaaagtgtcccctaaaatattgaatattacataaagggtgctatgttaaaaaatcacttgtatggttggaaaggttagtatcactgactttttaaaaaatagatttcctttgattctggaggcgggattagagaatggatatggaaacagagtgattatgggatggatagtgggcacacttagagctgccagcatatggaaaggaaaaaagtttgaggcttaagtagctggatttgtattttggtactacgacttagtccgtgtgggactataagcaattaacttcaaaatctctgaggactggattcctcttttctcaaataagaatagtatatactatcttgaaggatttctaagactaaatccaatcatcgatgtgacgtactagcacagcatctggaatgtgcgcagcactcaatggatagatgttaaaattgacattgttgttatcgttgtcattgaaggatattctaaggtcttctgcttcaaatgaggcataggcaaggagaaaaaatatattgaagacttgacaagagtggaaagtgtcaaaaattgccactgcttatgagtgacttaagtgatgaacacaatgattaaggatgagaaccaggtttttcttgtaatgtccagtgaccagcgaatttgtagtgtcccaggtctgttcacttctgggtcttctcatagcataatctatgaccacagagcaaagaaagggaaaataaacagtgatacagggttgagattgattaatgagattcatgtaaatctctgtcattttgagatttgtcaggcttgagttacttctaacaaagtaccctgcattatcatagtttattgcatatagtacctaatatattagaccacatgtatgaacattgtaactgacttatttcttaaagtaaacattagcatatgccagggtttctcagcctcggtactactgacattttgtattgctgatcctttgctgttggggacagtcttgtgcattgtagaattcttgcaacacccctgcactcctctcccagttctgacaaacaaaaatgtctctagacattgccaaatgattgccaaaagggttgggaaccaaaggttattttggttatttaatatgttcatacataaaggttatttaatatgttcatatataatatgttcagatgtaatttaatatgttcatatataaaggttatttaatatgttcatatataaaatagtgataaaaataatataaatgtacatgtgtgacgtttggatttataaaatttccatattttataactcataatagcaattctaaatagattttggttgtgatttctgttgcttcataagaccaatgtaattataaatttacattccttctgacagagaaaattctaaatattgaccataatctatagcaagaaatataaatattttttctacctgtacattttggttttgagagaacattttaagcattggaaatttatcatatttttgattgtttacctagacaaagttattacttatatatatatgtatttgagtctttcatgtactgttttttcattacatagttcaaataagttttgagcaaaaattatttgtgttttattttccagttgtttcctatccttattgctggtggctgctgtggtatggaagatcaaacaaacttgttgggcttctcgacggagagaggtatcagtaatattatttaatcttttgtttaaagatttaagcaaatatatggatctctattgtctgttaattaccatgctctcttggaatgcagaatttcaaatcatttttacatactaatattcaaaaatcactctagtattttttaagctgtagagcaaactttatcactgtaattttaagttagtatttgtaaaagcattggtttgttgcaaacagtttctaaaaatggtattggaatttatagtgaatacaattattatgtttaaaaaattttgtaatatatttaacaggcatttagttatgctataaagacatactttatttttcataagcgtctgttgaaatttaaaattctgagtgataaatatttatttttggtttttgaaaaatattttatctcctagaaatttattataacattctttttttgggaatcaaatcttttccattttctgattatctaataatccaactctgtttaaagagcacatccattggataaatttctgtattagaattatttttctcgtaatcctaaaattgatgaaaacaataatattcttacaaaataacaactgattatataaattgtgtatattcgttaatcgaaaggaacgaagaaacaaaatcatctgaggagcaaaagtatgcagtagatttattgttcatacctcatttattcaaaaaactagtttctgtttttatcagtattcttttattataatgtattctattgtattaatcttaatattttatttgctattgcatttctccatatatttctatatggatggtttttgtaacaatataaaacaacagtataattgcttaccttcttttttccacataaaaaatataatatttaaagacatgtaaaaataatccagagtgttctaagctatagaattagtgagtgatatgggttcttcttagtctatttttaagcacccatcaaagatcagtactatctataatatatttgcaaactggagtccctccctgtcttcaaataaatcattcatcttaatactctctgcctctctgattttctgtttatggccagtgcagcatcagtgagggtttacttggaatgactgtatgttaaaaagtaatcccatggaaaaagagcttattaaatataaatatataactattaggcaggaagtggaattctctgcagaggtaaacaatcttctagacatgttagatgatctattacagtaaaattatagattcaggaaggaaaaatcataattataggcaggtagtgtgaaggccttccttccctaatggaataaggcaagtgacaatttatgtccttaatcattagaagagaaggctgaatcaatcagggagcctctgttcccattgcatcctgaggagcactatttaaatatctgatctctaaaatttataaaatgcatctatgtaaatatagcattgtgaaaatatcaatttgtaagtaaaaaatatctgccattaactggcagctgaatgtaagtaagttgtctagttaaatttccttacctcttaaaagaaggatttgtaccctagagctaattctcagttgtggtctagtcttttgagccctataaatgtttacatgtagtagctaaagtttagaaatgatatttaatatttgttaaaactaatatgaatagtttagctataaaactttcatacttctcaaaatgacaaattgattttggctaatattgtattatctcagtgtagtaatgctgtttattacatactaatcaggtgctctggcaagttgatactacttcaatttttaaaatatagatataaatttatcttttggaagtcaaaatctttcaatatatgtggtagatgtggaaaggataaaagacaaatagtagaggggagctagattaggatcactttccagtttttatctgtattattaatattactgtgttctctggaaattcctttaatataatgcccttctttccaaaactcatccaggtagtgcttctttctattaaagtgtataatagtgtttgcatttaatttgctactgcttccgaaaaagaaaatgtatcttgagggtttatgttatgctatagcattacatgttaaaacatattttgaggaattttctgaaatttaattttactaaattcctttaaatgtaaaattctaaatgttatagaaactattcatatattgatgtccaaagtaaagatgacattgtctttgatgattattaaagatctgcaattagcaagtaattttaatattacaattgtccccccttatccatagtttcagttagtcaaagacaattgcagtccaaaactattaagatattttgagagaaagaaatggtgggggaggtgggaagtgacagagagagagagaccacattcacataaattttaggacagcatattattataattgttctatttcattattattgtggttaatctcttgctgtacctaatttataaattaaaatttatcattggtatgtatgtatagggaaaaacatagtatatatagggcttagtagtatccacagttttaggcatcctctgggtgtgttgaaacatatttaaaggggaactactgtgttaagaaattgtttttcattttggtcttaagagccctggagatttttaaccacactagttgtagttatgtgataattccatttatagactttatgtgagtggaggtaaaaatgtgtttatatctaatcctctctttattcagttttaaatattagattaactgtaatatttcccaaaggaaaagaacccactattatttctttatgtgaatgttactgtctcttcaaaacattgaagaaatcaattattgtaaagctcagaggacacctttgattagtaaaatgacagtttatctgttacagtaaatgaaagttacttaaaggattcttcttagaaattatgtagttttatttcagcagttatactagttgcttttctaaatgtaatgaaagtttaaaatgaaaataatctttggaaatgttttaatatattgtgttcattcaactagatgtgttactttttaaaccaaagttttgttttctcataaacatagatatactttttgtggcataattttaaattcagaggatagttagtcatgttatgacttttgaataacacccctgagaattcaggggctcttaaacacacattaaaaaaatgaaactacacacaaaaggcttcaattttgatatgaccccttcatacactaaccccaaacaaatttctgtggtgttaaaaagatgaaaactttcttttgggatgcgctaatgaatggaaacaataagtgtatattgataagtggaaatatttacactagaaagatgaattcatttatatagcttgtcctttttacagcggtattaaaaacatttagcttcaatggcacattcagttatagtcatcacattactgaaatatttgtcaggagcaagtatatgtaaaaaggagtctattgagctatttttatgcttgataatcttcattcttaatctgaaatttgaatattaataggtatcataaggcagaaaaatatgaagatattataattgttccctgcaatgaagatatttgatcatatatttggctatcgtgtgaaaatatgatgcatattttaatagttacaagaagttaatttttttccattttgagttgtttaaatgtagcatgtctctgtgaaactttaactgcaaaatctgtagaataatagatccataggcaaaggaagggttatttttacattaacttcatattactagtgagtctgagtatttgaataatctctacatttcatgtgatagcaatttttccatttttaattcttgtaaatttacagtttttttaagtttaaaaatattttaatgtagaactttaccacactactttttaatatttctcacatattacacttctcttctgcttcaaaatgaatacaggaaattttggaggataagacatgcccaatgagggattgaatttatgttcataataccctatctccctgcatattttgtaatcatgaagaataaaacttagatttgcattttttattatcaccctgaaatttgagttaaaaataataaaccaatacccacaagtagaattttagtagctttgagtaacaaactggttttccagaggcaaatacattagttctttccttctatacctgttttactggtacaaatccagacaaaagtaataatattaaactgtactttaataatgacattttatggtgtataaaccaattagttataaaatattctctgacgcagtgataaatagattctcatctaagtaatattaatgcaatgtagcagtgttttataaattaaactactcttttctccttagacactaaatatatttacagaaagaagattcggcacagaataaaaacattaaggaaaatgtgaaagtgttattttaggtggataaattcaaattaactgataaggtactgcctgcaaccttttgtagaatttcatagcacttcaaagttctgtattttgtaaatgtttaaacattttaacatatagataaagctttccattaaacacatgctttttaaaactcgttagtaaatatttcactcaaataaatgcctttgcagttaatggccacaatgtcaacttactgttgcttgtcatttgctttttattgaattgcaaactaaaatgattattattgtattaattttcttcctttatcctatgagactagaaattacaggtcttccgcatgcctattgcattatcatactttcaaaattttaacataaatttactttaaaataacttgagaagtcaaatatgtatgcagttaagatttgaaaaataactgatacttaccttgtaaacctgtttccaaagacttcatggtaaatatagtgctttcattttgctcagttcaacaaaggtgtatcaatttcttgctatattatagacaaattgataaatactgaggatataaagaaaaagatataggccccattattggggaatttgtagttttaaaacatttcaataaggcagacacacacacacacatacacgtgcaaagttcttaggggagcacctggatttactttattgtgatgtcatgcatagggagatagaatatatcgaaaagttttctggaagtcagattagtaatggaagtaaatgtgaactgtttcataattatacacaggattaatttcaaaaaaacccctaaacaaaaaaactttgggcactgtttttactgtatatacaatacaacaaatttgtctaaaatcactttttctttattatatgctattatctttatatttagacccagttacttagactaaaacattatattgatttattctaaaaaatgtagtctcgctaaccacaaaatcttatctgtattatatattcaaacgaatgtatatctcgatatatgtgtctgatgtttatgtgtgtatatgtgtttttatgctaaaaagttcattttttatctaaaatgcaaacttaaccaagtgttctgtattcttatttgctcaatctggcaaccctattttcaacacaaatgctcaccctggagctcaggggtgggttcaacctcataaaatccacaggaactcagagagaagtagaaaggaataattttctaaagttagaatcttgatttgttttcaaaataagggggagttatactgggcaagcaaaaataaaagatgtttactccgtatattatctatcaaaattaaaaactctttgactcaatggttagatttctgaaaatatatcttaaagatatatatctgcctagcttttcaaagtatactcatatatagacacttacagagagatttttgtatatcagaactatttcatatcattcaaaaagattcgagaaagaaattctgtgttcttacagtgggatattaggtaactgaaaaaaagaatgaggcatatttgtgttaatattaaattagtttattccttcaacaaatatttattgaacaactattgttgtttcaagcacatttttagacaaatacagcaatgaacaagccaaataaaatcccagccctcaaaaatgtttacagatcttaaaatctatattattaactggaaaatatatgacatagtttgtatgatgtttctatttgtataaatcacacatgcacaagcataatgtgcatggaaattgtgggtctgttggtatttgataaagaagattgactgtgttatttgataactataatataaacaaatagtcaaataatgggcaagttgagagaacatgatctaacattttaagttaggcacttaataaaaatagtatttaattttcacactaaaaatatatatatttgccctttacctatataaggaatttgtggagactagagtgcaatgctcaaagcttacaactagtaaaagaagaagctgtaacttaaaaccaagtctgtcagaccgaaccatacagagaactttagagatagcctgagtttgaacaagttggtttcataatggaccacttataatgtaacttatgcatctgtttgttgtactggaaatatgttatatttcatctgatattatgacacaatcattatttgatgtaccacttacgaagaaaacacagtacttattcaactattgcacaatgttcacttcccactcagaatatttattttctacttattgaaagagctcttatatgattatttagatataattttgtcatatgtcattcatatttatacagagaggaaaataaaagcaaaataaattgggtaaagttttgctacgacttattcaccttcatagtccaagtttttaaaaatcactttttgagttaagcaaaaatatattgtatgtttcacatagtatcattgactagaataatgaagtttatgtctgtgcagacaatgaaaactacatcacaactgtcatctggccagcagtgattatataatgtcattgattttaaaacacattagagtttagagatattaaaatgtgaaaaaatgtttcttagaatcaatcaaatatggtagaaccttctttataaggtgtttagtactaagcgaattaatgcatactaaggggttaccccactgcattttacctaacagacttcaataaatattagctgttattgatatgtaatataaagaatgatcagcattatacattaatattactaacaacaactcctgtatatcttggactcctcctccatttctactgtaatgcaatggttctcaatctagtaggcccttgagaatcacctgtggatctttaaaatgtgtgtgtgcgtgtgtgtatctgtgtgtatgtgtgtatttgcatgccattctactgttccatccccatcagatatacaaaatcagaatttctgtgagtgaggctcagccaagtgtgtttattattaaagccctcaaatgttctaatatgcactattggcctagaaacactgctttagcttctactctgacagagctgggaaactgtagaagggtttccaacaaacttgtaaagatatctgagttaaaaggatctgattttaagctgatcactgtgcttctgtgttcactccaagtaaaattggtttatggagaggagttaaatttttaatgttaagtttggtacatctactagacatctaattagatctatcgaagaggcaggagttgcatctggcatgaggaaacagagctgagtaggaagctaaatttgggaatctcagcacatagatggcatttgaaaccctgagcctagataaaattacccagagaggaggattaagccctgagacattcaaatttaagaagtcagagagaagacaagcacccagcatgaatactggaaagcagctaccaatgaaggtggagaaaaaccctgagcttctggaagccaaggaaacactgtataaaaaggaacagagttatcagttgtctaaaaaattctggtggttcaagtgaaataactgaaaattgaccattgtatttagccacttagaaatcattgctgaccccaacaacagcaattttagtggactgatggatgcaaaagtttgactgaagtttgatgagaaagaatggaacaagatgacttccagaatggcagcaagaggatcccctgagacctattctccagacaaacaacgctaactagtgaaaaaatctttaaaaaacaaacaaccgactgggcacagtggctcatgcctgtaatcccgacactttgagaggccgaggctggcggatcatgaggtcaagagatcgagaccatcctggcgaacatggtgaaaccccatctctgctaaaaatacaagaattagccgggtgtggtggtgcacgcctgtagtcccaagtacttgggaggctgaggcaggagaattgcttgaacccaggaggcagaggttgcagtgagccgagatcctgccactgcactccagcctggcgacagagcaagactccatctcaaaaacaaaaaaacaaaaaaacaaaaaaaaaaaaccatttaaaatacctggaaatagttttaagtgcatacggaaaacaaagaaacacttgttactggtggagggtcttgagtatgagttgcccgggtccttggagatttggacaaagtattgaacaaaatgcacaaagtagcagaggaatgaaatgcagcaaagaagcagcaaaagcagaaacttattaaagagagaaagcactccacagagtgggaggaggcctgagcaagctggtcaagggcctggatgcaaagttttctgggttttaagtacccaatttgaggttcttattggctaccccttatctggaagaaggttttgtctgtggctaaaggctgaggtgaattggcagcccatgcagataaagggatggtccctgctcggcctgtggcctatccaaggcactctccctttccatctgagatgtggcggaagggggagggctgtagggagagtagcttttgatcctttgttactcagcttggggagagggttctttttttctttttggtttagttttaggaagtttgtattaattggcctcaggttccctgcccccaaacctaggcgttttccttttgatccagctttgggaagtcagcatgaattggccctagattttctgcccccagaccttggtgttttctgttttagaaatttgctcaaattggccttaagttccctgtctgcagaccctattttcctgcctcaaacttatttaagaaaatctactaattctcagtaagaacagcaaatctatagcatttgagcctcaacttgctcccttcctacccccttctagctcactgtgactagcacttctcatccccccagctcccttttgcagatgctatattccagacaaaatcagctgaggcctgaggctctcttcttctaatgagccccacttgtatggcaagaagctcttctcaaggcatagcagcctgataataacagggacccagtctccctctctccaccttgcttatagggcagaaatttcatgactggcgagataatatgagaatataaaaaagtaacacctctgctcaacaccctgctcatgaagcaggaacattatttaagagagttatgggccactgtccccatcattagctctagagcttgcacaaactagcaaaatcaattcaaaaagataaaatctaaataaacctatagcaagcacagagattgcatttgttatttttaaatttccaattagatacatcaacattctgtttgcaacaagcacatctagcacccagatcttgttttctaatattagagaactctttccagtggttcctccattcctgacatactctcattcttggtgtttgtgtgtgtgtgtgtgtgtgtgtgtgtgtgcgcgcgcgcacgcacgcacatgcgcaacccttcttacgttttggtaccataagaaacttcaggtttagcttgtacacttcttgccccagtcctagaattagctatttctccaaggatctctggttccctttattttagcatacatattgcctagatcttgatttctaaataccattcaccaataaaaggagcttggatgcaaatcacatgagaatctcaatagatatagagaaagcatttgacaaagtccaacaaccttttaccataacaacacccaacaaattaggaatgaaaaggaaatcctcaacctgataaaaggcatctgccaataacccacatctggcatcatacttaactttttttaaatcacttatatcaggaacaagtcaaggatgtccactctctctaattctattcaacattttactgtatatagtagtcagagcagttaggcaaagaaatgacataagagccatctagattgggaagaaagaagtaaagctatctctatttgcaaataacatgttttgtaaataaaattctttagaaatccactaaaaaacctgttagaactaatacacaattttagcaaggttcaggatgccagagcaatataaaaatcagttgtatttctatacattagcaatgaaaaacctgaaagtaaaactaaaaacgaattcaattcaaaatagcatcaataagaataaaatacacaggaacaaacttaacaaaagcagtagaaaacatatgctatgtgtattagtccatattcacactgctaataaagacatacccaagactgggtaatttgtaaagaaaagaggcttaattgactctcagttccacatggctggggaggcctcacaatcatggcagaaggtgaatgaaacttattcactatcatgagaacagtatgggagagaccctccccatgattcagttaccttccactgggtccctgctatgacaggtgggaattatgggagctacaatgcaagatgagatttgggtggggacacagcaaaaccatatcactctgaaaactataaaacattgttgaaagaaattaaagaagacctaaataaatggaaagatactatatgttgatggattcaaagactttatgttgttaagatgacagtactcccaaacttatctacaaattcaacatgatacttatccaaatactaggtagtttatttgtagaaattgacaagtagatcctaaaatccacagggagaggcaaagggccctaaacagcaaaaacattcttgaaaaagaacaaagcttacacttcataaattcaaacttactatgcaagtatagtaatcaagatggtgtgatatggacataagactggacatttggatccatagaatgtaactgagaatctagaaataaactcttacatttatagttgattgatttttacaagggtaccaagacaattaaatggaagaaagattcatctttgcaacaaatggggctaggcaactgggtagccacaagcaaaagagtgaagttggacccattactcgtatcaccatacacaaataaagtcaataggaatcgatacaccaatatgtgacacctaaactataaaactcttagaagaaaatacagaagaaaatcttcttgatctttcagaatcttcttagacatgacatcaaaagaaaaggtgattaaagaaaaaaaaattggaattcattgaaattaaaaacttttgtgcttaaaagacaccatgaagaaaatgaaaatacaacctccagaatgggagaacacttttgcatatcatatatctgataagatatttgtatctacatatgcaaaggactcttccaagtcagtaatcaaaaggcaaattacccacttaaaaatgtataaagaatttgagtaggcatttctccatataatatatgcagtttgccctttgtattcatggtttccacatctgtggattcactcaaggattgaaaatattctgaaaaaatgttgaaaaatataacaataaatataaataaaaatacattataacaactatttacataacatttgcattgtattgggcactataagtaatctagaaatgatataaatgggaaaatgtgcataggttatatgccactatgacaccatttttaaacaatttacttgagcatctctggattttggtatccttgcggggatcctggaaccaatctcctgcagataccgagggacaactctgtgtgtgtgtgtgtgtgtgggtgtgtgtgtgtgggtgtgtgtgtgtgtgtgtgtttgtgtggtcagtaactcatgaaaatgaaaagatgctcaacaatgttagcattagcagaaatagaaatcaaacctacaataagataccactaaatgcttgtgatcgataataatgttattattattcaccaataatcatcaccaattatcaccaaaatgttggtgaggctgtggagaaattagattcctcacacattgttgttgaatatttaaaactgacactttgtagtgtaatacactctgacaattccttgcaatattaatgtttccatatgacccagcaattccactcttaggtgaatactgaagaaaaatgaaaacgtaggtctatataaaacttttacgttaatgtttatagcaccattattcattacagctttaaagtagaaatatcccaaatgcctaacaactgatgaatggacaaataaaaggtgatatatgtgtaaatggaatattattctacattaaaaaggaatgaagtactgatgcatgttataacaaagaaagatccttgaaaacattaggcaaatctaaagagacagtaagtaaattcacggttgccttgtgctgtgcttgggtatttgatggaatgtggggccagatggagaatgattgttaatgggtacatgggttctttctgggatgatgaaaatgttttaaaattagactgtggtaattgttgtacagctttatgaaaaatttaaatattattgaatcttatgctctaaatgggtgatttacaaatttctttgtagaaattgacaagcttctttgttgaaatggtttggctgtgtcccacccaaatttcatcttgaattgtagttcccataattcccccatgtcatgggagggacaagatagagataattgaatcatgagggccgtttcccccatcctgttctcatgatagtgagttagttctcttgagatcagatggttttataaggggattcccccttcactgggcactcattctctctcctgtccccatgtgaataaggatgtgttcagttccccttctgccatgattgtaagtttgctgagtcctcccagccatgctgacctgtgagtcaattaagccgctttaccagtctcaagtatgtcttgcacaaattgggcttaagttcataaccagtgtgagaatgggctaatacatttctagaaattgacaagtagattcaaaaacttacatggaaatgcaaaggaccctaaatagcagaaacatttttgaaaaagaacaaatttacagttcctgaattcaaacttactacaaaactatggtaatcaagatggtgttattatactacacagtatatttcttagttcttttgtgttgctatgaaagaacatacctgaggctgggtgatttataaaggaagaaggtttatttgcctcatggttccacaggctgtacaagaagcatgggaccagtatctgcttctggtgagcgcctgttaaagcaacagtgtaagattctttatattgcataaattactgtggaatgatagtaatatagtttccctgaattttgttgacaggatttgacatgttaaaagttgagtttgcaggtgataatgctacctgcattccatattaacttcattcatcattctgtaaattgttgcttaaaatatagaatttccttcatttaaagaattatgccataatttgcacatccgtgctgagcaattctcttcctaccaccacccacctccccttacaggggaatttgtttgctaggtatatactgttaacaggcatttatatacagatttaaacctaatacagaattcagcagtatgtattttatatataaagtttcttctcatgagcttttaaaatatattctactggttctaatttaaggaaaaaaaagctttaaacaaaataattttattgtgatttgaacatagttataatgctttattaattttctgaaaataaatttagtcatttaacaatacatagttgtcttagtaactattttgtattttatctcagaataaaaatatgtttgcaataatagcatcctgaataattggctttcacaataattcaaccacattgtaaggaacatggaaataggtaatatattgaatgacagatattgtgcatactccatcactagcagtggttcactataacagtgattctcaaccaaagaggatatcttaaaataatataattagaaaaaaaggcctagtctggttgattttgatatcctcattagataagtaattctgttctcctcatgtccaagaatcacatctgtactggaaatcatgctgaactggtgttcgacctgtactgtccttatctataaattacagggtattcctgctgcatagtatatttatttatttttaaattattttgatgccagcataattatggtctaatttagtttattgtcattcactgaaatgattcatgtactttaattgtgatatttaggtaaaccattattagagtatattgaatgaacatggtattagattcatgcatgaatgtaatattgaaaatgttaactattatagtatattaattatttccagtctgaaatccactgttactatattgtaacaattatgaagcattgtaaccagtactttgaacaagggcagtcaatcaaagcttgattctgtattcccacagcccattcaaactcattttctgtggccaatttgttctagttccttgagtagctagaattgaagataatttttttcttatatctctttttaatagatgtatgtttttcctttccttggcaatttggtattataaaattttattctattaatggaagagatttttagaagtcatctcctctttattggaaataaacatggaaagtttgctatcaaatcaagcattatttttataccttgtacatgttttcatatctatttttaataggtgatatgtctatatgtttcagagttcaacattgccaccagcattacccacccactcaattattctctcctctctatagccaatcagtgttatcagggcttttttgtgtgtgtatagttttctgaagttattttatacatacagaagcaatatgaatatacatctttttctacattacttacgctaataatagcatattctttataacctgtttttgtatatttttgcatgtaactgtaaagttctaataaattattataattctgaattattttgcaacataaaaaataatatttcacatctattgatgagaagtcaaaactgtacaaacttattttcattatagtcacattttgaacactttatatctttatttctctttactatttatttctacagtggagcatttctaatgcacttagaatattcttttagagagatatttttaagaattccaggataccaatccagctatgtaattctgagaaataatttttagaaccacactacagtggagtacctctcaaaaactacatggctctaactcaagtttataacagtaatataaggaaaatgactgagaatttcagtaggaaatttaagatgcagcaagctaaattacagtcttagagaattaaattaaaatgttggcaaactgctttagatcatgttataaattctatgaaatatgacaataatgtaaaataataaaaaaaggcttctgctactttttccttcatttaaatgaatgtgtgtgtgagtttgtgtgtgtgtgtaactgctttttatgttggtgtagaaagactatgtaattgcatggttattatgttatgcaagtatacatttgtaccatgttattgtgttgagtaatggtacagacttacggcattcaagttctggctttctacctatgcatttatagcaattaatatttattactttggtcctaatggcttgctttggaaattaacttagaatgacttagaagcacacactcatcaactactaatagcttatggtacaatagcatccaaatttcaaatctatacttggtaagtattttcaatcaaactatgtaagattataattaaaaactttaaaagtcgttatatattttgcaaatttaccatttgattatttttattatttattattgccatcctaaatttttctactagtataaaagtatattttgttcttaaaaatgccaagttattgccataaaataacattaatttccatagacgtacaggttagcaagattctactcagtctatttctctaaaattgtttgagtaaaagtgttagcttcttatttcttatttctattcatgctgaagtagtgacattgtgaactccaatgacatctataattggtaaattatctttgactttcagaaaacacataattgtttaaacaattctatacgatagctatagttttctttttttcattcttttttttattattattggagatggtgtcttgctgtatggcccaggctggtcttgaacacctaggcttaggcagtccttctacctcagcttcccaaattgttgggattacaggtgtgagtcattgcacctgggcaagagctgtagttttctaatcaaagtgcaagaaatatgctattcttagaagctggttttgtgttatatcatttaacatgaaacacgtatctcctgtagatgtggacaatttattattactttcagaatagttatttgcctaacagaagagctaacataaattaagcagtaaatcagttttgcttcctttagataattagtaatttacatataacctttggctattcttttatcttaggttattgatataagttgcataaaattgttttctatgtagaatgttctttgaaatgcaaaatctaattaaaatgcactattttaggacagttgagttgctaaatgatattacggagactattatgaatattttaggaatctgagtggagtatgtaagaaagctaaattataacctctatggactactttaggttactttatcagtcggctgaaacaaggaaaactgcccaggtacttagattattggatttttttacatatactatatttagaaataatgcaattatgactgtattatgatacctagacagtttcacattaagttacacattaatgtttgcaagatacactaaggttagtaaaggaggctaattgtggctgtagttattctgcccaggggctttcacatgcaccccaggaggctgctcaaaacaatgagtatcaacacatttataatcacttaatggcatacttattgatgaatcatattccaattactaacaaccgaaattcagttttgtggaaggcatggtaaatgatatacctgtttgtccagccaggacaaacaatgagtatttgtcaagagcctcctgtttgcttaacaaacattgtttagcaaggacccaatactgggtaaacaactgttgcatttagttttcaaactgaacatttcttaattttatagtgaagattgagtgtagaatcttatggtagctgtgaaatggtatgtagctaggtgattattatctagaatcttaatgtattaaatcacagtttagtgacgttaatattttacaaattaaagataatgcttttttagactgctgtccttcttttcctttaatatgtgtggtaaagtgaactactgtgttttaattactctttgatgtgtattgggataagtttttctaaatgaaaacatatctcattttgtcctgaagattaattcaaaattagagtttgcctaatgaaaacttttccatttaattttgcagatctattttatgcagaaatttatatcaattaaaagtacatatcacatgatttagccagggatggcatgcatgctagcaacctattaaaagatgaagaattgttaagattcatttcacttttgctgtctttgttgatagttttagtcttttactccaaaattttaatcatatactgattcaaattctatgttgatttgtaattttagaataatgcaggaactttttttaaattttgttaaaatgtacttattttgaatgtttcctaattagtgaattacctgctcattagtgaacaactaggaggtattttaatagcagttagtttaatgagaatggtgaaaaccaaatacattctccaaaaaatcttggcaaggagaataatgcataataagtaacagtcacaatgtctatgatctctttttgtttaacctttataaaacctgtatagttttgctacctgatgagtgaaatatttggtggtagcctgagtactgtcatcctttatctagttgttattctacttaatacgtctaattattgtgcttagaattacttattttttcttaatataaatgtttgttggatttcaaatgaaggtgactttgatgctgaaagctgacagttaatggtaacagtggaataacgttttatgaatgtaggtacgtagaatcatgcctggcagaagctattgtcatacatagtaagtggccagtgctcttttgttcaggctattaaatcatagtgatatgtgttatttcagctagaggaaaaagagaagtccttactcaatattgaaattcacaagatacagaataaattataattggtttcatcttttttatgttaaaaatttaatatttaaagttaatttaattatctgaatacaggaatgctaaacaatttaagtatatccattgaaaagaggatgcccaattactaaagctatgttctttttgctttattaaagattttaaagccagcaacatcactttggtagtgatattttcaggtaatattgatcataaagcatatatattcatgtctacatgaactggatattatcttaaatgtctttgccagaatttagattctaaatataaagctctcagcaagttcttaatgcttggaaaaaattcagcttttgtcttagcaagaatgtgaggtagtgcataaaaaacaaatgtaggttcttctatactagatttttaaaaacgaaatttgattttggagtgttaggttttatttcaatttaatttaatttttaaaataagtaatatattaacataattcaaatttaggaaaaaataaaaagttataaattaaaaagtttcacatttatctataacctagtccacactttccctccctgccttcatagataaacacttgtttattatctatccttccaggtttcctttatcaggatgttgcatattccaatatcaacatatgcaaatgtgtaaacatgtatccctcctttattatacaaaaataatatatttctgtatttcgttaaacctgagttcagacaatttgcacaacatttttgtgtaccaccaagaaagaaaaaatcttggcaattaaagggtgacagcattgattataaagaacattgcaatgttagaaatattagaatgtgaaaaacctcatctgttagagttgaagaaatatggtatgtaccctctactacatattactcttgtcacttatcaatataacttggatatctttccattgccaacctcttttgtttcttttattataaatgcattctattttgtagtatgattataccctaacttatttagtccctataaacagactcttgatgtttttctttttcattgttatgaactttgtacattgttcattttgtatgtgtgcaggtataattataggataaattccaaatgggattgcttgcttaatggaaattatatttgtaatttttatagctatgagcagattaccctctgtagggttttaccacattattttcctaccaactgcatgaagagtgttttgtcaaactttggatttttgctacctgctaagtgggaaatgatgttttaaagtggttctgatttgcacatcttgaagaaaagcaaagccaaaaatattatccagtgttcaagggtggtattttctttttctgcaaactattcatgtcctttactcatttttcaattagattgttaatctttttattctttatttctagaagctctttaaccttgagtaggataactgtttgtctctggtatgagttgaaaatattttttctctgtttaccatttaattctttaaatactttttttttttttttaacaatgtattactctgttaaagctgctgtaacaaaataccataaactgggtggcttataagaaacagaagtatatctcatacagctctggaggctgggacgtctaagatctaggcatcagcagatttggtgtctggcgaggggctatttcctgattcatagatggcaccatacagctgtatcttcacatggtgaaaggagctagctagctttctgctggagtgcagtggtgcgatctcagctcactgcaacctctgcctcccatgttcaagcaattcttctgcctcagcctcctgagtagctgggattacaggtgcacaccaccatgcccagctaatttttgtatttttttagtagagatggggttttgccatgttggccaggctgatctcaaactcctgaccttgtgctccaccagccgtggcttcccaaagtgctgggatttcagctatgagccaccacacctggcctctgccatctcttttattaaagcactaattccaatcatgagggctctgccctcataatctaaacacctccccaaagaccccacctcccaacaccatcaccctgggggttaagatttcagcatatgaaattttgaagtttacaaactttctgaccatagcaaacatgaagatatatttatgcttgatttcaaattttgtaaacttcttttatggtttctggaatttgagtcataggtagaaagactcagcttacttcaagtttacaaaggagtttacccagttatggcttcatttttacattttgtgtatactattagcttggtcaccccccagtgacctcagtatccagattttcatgcccatctgtactctctgtattgactgtagatgggggctatgaatgctttgaccagtcaactgtggttggagtgatgtgttggtagttttatgtttagcccttaattatactgacagttgtttttcttccctctttggagcttactaatgagatgctcctttttggaatctagctatcatgtataaaggcatcctcagggagaggcctatatccagagagctgacactgctagagagtgacctcaactgagccctcagttaggactccacgtgagctctcatttgagccttcagttgatttcagacatcccgagcaacccaagcatagggtttattcataatttgagcagagctcagctgggatagcttatctctccccaacatggcaccggctgggccagcttcactggggatggagaatcttccacccccattaactaagagttcagcacaggctgttggctaaggacctcaattttcctccatatgggcctatccatatagccgctggcttttcttataccatggcaattgttttaataggaggcagcttctagtccttttatagactagacctataatttccacagtgtcacctgcacctgtattatattggcaaaatcagtataggaccaggtcagacataaacgtgtggaaaaatggattgtcctgctttttcatggaaggaaggagtgatgaagaatttctatctttgatctgccacacatttaaatatttgcttcaacttaccgttttccagatagctgttaggtcattccaacactatctattaatacattctttacccccatattttgagatgctgttattactgcatgttatattcccatatacttttgggctttctgttagcttctgttgaattacccatccagacactactactacattgttgtaagtattgagaccttccaatgtattttctctctagtaggctggctgcttctcattttttgcttgtgtaattttgttatgtattattttgctataactattttgctaaatagattttataaagggtttgtgactttctggagaaaatagcttggtatatttattgttagagttaaaattataaattaatttgcagctattacctttatgatattgaaccttctaattcatattcatatattcctattactattcctaataaactaatatttctattataaatgttatttataaaattataaaatattcctattcatataagacatatttctgtgtcttaccgtctgttctacttttgtgtctttagggaatttaaaaatgttttccttaagtaggttttgtatattctctttcaagtttatatacacacatagaaaaagccatgtattgtatgatgtttatatgaaatgtgaagaaaaagggaaatataaagagactacctagagatggatgttggaatgaagaattattgcaaatggacagaagtttggttttgggggtgatggaaatgttctaaaattagattgtgtaatgacagttatattactctaaatatattacaattcatttaattgtacattacagtaaattttactatatatatagtattgcagtaaaaatgttaaaagaaagtcatagctctggctacagtatggagaatggattataggggaacaagggaagaggtagggagaacaatttggagcccagggtataagagaaaatagttgtttggactacataggtggtaatagaggtggagagacagaggaaaatttaggatttgtttttgaggtcaaatatattgtcactgctgatagattggatgcaacgggtggggaaaaaaaaagactaattctcactctacaatctagggttttaccttcaaaaactaggtacatggtggtaccttaacctaaaccataagaactgggagagacaaaaatgtgagggaagttagacagcagtcaagagcatcacttgaggtaaagtttgcaatgcctaaaagagattcaagaggggaaggttcacatagcagttggacataaagacatttggatatacaagtctgagattccagagagaggtctgggattccagagagagttctgggctgaatctataagtttcctaattaataccataaaatttatattcaagatccaagtcttgattaatgttaaatactgtttgtcaggggttgtttttgaaatgggagagttccctgattccccttgcaggacatatgattggggtgtggcttgcctgtttggttgccctgcagctcaaactgcttgagggagggggagcatgcagacgggcagatgcagaggccaggtgagcgctttgggctccaactccactgtagtgtctaggggtgagtgtctgcaaccccagttttgcaaagctctttcagctttgccttccgcagaaggcttgagtgttaatcagtttaatggaccttctgccttattgcaagggtaaagaaccagtgtgacagatttctgtatcctaagctcttgccaggcatcttggaagaattggatcacatgtgggctcaaagggtgagtgcaaggttttattgagtggtagaggtggctctcagtgatacggatggggagccggaagcagggatggagtgggaaggtgatcttcgtctggagttgggccacctagtggccggactctttcctgacttcccccagccaaattcttctcagtgttcagatgtccctcttcttctctctttctcccctacattgttccattgtctgtctgcttgcctcctcatcaatgtcctcacttgctggtctgctctggagcttggggttcagggtttacatgggggcaggatgggggcatggctgggggtaggatagggagtgtggcaggccaaaaggcagctttggggcacaaaaacagaaatacctgttctcatttagggccacaggtatccaggcttgagggtggggtctttgccggggaaccgccctcttctacccagtatttccctgtctcctgtctgtgttattttcagagcagaagtctcagtgtccttgggaatgttacaactcagtgagcaagataaataggtaacacaaagtgttaaattccaataccaggtgaaggcagatggttagaatagccttcaccaaataggtgccatttgagctatcaagaatatgtagccctttgcttgatagataaattggttaggatgttattaaaagtcagtatgggcacagagaaggtccttggaaaatactagcagttatgacagtaccattgctttcaaaatactgaataatcaaatgccaggtatgtaattaagaaaagagttgaaagacaaagctgaaaagatacttctgtgtccgattgtaggagaacctgtgacagacaggaaagaaatgggtaatctaaacttctgtaaaccacttaaagcagaaaattctttgggaagtagttatctcaattatttcttgcaaaatcatgattctgtttgtcttacttacgataaaaagcaaactagcaaactacagctgcagttttatatgtataagtacagccattatatataattgtatatataatacatatatatgtgtatctatatatacaaatataactacagcaatatatataactacagttatatatacataactacatatgtacatgtatatatctataactatgcagatatatatatctacatatgtacaagtagttttgtatatataaaactacatatatataaatgtatatatatatacacacatgaagcatgaatgaaactctttgagaaaaaagcctatagttgccaatgctattccactaaaactaattccttcaaatttacttcacttgtttttaggaacttatatcaaaagacagtaactagtatatcattatcaaaaatatttaatatcaaatctaccatgtatcttaatcttttatattttctgcaacttgtactgaatatttggctgaaattccttgctaaatgtgttaccatctacttcaatctcaatcacatttaaatcctatgttacttgggcaccagatgctccttagttgatttctgcatgctgatttcaggagccctagaaattctctggccattgctgataccaaagccagttaaggtttgctcagccctgttattgactaccaatttcctacacatagggtgctggcacaagactttccatctgtctgcctttttaattttaaacatagcctattttctttgtaaaatattagaaacatctcttaaacaaaattgctaatagacaaatgtaaatcatttggaaatggctataacttgtggaaattggttgagataatatttcaaaacaggttattgcattttaggtctgactcttaatgtgaataatatgatgtaactaaacttatagatattttaaaatagaatcttagtaaacattgttgctttttccttgcaccttttaaactcattgttatagtggaaagtgcttaaacactgtttatcccaagaatttataaaatatattattttaaaatatcagattttaaaaatgatttaagtagagcatgtgatatatattcatcttttaccacttaatgttgagttttagaaaatatgtgttgttaatggaccatcgactttcaagtcattttgtttactaagcttgaactgagatttgagcaattatgtgtgtagtaaaacctttaaaacagaatgcattgcattaaagaatgttcatgttcatttgcaatgaagcagagaatagtgtcagaactctgccctaactaggattaagttgagaagtaaactctgtatactttcttgcatttattatctgaatgtctgaaattttagtgttgttgacatctggagtgtttttcaacatgttttataatgtgttttactttcatttcattgttcatcacgtagtcatttgccgttcctgttagtgttttccaagtgttagaaacctttttctttctgcatgctaatgtcacctacttgccacaattgcatttttgcaaatattcttttttattttttatttatttttcattgcatgtgtttaaggtgtgcaagataatgttttgatatacatatacatagtgaaatgattattataagtaagctcttacctttttttgtggtaagagcacctgaaatctactctcttagcaaattttcaatatacaatacagtatttttagctatatccttctgctatacatcagatctctataattagtcatcctacctaacttcaagtttgtactttgatgaatatctctccttttgctctgcctctctgcccttgaaaaccactgttattctccctatttgtatgtatttgaacttgttttaggtatcacatatagatgagatcatgcagtacttttctttgtgtctggttcatttcacacagcataatatcctcctggctcatctatgttgccacaaatgccagtatctctttttttaagagtaaatatattccatggtatatacaccacaatttctttatccattcatgcgttgatggacacctgagttgtttccatatcctggctattgtggataatgctgcagtgaacatggatcacagctagctctgtgatgtgctgatttcgtttcctttggatgtacgtatacaaagcagagagatttctgagccataggataattctttttttcattttttgaggaatctcaatactgttttcaataatagccatgccaatttatgtttcaattaatagtgtacagggttcacttttctccaaatctttgccaacattttttatctcttttttgtaatagccatcataacatgtgtcaggtgatatctcattatggttttgatttgcatttccctgatgattagtgttgttgagcacttttccatatatccgttagccatttgtatgtcttatttggagaaatgtctatttacattctttcccctttttaaaattaggttatttgctattttactattgagctgtatgaatctcttacatgttttggatatgaaccccttacacgtacatggtttgcaaacgttttctcccaatccattaactgcccttttcttttgttgattgtttattttgctatgcggaagtaacttaatatgatatagtctcatttcttaattttggttttgttgcctgagcttttgctgtgatacccaaaaaaattatttcccaggtttatatcagagagcttttccttatattttcatctaagagtttttcagtttgaggtcttgtgtttaggtctttaattcattttaagttgatctttgtgaatggtgtaagataatgggcattttcatttcttttcatgttgacattcagttttcccaccaccatttatggaagagactatccattccctattgtgtcctcttggtggccttgtggaaaataacttactatatgtgcttgagtttatttctgaagctctcttttcggttctattggtctatgtgttttaatgccagtatcataatatttaattactctggttttgtaatataatttgaaatcagaaagtgatatgtttccaactttgtttttctttctgaagattgttgtggctatttagagtcttgtggttctattcaaattttaatattgttttttctatttctatgaaaaatatctttggaattttaatagggattatgttgaatctgcagagctctttgggtagtatggatagtttgacagtattaattcttcaatccattaacacagaactttccatttatttgtgccttcttcagtttctttaatcaatattttatagtttttattgctcagatattttactttcttggttaaatttattcctcagtagtttattctttttgatgacaatataaatggaatgttttcttaattgtgtatctaatagaccattgttgatacaaagaaatgcaactgatcttaccatgttgattttgtaccctactactttactgaatttatttgttctaacaggttgtgtgtgtgtgtgtgtgtgtgtgtgtgtgtgtgtgtgtgtgtagccttatagggtattttacatgtataatcattcagtctataagcagttataattttattcttccttttcaattttgatacctttaatttctttttcttgtctgattgctcctgctagtactatcagtactatgtttaacagaagcagagagagtagaaatccttacattgtaccatatattagaggcaaagctttcagttttttcccattgattatgatattggttttgggcttttcataaatgacctttattatgttcaagaaatttccttctgtacctgtttctttaatattaaaaaaaatcatgaacagatactgaactttgtcaaatgcttttactgtatctttgacttgatcctgtggtttttatctttcatccttttaatgtgttgtgtcacatatattgatttgtgtatgttaaagcaaacttgcttcccaagaataaatttcacttagtcatggtgaataatctttttgttgtgttgttgtatttagtttgcgagttttttgttgaagatgtttgcatgtatgtttagcagcaatattggcccatagttttcttttctcgtgatgtctctgtcagctttgatgtcagggtgatactagcttcataagatgagtttggaagtattccctctattttcattttttggaggtgtttaagaattacggatattaattcttcttttaataatttgcagaattctgctgtaaattcatctgatcctaggcttttgttgctgttaggaggattttgattaccacttcaatcactttttctgtcattggtcttttcaggctatttcttctctgttcagtctttatatgttgcatgtttccaggaatttatttcctctagattatccaatttcttggcatgtaattgttcataatattctttatgatccttttttatttctgaggtatcccttataatgtttcctctttcatatctaattttaatgtcatcttctctctttcttcttctagctaagggtttattggttttgtttatattttcaaaaaaattttagttttgttaatatttcctatagtttttctcttttctgtttgattcctatgctggtctttattagtttcttcattctgctaatttttgattcagtttgttctttttctagtttcttgaggtgaggtatgttgtttgagatctttcttctgttttaatgtagacatttttcactttaagctttcttgttagattgcttttgctgcatcctataagttttcttacgttgtatttccattttcatttctctcaagatagtttttgatttttttcttgatctcatttccaaagcatttggtttcattttcacatatttgtgaactttcccatttttctactcttattgatttctattttcataccattgttgtcagaaaagattcttgatatgattttgatcttcttaaatttgttaagaattgttttgtggtctaacgtgatctatcctagagactattacatgtgcacttaagaggaatgtgtattctattactgttgaatagaatgttctatatatgttgattaggtctaaggtacagcttaaatttaatgttcctttattgaattttcatctggatgatctatccattattgaaagtgtagtatcaaagttctctatcattattgctgtctatttctctctttagttgttaatgtttgctttatatgtttatattctctgatctaagatgcatatatatgtataattattatgtcgtcttgatagaataatctctttctcattatgttgaccttctaaaattatattgactttctgtgattatcgttgaccttctttgtcacttgttacagtttgtgacttagaacctattgtcagatattagcttagcttccctgctttcttttggtttccatttgcatgaaatgtctttttccatcccttcactttcagccaatgtgtgttcttgaatcaaaagtgagtatcttatagatgaatatagttgaatcttggatttttaaaattcatttagccagcctatatctttttattgggtagcttaaaccatttatatttaaagtgataattaacaaagaatgagttactattgccattttgttaactgttttctttttgtgttgtggttcttttgttcctctttttcttgcttcctgcctcttttttattgtttgtattgctagattttaattgctgttcctttttcttttgtgtaacttgtataggtattttctttgtggttatcaaggggcttaaatatctaatagttataacagtctctgcttagctgataacagcttaacttcacttgcatgccagaattcactgcttttacctttcctctcctcacattatacactgctgatgtcacaatttacaacttcttatattgcagaaccattcacacaatttagttatagttgtatttgaaacttttctcttttaccttttatagcaaattaccatgtatctatctaccactcttacagtaatacaatattctttctgttcctatatgtttacctttgctaatgagtttcatacttggtgttcattcatgttgctgtttggcatcctgctgtttcaacttcagtgacttcctacagcatttctcataagaaatgtctagtggtgataaacttcctcagcttttgtatgtctgtagaagtctttatcttccctttgtttttgaaaggctggtttgctgggtatagatggcaatttgtttcttttagcattttgaatatatttttctgcccccttctggcctgtaatgtttctactgaaaaatcaactgatagtctgatggcatttcctgagtaacaagcctttttttctcactgctttcaaaattctctcggtctttaacttttgtcaaatcaattacaatgtgtttcagtgtggaactctttggattcatattatttgatgtacctgaggtttgctgaatctggatttctgttttctttcccaggtttggaaagtgttcagccattatttctttaaatactctttttgtccctttttcttttttttctctttctcatcctcctataatgtatgtaattgttacccataagtcccataaagctgtcttcagtctttttcattattttttctacttagattaatttctaatgacctgtcttcagttttgctgatcaatagagtcctctattgattttttcaattcagtcattgtaatcttcaactctatgatttctgtttgatgcattttaatattttctatcattttgttgaaattctcagcttgtcatgcattgtttccctgaccgtggtgtgaacacccatatgactgtttctttgaattttctcttgggtaaatcacacagctttatttcactaaggctggtttctggagatttatcttggttttttattcggagcatatttctttgtttcctgacttttattgacactctgtgttggtttctgcacagtctgtaagacaactgtctctccctgtgttatcagactagtgtcttttaagaaatgtacctcactaatcaattcagcaagagattctaggtgccccaacttttatgcttatcttaatctcttttttttcagtgatccccaattagtatgtgccaagttttgtcagtgccccaagacagacaagatagaagccagtcccttgagatgcatctggaaaatttggcatgttagatatgtattgtcagggagaagctgaggatgggagtttacctcttactcaatctgcactaagccaggaagaggatctgtgggaaattcctgcactctcatttgaactacacactctgatctagatgcatagttattggaagtgcacccattcaaaaatcacatgcattaaaactcatagaaatgtaaaaattaaatattaaaagtctagtttgatatatgtaaattaaaatatatatgtgcatatgtataataatttcaaactattgtaaaaagatatagctaaagtagtggataataatcagatataagtcaggagagagattgatccaaggtaaacaggtcttccattcttacaaagttcggaagatatgtaaagaaaccatcgacactaaacttttttttttattatactttaagttttagggtacatgtgcacaatgtgcaggttagttacatatgtatacatgtgccatgctggtgcactgcacccactaactcgtcatctagcattaggtatacctcccattgctatccctcccccctccccccaccccacaacaggccccagagtgtgatgttccccttcctgtgtccatgtgatctcattgttcaattcccacctatgagtgagaatatgcggtgtttggttttttgttcttgcgatagtttactgagaatgatgatttccaatttcatccatatccctacaaaggacatgaactcatcattttttatggctgcatagtattccatggtgtatgtgtgccacattttcttaatccagtctatcattgttgggcatttgggttggttccaagtctttgctattgtaaatagtgccgcagtaaacatacgtgtgcacgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctcttcatgtccttcgcccactttttgatgggtttgtttgtttttttcttgtaaatttgtttgagttcattgtagattctggatattagccctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagagtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgctcgtttttctcaggtttgtcaaagatcagatagttgtacatatgtggcattatttctgagggctctgttctgttccattgatctatatctctgttttggtaccagtaccatgctgttttggttactgtatcctggtagtatagtttgaagtcaggtagtgtgatgcctccagctttgttcttttggcttaggattgacttggcgatgcgggctcttttttggttccatatgaactttaaggtagttttttccaattctgtgaagaaagtcattggtagcttgatggggatggcattgaatctatctgtaaattaccttgggcagtatggccattttcacgatattgattcttcctacccatgagcatggaatgttcttccatttgtttgtatcctcttttatttccttgagcagtggtttgtagttctccttgaagagatccgtcacatcccttgtaagttggattcctgggtattttattctctttgaagcaattgtgaatgggagttcactcatgatttggctttctgtttgtctgttgttgatgtataagaatgcttgtgatttttgtacattgattttgtatcctgaaacttcgctgaagttgcttatcagtttaaggagattttgggctgagacaatggggttttctagatatacaatcatgtcatctgcaaacggggacaatttgacttcctcttttcctaattgaataccctttatttccttctcctgtctaattgccctggccagaacttccaacactatgttgaataggagtggtgagagagggcatccctgtcttgtgccagttttcaaagggaatgcttccagtttttgcccattcagtatgatattggctgtgggtttgtcatagacagctcttattattttgagatacgtcccatcaatacctaatttattgagagtttttagcatgaagcattgttgaattttgtcaaaggcctttgctgcttctattgagatagtcatgtggtttttgtctttggttctgtttatatgctggattacatttattgatttgcgtgtattcaaccagccttgcatcccaggtatgaagcccactcgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataacgagttagggaggattccctctttttctattgattggaatagtttcagaaggaatggtaccagttcctccttgtacctctggtagaattcggctgtgaatccatctggtcctagactctttttggttggtaagctattgattattgccacaatttcagatggtgttattggtctattcagagattcaacttcttcttggtttagtcttgggagagtgtatgtatcgaggaatttatccatttcttctagattttctagtttatttgcatagaggtgtttgtagtattctctgatggtagtttgtatttctctgggatcggtggtgatatctcctttatcattttttattgcgtctatttgattcttctctctttttttctttattagtcttgctagctgtctatgaattttgttgatcctttcaaaaaaccagctcctggattcattaattttttgaaagctttttgtgtctctatttccttcagttttgctctgactttagttatttcttgccttctgctaggttttgaatgtgtttgctcttgcttttctagttcttttaattgtgatgttagggtgtcaattttggatctttcctgcttcctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaacgtatattctgttgatttggggtggagagttctgtagatgtctattaggtctgcttggtgcagagctgagttcaattcctgggtatccttgttgactttctgtctcgttgatctttctaatattgacagtggggtgttaaagtctcccattattaatgtgtgggagtctaagtctctttgtaggtcactcaggacttgctttatgaatctgcgtgctcctgtattgggtgcatatatatttaggatagttagctcttcttgttgaattgatccctttaccattatgtaatggccttctttgtctcttttgatctttgttgatttaaagtctgttttaacagagactaggattgcaacccctgtctttttttgttttccatttgcttggtagatcttccttcctccatccttttattttgagcctatgtgtgtctctgcacgtgagatgggtttcctgaatacagcacactgatgggtcttgactctttatccagtttgccagtctgtgtcttttaattggaggatttagtccatttacgtttaaagttaatattgttaggtgtgaatttgatcctgtcattatgatattagctggttattttgctggttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaacattggcccccactatcttctggcttgtagagtttctgccgagagatccgctgttagtctgatgggcttccctttgagggcaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacaccaatcagacgtggatttggtcttttcagatagtcccatatttcttggaggctttgttcgtttctttttattcttttttctctaaacttcctttctcacttcatttcattcatttcgtcttccatcactgataccctttcttccagttgttcgcatcggctcctgaggcttctgcattcttcacgtagttctcgagccttggttttcagctccatcagctcctttaagcacttctctgtattggttattctagttatacattcttctaaatttttttcagagttttcaacttctttgcctttggtttgaatgtcctcccatatctcagagtaatttgatcgtctgaagccttcttctctcagctcgtcaaagtcattctccgtccagctttgttccattgctggtgaggaactgcattcctttggaggaggagaggcgctctgctttttagagtttccagtttttctgctctgttttttccgcatctttgtggttttatctacttttggtctatgatgatggtaatgtacagatgggtttttggtgtggatgtcctttctgtttgttagttttccttctaacagacaggaccctcagctgcagctctgttggaatacctggccgtgtgaggtgtcagtctgcccctactggggggtgcctcccagttaggctgctcgggggtcaggggtcagggattcacttgaggaggcagtctgcccgttctcagatctccagctgcgtactgggagaaccactgctctcttcaaagctgtcagacagggacatttaaatctgcagaggttactgctgtctttttgtttgtctgtgccctgcccccagaggtggagcctacagagacaggcagccctccttgagctgtggtgggctccacccagttcagttggagctccctggctgctttgtttacctgaccaagccttggcaatggcgggcgcccctcccccagcctcgctgccgccttgcagtttgatctcagactgctgtgctagcaatcagtgagactccgtgggcataggaccctcccagccaggtgcggaatataatctcgtggtgtgccgttgttttagcccgtcggaaaagcgcagtattcaggtgggagtgacccgattttccaggtgccatctgtcacccctttcttcgactaggaaagggaactccctgaccccttgcgcttcccgagtgaggcaatgcctcgcccgcttcggctcgcgcatggtgcgtgcacccactgacctgcacccactgtctggcactccctagtgagatgaacctggtacctcagatggaaatgcagaaatcacccgtcttctgcctcactctcactgggagctgtagaccagagctgttcctattcggccatcttggcttctcctcccaacaagttcttttgacactaaacttttaaagtagatgtaaaaatatccattttaactattaaaataacaaagtttatcttccaaaccagtagagaaaacaaatagaacagaagtagtaatggagaaaggagaggagaggagtttattaattcaaattaaatgaaaaaaaggagaaagaaataagaaatgaaaatcaaattcaagtataatagtaaacatgataaatgcaaatggttcaaattcactaggttacacagggattatcagactggataataaatggaagttttcctttcttttttactaaaacacccctaaaacatgaagagacagtactgttgaaaatgaaaggatggaaaatgttaaacctgatatgtagcatcagtttggctctccggaatcattctagactgtcctcccttctcatccctctctcacccccaactctcacctcagctctatgccatggatggtgatttatgtatggactacataaatgagcctcttttgctgtgcagcttctgatggtctcaacctgtgggggacacaatctggagcttagagtgttggcagatagagaggtcagagcattgttctcctaagttccttcctgagagaccatagaatggcaatatgtgtgttcctctgtcaaaagccaaaactttagtaagatggccttccacagtattctgtggcctaggaagatttatgaatgcagagttctttctgctttcaaagctaagtgttttaagaaccaaaccctttgggaggaacaacaaaaattggggtgctttatgtgtggtctaagccctttgctactcatggaaaagctgggagtttggggttccttcccagtcattaggtgctgtccccaggtagggtttgtgtgtgagtgtgtcccagattttcctacccgtgttggtgtgggtatattcttattttcccagtgtgtacaagtctctcaactagtttctggttttctccaagagggattgatcaatgtgtagctgtttatttagtgcatctatggaaggagggaaaatcaagagcttcctattcttccatcttgcagatattaccactgcaaatgtccttgggacagaatggtagatataaaacaagtataagtaatttccttgcagtttttgcattttccatgtttagcattcttttcaaaggattagattgtgaattttcagtgctaaataagttatgactaacattccagctggtaatatattgatcagtagtggttgtgagaatggcaaatagataagacatagagatatgataagaaatataataaaaatgcatacctcaatggtttgtgatggtagatactggaaagaagaataatttaagatataattagactttgactataacgtattcagatatttttgaatattattaacaaacttatgatctgtaaaacattaacttctgccagtaattccagagaattatgtgcaatggttattagttgcataaagctggaggaatatttaaatgatctacttaaaattaattactctttgatcaataatcttggtcaaaaagagggcttcctatatcagtatggaaaatattatatttattcacattattttacaattatccttcctttttcattggattctcatttacttaatgaagaaaacacattaaattgttataggaactatatttcagtatctgttcctttgacagtaattgtattagagttccagacctcacacagcttaaattctcattgtacaaagtctactttcaaatgctttcaaaaagacaaaatttccctctcccccttattatttgagtgtaggatgatatattttcttggcctagatcatgatacatacttatgtctgtctttttagcaataatttttaacaaaaatttagcaaatctcattaattttgattgtaactttgaattatattgctttgatctaaaattatttatataacacataatttttcccaaaagtcttttggatcaaaaatgtcaaattgagtattaacgaaagattactctgttagtcttccacaagaaagatcaggagcccatcatggttagtaccagttttgtcagacagttccattgatgagaggccatcttcattgctcttctttattattttctgtgtaaaaccgaattctatctgacacagctttgtgttggttgtctgtaagttagctttaatatagcagtttgctttagcattgtcagattcacaatgtaaaatatactgtggcaaaataatacaatgttgtgttagttaaattaaaagcattgactcctccagccttaagaataaatctgaattgtagagcctgatcgttaaaagataatgatcatatactgccataggccacagaaatttaaaaggtcttagtgcttctttcagatagagatgcagagactaatttgaaatgaatacatagcctaacaagatgagtaggtttatttaagcacatgactgacttttgttcttcatgttgaagaggcttgaatctttagtgtcaccctgtttttaataatgatcttaaaagttcttttctttggcagtttgctttctttctgtgtattaacctttggttgtctaattattgtttcctttggtacatatttaatattttctgcttgtgctctttattatttgtgttctagatccattgcttgcccagtaagtaaatacatgaagaaaatatactaatactgtggagtagaggaagggaagaggaatatttatgaatattaatgaatattaataaaatctactacagtctattttatcatacatacttcccttccttttgtatataaaatatagtcacttcccacctgcctcctccaggaagaaactcaaaagtctcatctaattgtctaatcttaatagccttgaagtaaaaatgcaaattatctggctccccactcaccacattcaacattcaatgaggaaacagaacaagataatcataataaacacttccattgcaaatagaaagatggacacatatagtagtccctgaatactagcatttctgaactcctgttgatcagaggtttcaccatccctcttcctgtgtgagtggcaaatctttgctgaggttttctgggaacaactccctagttattgttcatgactcttggctctggcctctggcaaatccttctgtttcaatgatctcacttcgttatatctgaacagggcatttgagaatccgtcttttttggatctgagcactgagtctgaaactatgaaaggttctaggtaccactgtactagcacgtacaagatatgcatgtatacgtgtatatattaatacatacgtgtatacacactaacatgtgagtacacatacacaaaaatgcacacacacatagtagcaatatcttgagatctctggtttggagatagactctttactcacatagtaacctgtgtcacttccctatacctcaatttcccacaagataacatagtatcagatatatcctgcacagaaaatggggtttatgacacaggagagttactccaaaattatgaatcttggggcttatatagggtaattggcacatgtggcccttctgccctctggagactagagagggaagcttctctagaatgtaagcaaatcctctcggagaagatggagaggtctctacttcaccactctggaatgtaaataaaactctctgagggagatgtccataaattttcttggaaatttctatctttatcatacaagacttatttgatattcaatcatttttaacccatgttacttggaatttttgttcaggaagctctgaccatgcagaaacatgaaatattcgtggagcattgtctcctgacattgtgtagctttctcaacctttcttctacctataactttggtccaaagaaggtccaaaacgcgtatatactttggtgggaatctcacttatttcagccacatggaaagcagctgattactcaaagaacttacaactaccatttgatgattgggtatatatcccattactgcacatgtatccaaaagaaaataaattgttctaccaaaaagacacgtgcactcttattttcatcacagtactattcacaatagcaaagacatggtgtcaacctaggtgcccattgaaattggagtagttaaagaaaatgtagtacatgtacaacatggaatactatgcagccataaaagagaaaaaatcatgccctgtgcagcagcatgtatgtagctggtggccattttcctaagctaattagcacaggaacagaaaacaaatactggatggtctcacttctaagtgggagctaaacatttgatacacaaggtcgtaaagatggcaacggtaggtactggggactactaggggtggagtgagggatggagaggcaggatttgaaaaactattgggtactgtgctcactacctggatgatgggatcagtataccccaaaccttagcattgtgcaatatacccatataacaatcctgcacgtgtacctcctgtagagatctaaaagttgaaacaaacaagagatcgccagtgatggtgtttcttgaaatataattcatacaccatacattttatccatttagtgtatgattcagcagcttttactatagtcacaaaattctacaactctacaactgtcactccagttttagaacattttcatcatcctaaaaagaaacaacataaccattagcagacccacgcagctctaccttactccaccccgctaagtcctaggtagccacctctactttttgcctccatgagtttgcctattctggacatttcatgtaagtgaactcatataatatgtggtcctttatgactagcgtcattcacttggtgtaatattttcaacattcatccatgtacattttattgccaaataatactagaaatcatctgttttatttctctagcaatcagtttctatttatccaggatggtggcacttttaacagcagagcttcctcaaaacataattgcttttgttgttgaaactctatatatttgattatagtcagctacatgtgcctacttacaattctttttagggaatgtcagttcctgattctctgtttctctctgtccctctttcttatctaactatctgtctgtctgtctatctgtctatctatctatctatctagcttagtccattttgtgtcactataaccacagactgggtaatttgtaatgagtagaaatgtatttcttagagttctggagcctgaaaagttcaaggttgaggggcatgcatctagcaagggctttattgctgcatcatcccatggcagaaggcagaagggcaaaagaatgcaagagtaagggagccagaaggggctgaacttccttttataataagcccattctcatggcaactagcccactcccttgatatgaacatcaatccatttatggggtcagggacctcatgacgtaatcaccacaaaagatgctaaatagccaaagcaatcttgagcaaaaagagcaaagccgaggtatctcacatcctaatcccaaaatctatacaaaactacaataattaaaacagcatggtattggcacaaaagcagaaatatagaccaatggaacagaataaagatcccagaagtaaatctgcacatttatggctaactgatctttggcaaaggtgacaagaacacacaatgggggaaaggacagtctcttcactagttgatgctgagaaaactgtatgcccacatggagaagaatgaaactggactcttattttatcactttaccacaaatgcctacacttatatgtatgtacctcataatacattgttgagatcattgtatgtgtggaaattatagtatttttccaattaaaactatatcataaacattctcaatacatctctattttaatgatataattgaacaattgtatctaaaatttgcattgaaacaaaattggtgtagacacttccttgtaataattctgagatggttgtcaaatgggtagttttgttgtttaaattaaaattttgcttacacttattatcattatcctgttttaaaatgaaaatttaattatcttattttttctacaggtagtatacaattattttcttccaaatatatatactttatttaatctatttaaatgacccaagagagatgggttttcataccttgctagaaaataaactctaaaacatattattaggtcagtaagatttcagatatctttatatttgatctatttatatcagctgtgacataattcatatttcttttattgattcagaagaaataaaactatactttcgtatacctatgagtgatttagaattcttcttggaagagggagaaacacttagttattctttgatatccaaaagcaatagtacttcaagattctaagtactataatctatacatatatatgcatgatatcatatgtgaattctatattataaatacttaatattttatatttctcacatattacagattgtataattgatgtgtttttaagccaaaatttagcagattttatgagcttttcttttttaatctgggaaatttcatctttgctttaataaacttgctcaaggactcagaatttgagttaggtatagtgtgactatgggtgggtcttaatttgcatatcctaatgaggaactgtaggataagaaaataattcttcactaatacttgttttttgttttgttttgttttgagactgtgtctcactctttcacccaggctggagtgcagtggcgcgatcgtggctcaccgcaatctccgccttcagggttcaagtgattcttctgtatcagcctaccaagtagctgggattacagacatacacaactacctgcttaatttttgtgtttttaatggagatgaggtttcctcatgttggccaggctggtcttaaactcctgacttcaagtgatccacctgcctcagcctcccaaagtggtggaattacagatgtgagccaccatgccaggccagtaacattatttccactaaattctctaggtctctaaagagatcagcaggtggtttgtggctccaagtcaaacagagcttttagaggtacatgacatccttcttgagccttcttttcaagtctctagtcataagtttttcattagataaacattctattgaggtgtaatttgcatacagaacagtaaacaaatcagaaatatgtagcttgatgaattttcacagaatggacacttctgtgtaaccatcatccataaacattcatgtaaatcaatagaaacttgctggcaccacagaagatccactaagtctcctcccaatcacaggcctgtccaaaatgatagctgttctggcattttaattaaagtcatctatgggttactttgggtgtttgaatttttttctttccttcctcccttcctttcttccttcatattcttccttccttcccttttttcttacttctttttagctttaaaaggggtcaagtgtgagacactgatataatctatataaaattacgagttttcaactggaaaatatcaagcacacatgaattatatttctgctttgagtgtagactgccatgagatttgtaatattatatattaactagtgaaaatagttattaaaagctgttgtgctttcactttgaatttggtaatttattttccatttacatttttctgttaatatgttaaatttattaaggcagtagttaagagcttaattgttgtgcaaaaagaaaaacagggattttcatttccttgtttgctcttttattacactcccacttacttggagtggctggatctatttattatcttttccttttaagatctgagtgcacaataatatttgattcatttgagtctttttatacatgaaaatagcaatatggcagttgctcagttttttatatttatgactcagtattttatggattgattattattcacttgaaatgttacaatttggtctcaatttgaaaaggttagaattaattataatgaagcattagcgattaatcattagaacttaaaatcaaaatgtcagtatatttattgtgaaattgcttgaattggctgagaatttcactaatatatcagacaatcaccagtcctaactacttcatctcaagtcaaaagataacagcttttaaaggtttgttccaagttttcatctctgtggttttgtaactagaaaacaggtatgagctatagtaagtgttattcgtaaaagttacataatggtttgtatgtatattgtgttggtgttcggaaatgtgacgcccaaattatgtcattattcttttttttgagactgagttttgctcttgtcacccaagcagcagcgcaatgacatgatcttggctcactgcaacctccgcctcctgggttcaagcgattctcctgcctcagcctcctgagtagctgggattacaggcacctgccaccacacccagctaatttttgtacttttagtagatgcagggtttcaccatgttgtcaaggctggtcttgagctcccaacctcaagggatccacctgccttggcctcccaaagtgctgggattacaggcatgagccaccacgcccggcccgtcattattctcatttgaatcagttggtataaattatcatttaaataaatatatgactacatacaattttcaacttatggtaaacacaatgacattcatggattatcatgaagaagttaaagtagtcacaaatggaaaggaagatctttgtgcttttatcttagcaatttcacctgacatcttacagtagggaaaatgggcaaatgtcagtgagctgaagggcgtgtttagttggaactggctaaaaggtagagctaggacagtattggaaacccgtgacagtgagagtaattgacatttaacatgatagactatgggaagtttgtatgtagaaatatactttgttaagccttaaggtaatatgagagtattacttattgttataaatccatttatttttaagaatattagtttaagaatattattattcataaatgtgagacatcaatctttatcaaataggactagttattggtatcctaaaatcaagtgaaatttattgttactacaataattgatttataatgttacatttatttcctatttattttggttgccaataagtatgaacaacaaaaaaggttaaaaaaaatccttcactgtattgttaatttcctttggtattcacagctcacatctaacaaaatatttcagtcctaaatgagtttcttctagtttaaatagtctagtaaaacattttgattatatttactccaaaggatacatcattaaattattttaaatgtaaggtaataatttttctctatgtttactaaaattttttcctcagtagacgaatggttaccaaaatgatttgaggctctagtgaatcatgtaagttccataacacaaatattcatatgtaaatttaaaaactagttcaaattataatttattcataattacacaaaattattgttttatgaaaggttgagaaatgaagtaaatgtaatatacagtaatgtctatctatgtacctgcttatctatgttgatgacacaattttagaaaattgtatttttagatttactaaatatttatctgttgtgtgaattaaaatggcaatcgaatacaaatgtgggttaataatgatgaaatttcaattacaaaatatgagaaaaaactttgtaaacattacatgaaacaattcatttatgggagcttttttttttttttttttttggagacagagtcacactcttgtcacccaggctggcgtgcagtgtggggatctcagctcactgcaacctccgcatcctgggtcaagcaattctccattacaggcgcccactaccacgctcagctaatttttgtattttttagtagagatggggtttcaccatgttggccagactggacctcaggcgatctgcccacctcggcctcctaaagtgctgggattacaggcgtgagccaccgcgccgggcctctatgtgaactctttaaatttagacattttcaacaacattgctgttcatttctgtagtagattaaggtgtgttcatataactgaacttctaaactcgtgatatatagattatttttggcctaaacagtgttttaaaaatttaaaaagcttcacatacaaatccaggtatttagctgctattgaaagattgtaagacataagagcaatagacctaatttgaacatggtaagttaactagaggtgaatagttatataactgttgcatggtaggtgaggaaggaagaaatggggaagcaggctgaaagcaagcccaggcaagcgataaaacaatagcatcagcatattaacagcaatattcctttattcagtatagcagctctcagactgtttggtgtgagcatataactatagatatttactactttagaaatatagaaatttaaattgataaattgagaaatttactactttggaaatttaaattgagaacattttacattatttatttaaaaaaattatttatttatttatttatttatttattttgagacggaatctcgttctgtcgccctggctggggtgcagaggcgtgatctcggctcactgcaacctccgcctcccaggttgaagcaattctcctgcctcagcctcctgagtagccaggactacaggcacacaccaccacgcctggctaatttttgcatttttagtagagacggggtttcaccatgttgggcaggatggtctcaatctgctgaccttgtgatccacctgcctcagcctctcaaagtaaaaattatttttaaaataatgaaaaacccattcctattataataaataacatattctttataaaagtaactatgtcttttaaaaagtgagaagagtggctttgtttcactcttaataagtttctttaatacctgactcaatagaagtcagctaaattctcatacctgattcccatatttaatctgttttaatatgttcatcaggttgaggtgtataaagaaaatccagcctcacacagaaacatagttagaaaagagaggagtattttttaagtttttgcacgtagttgtgaatattttctgttatactttattgaaagttgacaactggtaatttcttgaagttggtttaaatatttttttacccatgcaagatttgctagcatcatgcattggtcctctggaaaatgttgattcactgagttatgcaggtcttctgaatattgacccatttcattttgtaataccaagaaatcaccaccaatataataagaacaagcttaaagtactgtattggaaagctatcaggctcacagtgtactataaaatttttcccaaactatgatttttgctttaccctcctattttatcattgccaacaaatacagtcagttattttccttcaagtgacagagttttttcatttttgtgaaaatatctgtaaaatatctaatgtgaatggtttgtgtgtcacttgtgctttcaacttaaaatggtgcttcatgaaaaaggcagctaaatgagcatgcaactcagtctcataagtgcatttccaggagacagttaattagttacagaaatgctgtatttgtacttcccatttgttatacttgagtcaagatttaataaaattaataattttactgatgcatcaaggatatttttaagtaaagtaaacccggattttttttgttattctacaagggcttggcagtgaaaaattcagtgactactagtagtttgctaacactgctttgatttgtgctaaggttccagcagttttacctatcattgctttttcaccatcactgcaaacatcagcactgtgcaaaaggcaaatggaaatttggaatgactaacaaaatagttttgacttagttgtatcctcaaaaagatgctttagaactcccaaacacccactgtctacactacgaaaactgtcactctataacaatgtgctaacttaaaaaatcaatattataaaaatataacatatacaataacgcaactgattttaactgtacagcttaatgaatttggacaaatgtatgtatccagttaaccaccaacacaatcaagataaagaacatttccataatctcaaaaggttccctcatgacccttttcattcactcctcactcccatctccaccccaggcaaccatgcgtgtgctttctatcactaaggattttattttgtctttcccagagtttcatttaaatagaattatgcagcatgtgtgtgtgtttttttcctgtcttccttctttgacccatcttaacaatgttgagatatatcagtaattttatgtattataccacttcgttcattgatttcaccaagttctattccaaaactgttatgaatgtttgtttagaagcttttgtgaaatttaaaaaaatttaacttgagtaaatgcctaatagtacaatttctggattttactgtaaatatgtttgattttattagaaaatgccaaaccctcttccaaaaggattgtataataccacatttcacctattccatgtgagagttccagtttctccgcatccttgccagcatgtagtattattggtatttttcattgtaactattctagtagttttactctagtacctcatagttataattttcagtttttgttggctaatggtattgaatatcttttcatctgtttctcttttgtcatgtgtgtcttcaattttttgctcatttttaaaattgacaaagtattcttattattgagatgtaaacggttcttatataatatgttctgggttataaatcctttgtcagttttatgcaatgcaagtattttccccaggtctataagcttgctttgtatatttttactacctttcaaagtgcaggtgttttaattttgatgaatttgataaaattttattctgcggtttgtgttttctttgttctacttaaggaaacgtccatttgatggttacaaaaatgtttctcccatttttttctaaatatttatggttttagcttttttatttgagtctatgattagttcaagttaatttcagagtctgatgtaaagtaaggattgaggttttttattttcttttttttttttttttttgccctgtatggatgtccacattttctagaaccattgtcgaaaacattatcctttccgcattgcatttcttacaatctgctctttttctgcttttgtagcatctcacaattttgatatgttgcattttcatttttttcatttcaaaataagttatatttgcccttttaatttcttctttggctcatgacttacttaaaagtattttgtataatttccaaatatttgacattgtttccaaatatatttctgcttttgaattctaattagttctgtattagacctcatatgtagaccacatacgtagaccatatacatatcattgtagtgctattggaaacttgttttatggctcagaatatgatctacattcatgcatgtcctatatatgttagaaaaaatcgtaattattgggttaattattgtaatgtcaattagattagacaatgtttgcttgtagtttcatgtcttctatattccggcttatgttctgtctgcttattctataatgtgacaaagagaagtgttgaaatatccatctataattgtggatgtatctattgctcctttcagttttgtcagttttgcttcatgtactttgaagttttgctattgcttgcatgcagttttaggattggtatgacttgttcatgatttaacatattattatgaatatccctttttattcgtagtattaactcatgttctggtctatttttatgatattaatggagccaactagctttttatgcttaatatttgcacaacatatcatttttctttctttctaacttgtctgcttatttaatttaaaagtagtttcttatagacagcatatagttgtaactctttcgttattccagcacagtaatttcttcctgcatttctaattgcagtgtttagactacatatttttaatgtaattatctatactatgtgtctcccatctggatttttcctctatattttcattgttcactttttcctcatttccccccttttttcaggctaattgagtactttttggatttttttttttttactattttcttactagatctacttttctttttgacaatggctctagagtttacaatatgcattttgaacttattgaagtaaaaggaggcctggcacagtggctcacgcctgtaaccctagcactttgggagcctgaggcaggtggctcaactaaggtcaggagttcgagaccagcctggccaacatggcaaaaccctgtctctactacagatgcaaaaattagctgggcatggtggtgggcacctataatcccacctacttgggaggctgaggcaggagaatctcttgaaccctggggtcagaggttgcagtgagccgagatcatgccacttcactccagcctgtgcaaaagagcaaaattcagtctcaaataagtaaataaagtaaaaggaaaactgtttctttactcacaatacttctgacactaaatgtttgggatttttttgtttacacacacaaaaaaactctctggacaccaacttagtgtcttatatgcttactcaattctgacactgactattcagaattagtgtcagacgctacaaggttagaggctccgtcctacaggcctgcccctcacttgaaatagcaatcatggccgggcgcagtggctcatgcctgtaatccaaacactttgggaggccaaggtgggtggatcacaagatcaggagatcgagaccatcctggctaacacggtgaaaccccgtctctactaaatatacaaaaaattagccgggcgtggtggcaggcacctgtagtcacagctactgaggtaggagaatggggtgaacccaggaggcgaagtttgcagtgagcagagatcgcgccactgcactccagactgggtgacagagcgagactccgtctcaaaaaaaaaaaaaacattgcaatcacaagtccagtcccaaatggctgataatttgctagaatgactcacataactcagggatacactttatttaaatttactggtttattataaggaatgttaaaacagatacaaatgaacagccagatgaagaggtacgtagggcaaggtctgaaaagttcctgagtagcttctgtctccatgtagtgggggtatgccactctcccagcacgtggatgttcaccaacctggaagctctttaaactgcagttttgagatttaatggacgtttcatttcataggcataatgaattaactcaatctccagccctgttcccctccctggaggacaggggataggactgaaaattccaagctaatgataaattagtctttctcatgaccagccctcctgaagttatccaaaagcccaccaagaattgcttcattagaacaaaagatgctaatatcgcctgggaaataccaagggatttaggggctttacattaagagactcctgtcatcccatcaatcaggaaattataagggttttagaaactgttttaggagctagagccagagaccaaacattagagcagacgatgctcctagtacccatatcacttaaaaaattacaagagttttatgggggcagatacatatttattattatatcacaacagtctaccctcataaaattttaagaaacttataatttatttccatttcaatgtataaaacttctgacaatttatttcttatactattgtgtcatacatttaacttatacatattttataagcatcatcataagcaggcatcaaatctcattcaagtgaaattttgagatgaaaaagttttgatatttatctaaatatttaccctatccattgctctccattgctttgtctagatttaagtttttagctagtatcattttccttactcctgaaaaagtttctttagtgttttcattagttcagataggctggcaacagattctttccacttaatatggaaaatgttttattttgcctgcagttttcaaagatatttttactgattatagaattctaggtggacctcttggaggcccttaaaaaatgtcttttctttttcatctttgtctagtttctcttgaaaaatgtctgctatcttgtatctgttcatctgcatataatgtgtcattctttcgatgtcatttctgggtctattgttttttactgacttatttttctctcattatagtcaatttcctgcttcttggcctaataaacttttatttgattcaagacattctatatttttatgttatttttgtaaatttacattactgaggatatgaatttggttgtatttttaataagcattgagttttgttctgctagacagttaagttacttgtgattaggtttaattcttttgaggcttgtttttgaactttattatgatagaacagccttgactgtccttttgtcttagaattcagcctactattaaggtatatccttttcgagttttctactgagtactctgaatgatcagcaaagactccactctagctggttggagctcaactgtcttccagccagccctttctgagctgagaaactgtgcaagtcaccagtttttggtaaccctttgtctgcctttgtgccttttaggatttggtaaaaattcaaagagatatttagagctctttttcagcatatatccatcctcttctgattgacaccctacaactcagcctctccacacttagacctcttactccttaagtcagttcccatttaggatacccttcctacatcacaggctatactatgctgcaagacagacaacaaggccaatttttgactcactttatttgtttcccttctctaaagaatcactgtgcttctctgcctattgtctaatacccggaagcaagactttcatagattttctccacttttctagttatttatggcgggaggttaaatctgatctctgttactcaattaagaccagatgtggagatcttattttgcttgattttttgtatttgcaattttctttctttgttaaatgagtacttgaaatatatgttaccaaagatatttatctcaattgtgagctttatacaggtcctaaataatagaggattgtaacattttgtattatttaaaatattaacttttaatgtaaattaacatgagggacatattagaagatggctgattatgcataacaactacttaccaaatacagattatatatatttagtgtcatttttacacagtttatacgcatacatcaatttaaatgtttttactaccgttattatctccttataataccttgactgccaaagtttttctgcatccagtgttgctatcatcttttgttcacgaggaacaatctgttctgatccctgggaattgagcaggatgtttggtttccctctccatctgatggtagtaatttgtctttcttacttacaaataatatactagatcttgatgatggaataagcttacttcttgaggaatgtgcaaacatgacaactaataatagaaatttctgtaactacagttagcatatatattttaataatacacctttgcatagattacttacatttattttcatatttatacatatgacccctaacttatgatagtttgatttccaatttttttgactttatggtgggtttatgagggaattaaatctatttcaacttacagtattttcaatttacagcaggtttattgggaaataacctcattgtaagtcaaagatcatcttgtatttcagcatattttattatacaacaatgaataattaaatagacatgtgccttttagtatgcatatacagaaatgcatcgaaaaaatatcagtgactctcattcatcaaaatattcaagccatgattgcaccactgtattcacctgggcaacagagtgcgatcagtctacaaataataataataataataataattcaatctgtttatcctatgctaagtatttccaacatttgtaatcctaattcctacagactgagttactatataacttagcttttggaaataaaaatgtgaatgagatgatctttactatatcagtaagaaagatgcatgcataatgaacaaaaaatgtggggatagggagaaaaagaagaaaattaaggatatttttatctgagtttattgtattcctatgtatcaaaagcctaagattcattttctgacattgttctgaaataaactgaaatgtattagggatgatttggattgttatttttgcaaatgtacactgttgtatattttgcaaatatttttcacatagaccctttaattgagaggcaaaagttcagatagcaattgtacacattaggctcgcatatttgattctaggaatgtacattttcagcaacacactcatagaaaaaaaatgcacagctgccaaagctgttaatgggagctgcatgctgaatttattgctacattgaaaatatatcccttcttgttcaacatattcagtcaaaaatgttcattaagaagtagtcttatctgcttttcattttcagggtataacacaagaatattatattccattaagagcaaatgtttaagtaacatttcagaaataaaataatgagtttttgcagtgctttttgggaaaatttaatttatgaaaaagaaaactcttagaatacagttgtagcatttcaatcttttcttctgtgcttgcaattattatgcaaatattattgctactgcaaaagatctttgtcatgaattgctttgtaatggggcaaggttattgagcactactttttaaagagatgtttctatgacagtattatacataagacttcaaaataaattgctaatggtaaaagactaaacaaatgcacccaccatttttatttctacagtgccagaattaaagacgtttatccaaatgctttaaatcagtttattttatattttctagccatgcctgttctagtaaacatgaacaatgattgtacacagttttcttctttagctgtcactaagatggtgtcataatgtttagagatacgctctctaactgtcagcgtttgttacagttcagtgatgcgtgataaagtatgagggacattgtcttcttgcactgctaaatgtattaatgcagtgatgatatttctcaatgactttttactcaaggtcaaaatgatgaaattcatctgtacttttcaataatttgtttattaatcaatatatttttcatcttagcctgttccttcaagttttttaggtacattttaaaatttgaagcaaatgtatattaaaatttaaagaagactgtgtcatatttttacatttaattgtattttaaattaccagccattatttttcaattcatcttttaaaataaataaaacagcatttagttattgttctttttgttgctacctatgaaaatataacttgagatagactctagaattctctgatctatttgaattctctgtttatgatctctggatataaaaattacttaaaaaatgataatcattatatgataaccattcatactatgtatttagtaattgtgtcttatttacataatcctttaaagtttacaactttaaattgcttgatttcacaagcaatagttatttttgccctaataccaattctatatggtagagactttaggaaatataaccccctttttacagttgaggaaattgagctcattgttgttagtaccctaaggtcacagatattgaacttaaatctagaattttggaccccaattccagtatcttttctttagttccattcttatttgttcatatttatagacaatctgcagattgtatatcactgacataaatattgcaatgtgttatagaataatgaagttactgataatgtaattaaatattcactgcttctggattagcatttctaaatcactattctagtgatgtaatgtcattattcacaaaacttcatggttcattgccaaccctattccttcttcgtatatggaaatcaccatcttcttccactggaaatattttctcagattagagatgccattgtttatagattttcaattactgtagttgatctaatttcacctaggagggtatatattgattataaatgtttacatgggataattacattttatcggttaaataggaaccagtatatatgctattggtttagtagcaatgcctttccaattacagcccacctttatatgatataaattgtctttattctttccccttagcatttttagagtttttaaggacatggtaatttgtattgaaagttacactactcagtggtattttccaagaagactctgcaaatcttttacattctgtgttactagcaatgtgatataaatcagttaacatccataaccgatagctactcatctacaaagagtcttaaagagtaaaacgtacaattcagaaatctgaactctggtgttaaaaaatcctcaagattattagagcaactaccatttgaaaaacagatctgaactatgaagttctgtatcagaattttgattttgaaaaatttctgtaggttaaataacaagaatcaagaacactacataccatacttttggacaaaagtttattataaccctatattataataggccaagtatatcacagtggattcattgttattactaaaagtatgcattcatagtttcagtcactttaattatcatacatggacaatgactagattttttattattaaagatatgtaaagtaaaatacataatatatcaagaatatacatcactgccactaaatagaagtgttttcattgttggaaatttaaaattatttacctattatgaaaacgttagttcttaaaaggattaggttcagcaagagtaccaacagattaaagctggacaactttggcattcctctgttttcgctgtcaaaaatacactttggactttgcaataagttcctcaatagttataaatcctagtagacaaaattgaaaaaaaaaatctcttcaagcttttgtttgctttactgtattataatggtaatagttactggggattatttttaaatttccagttgtttggatggcatgaactgattatgtgtatctaaataatatacttgtattattaatataaatattttgctaataaatatctttaaataaaatattataagttaagttgaaatgtttatctatttttatgttattaaaacgggttaacactaattcacgtgagttatggttggtgaaaattccaaattatttgttaaagatataattgtaatagagctatagagtcttcactctgtcaaaattacagagctttctccagaagcatcactgtttctttagttctcccgcaccctgctgacatgatgtggaatacactgagtatttgtcagtggagtagccaggatgggtgcagttgagagcactgctgaggagctttcaaggaaagacactctgctctgaagcaccagaagttacacccacagggaactttaccctaactcctgagttgaagtaatataggccattattataaaagaatgcttaatttagagttaaattagagttaaaaactattaaataaccgaataaatctttgtttttatgaatcactattttgtaataatcattaaaatggtgtcagtcctttaagaactcacattttatttttctatgttctgaaatatacacaaatgtattttattacacctaccctgcacaagtgtgattattttgcctgctttctcctattcatttttttttaacacagtacctgaaaatagggaaatgggcagtgtgttgtgggaggaagcaggggataaaatctcaaattttggcactggtaatatgagacagaaaggagtgaatctgagagtcaaatagttcgttacactgaggagaggtaaatggtgaaatatctggcgtccatagatccctcaacataagtggaaggaggatagatttgttcttacggtatccgtggcccactctgtacatttgggacaagtaggtttatggatgctgattttgtgagacgtgttgtttgtgagtctaatcatgtggacagaagataactgaccatagaaatggataactgacaataaaaataaatgtatttaccatgtattatgctatattctatgctgaatactttctaaaatagactttcatttttctttcaactttctaaaactttcagtttgtgagatgaataaaattattatccccattttataaatgaagcttgtagacgttatgtaactaccaagatgacaaagctagtaatggagcaaccgcaatgcaaacccagggtgtcactgttttagaaactgtgctcttaactgctacactctcatacagtctatggcctttccaaacttgcagttaaaaccaaattttagtagcaaatagaggaaatttaataaacgaatgaaagcaattgatttctttgaaaatagttttgcattgtagactgtctatgactacaaaaaaaagctttattttttctcttggtagcttatttctatagaagtgatgagtcagtgccttatcaagaattttcatttcttgcttgcacactccccaaaatggtacttgcagctatttatcattttagtcttatcagtgaattaattttggttatgattaacctttaatagagacagaatagcatggtggcttagagccagtttttcatcatgttattaaatgtcttttgagcccaattttttatctgtgaatcagggaaaataatagtacctcagttataaagttgtgcccacaataaataaattgctgtatgtagaggtctttgaacagtgcttaccttgcctaagcacacgataaatgttatttagcaattattgttaaataggattgcatgtcaaagttaaggaaaccaaagttgattctgttttattgaagttcaactaaatatcatcaacttgagttatatacttaaggaaccttcaaaatgtcggaatgaagactattttcattgtaactttaaattaataaagattaccctgaagggacaataataaatataaacattaatttgttctaaaattttaaacatgtacatgatatattacacaaatttagagtttcaaaatatgaatcttttccagccaacacagtaattttcaaaggacttttttttttactatatacctcttgataaaattagtgaaaaaacagcttaaaatggaactgattggattgaacatttgtatacctctgtgggtattgtttaattgcccgtgaaattgagttgttaaacaagcagaataatacatgtgacataaataaggtaaatcataagaaaattggaaaaataatttcgtatctaatgtgcaatccttaattataagtagtatttcgggcttacaaaatatatgcatttcctttggagagcaatttttatcttacttatctcgggttgtttagattctacttcagatattattggttggatattgtcaaaatacaacatttaaagttaaacagaggtagatatattagaaaatgtaaattgatagaatagttattttgtgtccttttaggatgatataattcagtaggtttagcataagtattaagtacacttataaattatttattaactactgtctttcaggtgtttatattctactgtgaagatatttgtagtgaggaaataaatattttttataactcatttttaattgatttaaaaagacaattttaatagttagatggtgtgatatatttccttaaatgctatcagttgtcatctaatgcatatagacataaaagtttattaatattaagatgattaatattctttgaaacataatttataatttaggataatatttcatctcaaaaaatcaaggccagtaatgtagggaattttattgacgggatgtgttaatcagagcaacctctccagtaaattttaaaatagtggatatgattttttaaaatttattaatagcatcaaagaactaaattgacaagagagatagtcattacaaggccaaaaattatgaggaagggggaattggaaaataagaagacaactgagggccagccatggtggctcacacctataattccagcacgctgggaggccgaggcaagtggatcacctgaggttaggagttcgagaccagcctggcctacatggtgaaaccccatctctactaaaaatacaaaaacttaaccgggtgttgtggcggacgcctgtaatcccagctacttgggaggctgaggcaggagaatcgcttgaacctgagaggcggaggttgcagtgagccaagattaagccattgcactccagccagggcaacaagagtgaaactccatctcaaaagaaaaaaaaaaaagacaaccgaggaagtttggcctttgttaaaactgttcgttcaacaaactcaccataataacctgttttagtgtgcaacttctttcttgccacagtgtttactaacatactgtcaacctaaataacagagagagattatctaaagatactcattctattctggagtgtgcagtatagatgctaatccaggatatgtggactatggggatcataggcatagccaaggagtttgagacaagaggaagctttcaaaggaaaaagtgaacgtaattcgttttaaaacaaacaaaatattgattacagtggcttatcacaggagttgatgccaggtccttgtggagacagtatgtcaggcaagtgttcttatgcattcactagctgtccttgtgactcatgtaacaagatgcagtttgaaaagtccttggcaaaagttctttttacaggcatatgtgcaagtaagagactttcagatgttctttgtaatagttcttatcataggcatgtgcgcatgagggccctcccttcctaacctaccagcttaatttttgacacaaatgactccatttgtggaatccaagtttgacacaaatgactccattttgatcctgacaactttcacatttcctcatttgatcaaggtctttctccaaaagcattgctgatcaaccatctcaagcatctcatagttaggttttatttctcagtgctggtatgatcttgtcctgattgttcagttcttctcacatcagtgaggatggtcagcaaattctgagtcagttttaaaaacactttagcaaaatggccgcaacaagtatgtttgaaaaccctgtatctctgattaattttgcctgaagtccattggtaagttccattttgttagttccaaaggtgttggctatcattttaacaaaaccggaccagtattattctattaggagtcttgctgttgcagatgttagacaggcaacaaagagatactgatctttatcaaacgttttgcctatgtctgttgagattatcgtgttgtttgttctttattctctgatgtgatgttccacatttagttatttgcacatgttgaaacacccctacatccctcatgtaaatcccactgtattattgcgtgtaatcttgttgatgctctgttagattcgctttgctagtatttctgttgatttttgcatctgtattcatcaggggtttttgcctatagttttcttattttgttgtattcttgtctatttttagtttcaggctaatgctagcctcataaaatgaattagaaaaaattccttcttcatcagttttttggaataattagagaagaatttatgttagttattttttaaaagtagtttagaattcagcagtgaacccatcaggtactgggtattttgttattagaagactattactggttcaatccagttactgattttatatatgtttgggttttctattttttcttggttcaatcttggtaagttttatttttcccagaatttattcattttcttgaggttttctagttggcatgtagttgttcatatttttttctaaatggtctttttgcatttctatgatatcagttataatatctcctatttcatttctgattgtttttatttgggtctccactgtttttttcttactctaactaataatttattgacttatgtttatcttttcaaacaactaggtttttgttttgctgatcttgtattatatggggttttctttttgtctgtattttgtttagttctgctctgatctttgttatttattttttatactaattttctgtttggtttcttcttgcttttttagttccttgaggtgcatcactacatcatttaattaaaatctttctacttttatgatgtaggtttctatggctataaacgtccgtcatagtactgcttttgctgtatcctgtaggttttggggcgttgttttctattttcacttgtttcaagatttttttttctctttaattccttccatgacccatcagtctttctggagcatgttgcttaatttcaatgtatttgtacaatttccagagttcttcacgttatttgtttctagttttactcctttgtgatctaagaagatatgtgatgtgattttgatttttgatttttcaatatttgttgatgcttgttttgtggcctaacatatgttccctcctggagaacatttcatatgctgaagagaagattgttttctgcagctcttggctgaaatattctgtatatgtctgttaggtttatttggtctataatgcaatttaagtctgatgattatttttgtttttctgtctagataatctgtccaatgctgaaagtagagtgttcaagtacccaactgttactatattgctgtctatattggtctttgattaatatttgctttatacatctgtgtgctccagtgcgtgtgtgtgtgtgtgcatatttacaattgtattttcttgccaaactgatctgtgtatcattatataattgccttatttgtcccttttgttcttcgacttaaaatatctattttgtctgatataagtatggtactcctgcatggttttgttttccatttgcctggaatatctttttctcatcccttcattttaagtctatgtgtgcctttagaggtgaagtgagtttcttatagccataatattgttgggtcttgtttttttttaatcaattcagcagttctgtattttttcatatgggaatttaaagtgtttacattcaaggtttttacttttctattgaaacatattcctgtcattttcttaatcattttctgattattgtgtatatcctttgtttctttcttacttttattatttgtgtggtttggtggttttctgcaatgataacatttgattcctttctctttctcatgagggtatctgctataccaatattttttatgctttttgagtgtttttataataatatatactgtatttttgcttccagatataggatttttaaataatatcttgtagggctgaccagtagtgatgaattccctcagtttttgcttgtctgagatatcaacaagcaaatttctccacatttctgaagagacagctttgtcagttataatattcttggttgaacactttttttttcttttcttctggcagtttgaatataatatataatatcattcttttctggagtgtacagtttctgttgagaaatctgctgttagtctgatagagattcctttagatacaacttgatgcttgatatggtttggatctgtgtccccatccaaatctaatgttgaaatgtaatccccgttattggaggtaggtcctggttggaggtgattggatcatggcggtagattcccctatcagtgccatactcgtgatagtgagtactcacgagatcttgtcatttaaaaatgtgtagcacctcctcgctatctttcttcccgctgtttcagctttgcaaggcaccagttccccttcagcttttgccatgattgtagccaagcagatgctgccagtcttcctgtacagcctgcagaaccgtgagccaagtaaacccattttctttataaattacccagtcacaggtatttctttatagcaatgcgagaatggactaatatagaaaattggtatcaagggaggcattgctataaagatacctgaaaatgtggaaggaactttgggactgggtaatgggcagtggttgaaatagtggaggcctcagaagaagacaggaagttgaaggaaagtttggaacttcctaaagacttgttagattgttataaccaaaatgataatagtgatatggacagtaaaggtgaggctgatgagacctcagttggaaatgagaaactcattgagaactggagcaaagttcacttttgttccttagcaaagcaattagctgcattgtattgttgccctagtgatctgtggaactttgaacttggtaatgatgatttaggttatctggtggaagaaatttctaagcaacaaagcattcaagttgtggcgtggctgcagctaatcacctacactgatacgcatgagcaaagaaatgacttgaaactggaagttatatttacaaagaaagcagggcatacaatttgggaaaatttacagcccaaccatgtggtagaaaagaaaaaccaatttttgggcaggtagggggattcaagtggactgcagaaatttgcagaagtaaagaggagccaagtaccagtagccaagacaatgggaaaaattcctcaaaggcatttcagagaccttcatggaagcccctcctatcacaagcccagaggcctaagaggaaagaatgcttccatgggtgaggcccatgcttatagccttgtgcaaccttgggacactgctccccacatcctagtcactccagctccagccaaggccaaaaggaccgaggtacagctcaggccactgctacagagggtgcaagccataagccttggtggcttccacatggtttcaagcctgtagatgcacacagtgcaagatttgaggctagagaacctctgcctagatttcagaggatgtgtgagaaagcctggatggccaggcagaagctggctggactgcaggttagagccctcatgtagaaactctcctagggcagtgcagagcggatatgtcaggttggagctcctacacagagccctcactggggcactgcctagtggagctgtgagaagaggaccaccatgcctcagaccccagaatgttagagccgactgtaacttgcaccatgtgcttggaaaagccacaaacactcaacagaagtccatgagatcaatcatgtagaataacccctgcaaagccactggggcagggttgcccaagaccttgggagcccacctcttgcaccagtgtgctctagatgtgaaacatgcagtcaagggatattattttgaagccttatcatttaatgactgccctacttggtttcagacttgcatggggcctgtaaccactttcttttggccaatttctccatactggaatgcgagtatttagtcagtgcctataacccctttgtgtcttggaagtaactaacttggtttttttttgttttttgtttttttttaaacggagtcttgctctgtcgccaggctggagtgcagtggtgcaattgcggctcactgcaacatccgcctcctggattcaagcaattctagtgcctcagcctcccaagtagctgggattacaggcatgcaccaccacacccagctaatttttgtattttttgtagagacggggtttcaccatgttggccaagatggttgtgatttcctcatctcatgatccacctgcctcagcctcccaaggtgctgggattacaggcatgagccaccacacccagccaactaactttgtttttattttacacactcataggcataagggactagccttgtctcagatgagactggactgtgggcttttgagttagtgctggaatgagttaaggcatggagattgttgggaaggcatgattgtattttgaaatgtgagaaggacataagatttgggagggcctggggtggacttactttgtttggatctgtgttcctacccaaagctcatcttgaaaactacttcctaatgttataggtggggtcttgtggaaggttattggatcatagggtagatttcctcgttgctcccattcttgtgatagtgagtgagttctcatgagatctggccttttaaaagtgtgtagcacctcccccatctctctttctcctgttttggctttgtaaagtttcagcttcccctttgtcttctgccatgattgaagctgagcagatgttgtcatgcttcttgtacagcctgtggaaccatcaaccaattaaacctcttttctttataaattacctagtctcaggtatttctttagagcgatatgataatggactaatataatgctattctcttactgtttttagaattctgtttttctctttgacttttgatattttaaatataatattcctcagagaagaccttttgagttcaatttacttgggaattttttaccatcttgtatgtggatgtctttatcttttccaagacttgaaaagtattctgttattattgtattaaataagaattttttatgcagctttccatttcttcccttcctggaactcacttaatgcaaatattggaacttatttgcataatggtatttcatatgtcacattggcctttttacaattttttttttccttttcctttttcttttttcagactggtttatttcaaaatacctttcttcaagttagtaaattctttcttctccttgatctacactgttgtcaaagctatcttttgtattttttattttgttcattaaattcttcgttttcaagatttggatttttataatgatatctattactttgtagaattatttatttagatcaccagtttttccctgatttctatttattgggtaattgtttgttcttttatctcactgagttttcttaagatcattattttggttttcatgcatttaaaacattttcttctgtggtctcctcctggagtattattatgttccttgggtgatgcaatgtttctttgctctttagggttttttgtgttcatacctggatgtctgtgcatctggtgtaactgttgtttcttccagtgttacgaaatagctttcataggatgtatttttcctttagatgtatttatagtgtcagttgaataggatactttggctttggttctgtgactgtacagtaaggtagtcttcatatgatttctttggctgtaatcaacatcagttatgtctgtgtgttcctcacggtttaggttgtggttgtttgtgtaggatgtggagtggatttgctggggacagggacatcaggcaggccaatccttgggtctctggggtcatgtgtaagtgcatggttgccactctactgaagggagtgggtttgctggtagcagcagtggtgagtcccatgtgtggtgagccattccatggggccatagagggcacatgtgaacactggaaggtccactgtgagccctgtgcaggctggccccacagcccctagtaccagaggtgcatagcagttccaccagtgaagtggactgtgtgccctgagcaaactgattctcaggcccctggcgagtacacatgagctttgattgtgtcaggggtgggtgctgggtgggccagtcttcaggcccctaggccacacttgcaagcatccgtagtgctattgacagactccaggcagtctgatcctgaggcccctgggtggcttgcatggatgctgtgatacttttgtaatatgaatttaaaagtatagaattttaaacttcatgtttaaccatttatttttcagtatcttatctcatttggatatgacccagactttttatgaatatccattgcctaatttaatataactttaatattttaaattacataaaaatttcatttataaagtttctctgatttgtatttacctaacgtatttatttttaacaacacctggattacttataaaaactgggatattagacaaggatagtcatcatttctaattatcttcttgttacagcctgtcaagatcaggtgtttatcacccaagtatgaatcttaaggttaaatgtattggtattttgctgataattaagaagatagaggtgtttacattaagccagcaatatttaattagtcgttttgttaatccatttcacgttataaaggaatacctaaggctggataacttataaataaaagaggtttattttgctcacagttctgcagtctgtagacgtgtgacactagcatctgcttctggtaaagcctcaggaggcttacaatcatggaagaagaggaagggaaatcatggcagaagagaaaggggaagcatgcctgtcacataggtaagatgtgggtgggagaggtctcagactcttttcaagaaacagatctcatggtaactcattacctcaggaatgacaccaagccgttcatgaaggttccatcctcatgacccaagcacctctcaccaggccccacccccaacactggaaaatcacatttcaccatgagaattggagggacagatatccaaattatatcagtcttacttatcaaggagttacataaaggatgatcgttttgcttttaagctgcttatataattttatgcccttaaaccattttagagacaaatataaaactgtctggccattaaacccaggctaaaaaatatatgctaacaattctaaagattatttttattttaccagcaaatttaaagccaccttatttattaaagatttactcaaagcatgtgaactaaaaggcatttggataaattagtaaatattttaacagtcttaagtattaaattatatgagttctcatttattaaaaccaatcttaatagaatttattaaggtatttctgaccaattatgctagattttaccctgtagacacaacatactacgtgtgtaaacacacatgaacacatatgtacacacaaagatatagctttcattttagaattttagacatgagacattaatatgttctgatctgtaatcttatcatggctgtaaaccaaattttgggtaaagcagttttcatagaaatttttttctaaaaaatgcatattttactccatttccccttttttttcattttcagttgagttaggggttaattccttgtcgccttgtatcattggaatgccattagaaaaacaatctatgagtgagattttccttgtttttatttaaatttgtaactacaaagactgttgaagcattcagtttttattttaatacaagcaaaagaaaaatcagcagattcagagtaggcagaagaaaaacaatacatagagaacttgaaagcctgtacatgtaaatcttatagatgcagtttccttatagagttcaaataatggccattgagctctgaatatatatatatatatatatatagagagagagagagagagagagagagagagagagagagtgtgtgagtgagtcagcatcttacttgtcacccaggctggagtgaagtagcataatcatggctcactgcagccttgacctcctgggctcagggaatcctccttcagcatgctgagtaactggggctacaggcccataccaccatgcctggctaatttttgaattttttgtagagacggggttttgtcatattgcccaggctggtcttgaactcctgggctcaagcaatccacccacctcagcttcccatagtgctggggttaaatgtgtgagccactgctcctggccaagctctgattttttttgtgtaatttcctcatcagtttaaaaatgtgtacaagaatgtgctataatatagccctcctagaatccctgaaagaaggttgttctggaatgccattagaacttgaagatcccattccatttcttattaatctttcagagcaaagaaaatcattttccctgctgtatgaaatttaaagtgtatacttaccagaaattcaaaatgtctctaatagaaaggacttgtgttaaaaatgcaaaaagtcttttgtcttcataagagaaatgcgggttccttatgaaggtggatttatctaagtcagatctcaaataaagtcagcaggaaacatctgccaaaaatagggcatcttggcctgagaggagactcaccagacactaaaggtgaggtgtggaaggggagagcagagggctcaggtgactgctgcacactgttcttaagaattactgcttttttccaaaggtaatcttgctccacttctgactctagatatgtcaacctaaataaaagacgaagagagagtctccgaagacactgagtttattcaggagtgtgcaagggatttgcacttccaggatatgcagcctataggattcatagacctatccaaagagattgaggaacgggcaaacttttaaagacaaaaggaaaaagaacatgtaatttgttttgaaacaaagagaatattggtgacaagggcttatctcaggagtccataccagttcattatggagacagtgttaatcaagtgttcttatgcatccagctagctatcctgtaactcatgtagcaagctcaagtttgaaaagtcattggcaaaagtttttgttacagacatttgtaattgttctgatcataagcatgagtgtgtgagggtcctcgcttcttaacctcccatctttatctatgttttgttggggtttgatgcaagcaatccattttgagtttgataacttttacaatatcaagcaaattctaagcaaaacaaaactgatgtagttgtattaatattatgtaaaatagaatttagggcggggcgcggtggctcacgccttgtaatccaagcactttgggaggccgaggcaggtggatcacgaggtcaggagatcgagaccatcctggcttacacggtgaaaccccgtctctactaaaaatacaaaaaattagccaggcaaggtggcgggcgcctgtagtcccagctacgtgggaggctgaggcaggagaatggtatgaacccgggaggcggagcttgcagtgagccgagatcgcgccactccactccagcctaggtgacagagcgagactgtgtctcgaaaaaaaaatagaatttaaaacagaaagcaaagatagaaaatcttcactgctaacaggttgtctttatcacaacggtataataaattataatttataattatctaacagcatagcgtcattgtatttttaaaaatggcaaaattttaacataactttctcagtaaatgataggtcaagcatataaaaatcatttaaaaattgtacaatataatgaatcaccttgatttataaggtatatggaaccctgatcaaaaagggaacaaaaatgtatgtacacatacaacatttatgaagattaactatatatgacaccgaaaagcaagtttctgaatgttttaaagaatcagtttcagacagaccgcattctgttactgtaatgcagaaagtttcaaactgaaattaaaaaattgaacctgaaatgccaggaatgaacaaattttaaaatgtaagcactatctaatatgacaaagaggtaattgaggtagaaattagaaaatacttggagttgaataatactggaaatgttacttaccaaaacttctgaagtatggaaaaagcactacttagagaaaaatctatagtcttaactattcatatttaaaacaaatacaaaagctgaacattaatgagctatgtatctcatgtaagcaatttaagaactacaaaaaaaccaaaataaagtacaaagaagaaataatgaagtgagtaacaaaaatttttaaaaaattaaatagtgggggtaaacaaataccacaatcagtttttttaaaaatactaataaatgagagagactggctagattattaaatagatgaaagagaaggtatacataatcaatgataggtttgaaaaggtagacgtagtaaaatagtatgcattttcttgattcttgtaaaataaaaatatagatatttagtaaaataatgtgtttacaaatttactacatttcaacggggccaagcagtctattagtcacagtaggtacagggcctagggctcaggatatttttagggacgcatgaaaggatttaattttactttttaaattgtaaaaaaaatgaatatagtcataatgaatatctaataatgaatccaggcaggattaaatttgtttctatacccacatagtcataaaatattatttttctatatctattgctgaatttatgtatttattttttaatatatgtttagggaagaaggagctaacaaaggcaaaagtgctttggacccactaaagtcatgatacagccctgaattcaatagcatacaataataaattttaaaatacttcaagttatattaagtacaatatatataatatgattttataataattatgcctcctaaaatactttgcaactacatgtttaaattatgttttctaaagatagaaaaatattaaacagtattttattaaagtcctcttaagaatcagtttttaatttttattgcaaaatagtcagcaataaacatatatgttatatagttgtaaatataagacttgatattaacattattggaatgacataattgttttggaaaaactaagcaatatcatcttcgattataaaatttaacaatgagatataaaagcaatgtgagagtggtatgcagaagctgcctggagccaatttgtaggagcctattgtgtgcaactcttcccaactctgcgttcagtgtcatcaccttggtattttgaagtaggccatgatgagagtgtttgcaacacagaaatctgcaaaccctgcaaatgaggacccctcccccactgtttggacagctgactgttaaacatttactaccacactactgtatggagtatacgatacataaaagtagtgtctataatgctcctatataaaataattagggggtgataaggagattatctttgaataacttctactcgtctttacaggatatatttcattttctttaagtttctaagttggatctgcaatatctttagaatttgtaaccagaactactttttaattccccttagaagatttcaaatgttttcaggcaatattagtttactatcataatactaaattaaaaccaaagcaggtatggcctttaaaattcaaggggatactttgtggaagggaggttgcgaaacaagcagtgtagactggcagaaacaaaaattatataccttccctaaaagccaaataagatattgggttttataacagtgtcttatttgatactttacagtgttagtggatgctgcctttaataaggaaaatataaatatatttggaacagtacattttgtttttcaatacaaggtcttttggtagctgcaaacactgatgattagcattttgttcgaaattgtatggatgaaactgaaaatggaagagttgtcactgtaaattttttgagctgatagaaatttctgatggaattttttactttggaaattttcaaaaatactaagaagcaaataataatttgtatttccacactcataatttaatgctattaatttcttggcatagttgcttgtagttttataccttttttgttaagaaaaatcactattgttgctgaaaaatattacacatgtgtattgaaaatattcaaacaaaaaagtttagaaaagaaagaaaaaatagaccatgaatattctatctggaaagttttatccataacattctagaaacacctttgcaggtgttttatctgtacataaatacagaaaaatgagggttcaaagaaaggaaacttcacacattcagtccctgagttcctagaactccattcatgcaatttaatcaagaacctattcccagaactccattcatgcaatttaatcaagaacctagaattggatgccaaggcgcataggaatgaccctatatgcttatatttccaacctcaatgaacaaactcttctttctctagatgacatttccaatcctccaaatctaagcccctcaagcagccccaacttgttcgttcctctgtcagtataaagattatccttgaatgcatacccttacttaaacaatcctcacactttccccctcatctcctgaattttctccagcctgccttgcagagtaaatattttactaataataatttgtactacatggtatatctccatgccccctgaaactggtattgacctgaatcaaaatactccaaaatattaaacccttctcagctagtttggttacttatcattcatcatttttataacacacacactcatatacatacacttactttgttaaaaataaagagaacttaaaaacaatggcatacataatctgtaagttgtcagataaagcatttgttttcttttcctatgtcagttgttgtttctggaaggtggaagagggaattaggaataattatactttattatatatgttgctcagtggccaaatcaacataggttcattttaaacatcagctgttctggtaatcatcatacttagaggtaatagtaatttggctcaaatactttatttttgggcatattgcttaagcatctgtccatgaattagcttttgtaatgtttcaatatgttctggttcatgttgggtatatttgattctgttacagtaagttaataccatagattttcaaagtagtccttggataatgtttaatatgtttccttagacaggcagcaatttaaatcattttttgtgactcttaatctacttttcatcttattcaaatttgatactagcaatgaacttgcaaatcgctttctcagatttcacagactacattaggttagatttgaaagaaaaataggtgaattgtcacagtaaagaaaatatttattacttattcatatagatataaaatttatttttcaaactcaagttattgtattattgttgatttacatatgaattccagagtagcatctgcatatgagccatttcctaatgcagaaatcatcaatagagaggttatactgttgattagcctcttgaatatcctcagcacatatgtatttctatctcctaatatttaacatggtttttgcctccatataacctccatattttatgatttgatgatagaaatataattaggcacataaatgaggtaatttttacaaaatattttttagtgagataaaatttgcaaaacttgaaaatcaaccattttaaacagcccggtgtcactttgtgtattcacaaagatgggcacccaccgcttccatctagtttcaaaacattacagcaccacaaaataaaaccctttacccactaagcagttgctccccattctcctctcccctgccagatccctggcagtcaccaacctgaagtgggtctttgtatttacctattctgagtatttcacataaatagaattacacagtatgtgaccttttgtgtttggcttctttcacttatctttacgtttttgaagtttattcagattatgtcatgtattagtatttctttttttttgagacatagtctcacgttgttgctaagactggagtgcagtggtaagacctcagctcattgcaacctctgcctcctgggttctagctattcttttgcctcagcctcccgagtaactgagattacaggcacacacaaccgcgcctggctaattttttgtatttttaatagagacagggtttcaccaagttggccaggctggtcttgaactgctgacctcaagtgatgcgctcccctgagcctcccaaagtgttgggattcaggcatgagctactgcaccccacctcattgtattttcataccacaatttatttgtcacttcatcccttgattgatatttgggctgtttctaccttttggcaattgtgaatagtgctgctaagaacacgagtgtatttgtttgataacctgtttttacttcttttgggtatactcctaggagtggaattgccagttaatatggttgttctatttttaactttttgaggaaccaccaaaatgttttccacagtttgaaatgaaccatgttggctgaggcgggcagatcacaaggtcaggaattcgagaccaggctggccaacatagtgaaaccccagctctactaaaaaaatacaaaaattagctgggcatggtggtgtgcacctgtaattccagctacttgggaggcggaggcaggagaattgcttgaacccgggaggcggaggttacagtgagccaagatcgcaccactgcactccagcctgggcaacagagcaagactctgtctcaaaaaaaaaaaaaagaaagaaaaaaaaagaaatgaaccattttatagtatttccaccagcgatgtatgcgagtttcagtttcttcacatttttgccatcacttatttttgatttttaaaattatacagctattctcatgggtgtgagggcgtatctcattttggttatccctaataactaataatgttgaacatcttttcatatgcttcttggccatttgtatatcttttttggagaaacgtctattcaagttctttgcccatttcttagttggactgatgatttgttgttgttgcattgtaagggttttttatataacctagatgctagatccctatcagataaatgatttgcaagtattttctcccgttctatagattgtcttttcattttctttaaaatattatttaatgcacaaaagttttaaattttgatgaagttcaatttatactttttttcttttgttgcttgcgcttttggtgtcatgtctaagaattcattgccaaatccaacatcataaagatttatctctttgttttcttctaacagatttgctttagctcttataattaggtatttgatcaactttgaggtaatttttctatgtggtgtgagtccaacttcattctatttttgcaatagtatttggttggtgcaaaagtaattgcggttttggtattacttttatggcaaaaactgcaattatttttgcaccaatctaatatatccagttgtcccagtccaatttttttgaagagtctattctttcctaattgaatagtcttggccttcatgtctaaaatcaattggctatagatgtatgagtttatctctcatttttattccattactctcatttttattccatttctatttaataccattttatttttatatcattttcattccattactctatatgtttttctttacaaatatttcaaagctaaataacttaggaattgggcattatccacaatgtttttaaatgattaatctggaattttaaattaagatataattatgtagataatatgttgtaggcactgtgctatgtagagcaaacatagacttgaatatgatactgtctttactctcaaggaagagcttaatgtttagtgcgggtccaactttagtaaaccaacaatttaagttcagtctgataaatgctcagattgagtacgggatgttataggagtgtaggggatgtaacaggtgtactcaccaatgtctattctactccaagtaattagtctgaagtaatcatgaatcctattctccttgccagacatgatgttttcaaggataggtatgcctaagtcaatttaagccatgagagtccccaggagaggttactgaggagttctggatatggttttattgctcttaagagaaagtataggaagcttctctcttcccagtgaaaataaatgaggaaatgttttccaaagtggtaattgttgcatgaagccatattggagactgcagagcagagagtcaagactgaactgtcttctgatggcatcactgaatcattagttgaaccaactcggaattcagaaccatctgtagtcttccttttctgtgagctcatcatttccttaactctttattatagtttaaacatggaattctgtttcctgaagataaaaagtcctgtaaggaacacagtactagaagtacatctaaatcggattgaggaatacttaaatggcttctcggagaagatggtatttgagttgaatgttgacttttgaattaaatgttaaagaacaagtagtagttagctaataagaagcagcatgattttaaaatattttctctcaacttataggttcccttttcattttgtttcctgtactgtgcaaaagacttttagtctgatacaatcccacatgtttatttttgcttgcattgcctgtatatggtgtcatatccaaaatatctttaccaagaccagtgtcgaggagctgtttccctttgtttaattatcagaattttatggtttcaattctcatacaacttagtagaaaaaaaatttaaaaatggacaaaagacttgaataggcattttcccaaagaaaacatacagaaggacaatagatatatgaaaaggtgctcaacattaccaagcatcagggaaatgaaaattaaaaccacaatgagatattatcttacatctgataggatgcctgttatcaaaaaataaaaagtacaagtgttggtgatgatgtgaagaaaagggaaactttaagcactgttagtgagagtgtcaacaggtacagctattatagaaaacaatacggacattcctcaaaaaattagaaataaaaataccatatgatccaacaaatctacttctgggtatatattcaaagaaattgaaataagtctctccaagagacatctgcactcccattacagcattattcataatagtcaaaatatgcaaacaacccatttgtccattgatagatggataaagaaataagatttatgtatatttaaatatttaaatatatatttacaaatttagtatttatatatgtatattatatccatattgaatagatatttaatagatatcatatatctatatttaagatatatatttaatagatatatatttaatagatatgtattgtacatctatatttaatagatatataatatatgtattatacacacacacacacacacacacacacacacacacacacacacacacattggaattttttcagccttaaaaaaggagatcctgtcttttgcaacaacctggatgaatgtagagtacattacactaagtgaaataagccagacaccaaagaaaaatattgcaggatcttacttatatgtggaaagtaaaaaggcctaatcatagaagaaagtaggactatgcttaccaggggtggggaggggggtgtgtacgggaaatggggagatgttggtcaaatggtacaacgtttcatatactagaatgactatattctagagatctaatgtgcagcatggggagtatagttactaatattgtatactcgaaacttactaaggtgaggctagatcctaaatattcccaccacatcaaaaattagtaactatatgaagggatagatttattaattagcttgactgtagttcactatgtatatgtatatcaaaatatattgtataccttaaacatacataaattttataaaaataaattgacaataattaaataaatagagagcacaaatggtagttaaaaagagccttaagatattacacatgctaacaaagattttacagtataaataggataatagaatatagaaatagaaagacaatgtatgctatcatatgtaatatgttttctaggtttcacatcaatcctcttaggaagataattgagtataagggaatagatgggagagacactttgaaatgctgtaactcaacagtaacataattatataagcacataattgttgaggccagatgtgttgataccacaccttgaggagttttcaaagcatcaaagttataataaagagatgatgatatggtctagttaattactgcctatagtagcatattaaatctgtaaactacagtgctgctaccaaatctaagatactgataccttctgatattatcgagatcacattttgaaaggaagagaatgcctagagaccattttcaatggttttctaggactgagctgtgaatagcggtaatctgaaaaacaatggcaagtcgagtctatattccaacccatatttaaggggaaataagatttggcactttggaaattcatctatcaagaatatatatcaatatatagttgtactcatcactgtgttcatactctgctgaccaaaatttaaatgctagctaaaaaggattctgggaagtatgggttttagttatgcatccttgtacctgtctaaaattcaggatgttttattactaaaaagaagaagggaagaattaattctggaaaacaattaactgtggaattatatagatcccagcagtaagttatttagtctaggaactaggtggaagcaaggagaccatataggcaagtaatccagtgatctagatgtgaagtaataaataatgctaccagacttatgaggttggcactgaaaaggattgggtggatccaataaatgttgcaaggaaagaagcactataacttcatgactggaaaacagaaagaaataaataaaaatcaatgcttgattatttttatatgatcttcagggaaataatcaagttggttataaataagaactcctgttatattaacagtaataatagggataagaaagaggatggttctttttaaaaatacctggtttatagttttaaagaatctattttgtaaaggacaagaactgtctttctcttacaaatttcactcaaatatgtagatgattttgattatcttgacaagcaacctaattttacatgttgtgatatacttgatattctgtaagaggtctaaagaactgataatgtaaagggaaaatgcattcggtgaatgaatatgctgcattatttatttgttattcatcatactgggaaattgtagcaggtagagactggtgagattatcacacacaaacacacaattttttggtaagccacaatacatgaataatgttatactaactttaaaaaatgagtcaatattataaatacaaattctagggcctcacattaactttttattttattttattttattttattttattttattttattttttgagacagagtctcactctgtcgcccaggctggtgtgcagtggtgcgatcctagctcactacaacctccgcctcccggatttaaatgattctcatgcctcagtctcccaagtagctgggattacaggcatgcactgccacacccgggtaatttttgtattttgttttgttttgttttaagtagtagagacagggttttaccatgttggccaggctggcctcgaactcctcacctcaagtgatcctcccgcctcggccacccaaagtgctgggattacaggcgtgagccactacacctggcctaaagttaatattttaagcgacaatcttcttgcccattattcactgcaaaaatgcatacatctctaatgggataaccacttctatcttgaaataaagatgtgtaagtcttggttctgtctatgctaatgtaagtatttttatcactgtaagtttgtacatttgattgtttgggacttgtcttggacagtttcttactgtgtgtttgaatttggtctatagatttacactataaggaaacaagtttattattttcttctataagaatttatagttatttcaaagttatgagttgaaatgttttgatagaagactacataaccatgggttctgattcaaaaataagtccaatcagtaatactcatagttacttgctatgagttgttaattaacttgttgttaattgtttgcaagatagataaaattagtaatggtttatcattattgactcccaaaccatcctgtttggatatgtgacatgtgcattttaagagttacagatactgaaagcaagatctaatatagaatttttaaaacacttttagctatctaccaagtcctttggtcatagattatttctaagaataataaaacattgatatcctaaagtatttgacaccagtgatttcttggaaagtgagcaatttgatatttccattgatagacatattagcatggctatatttgctagtagttgtaggtaaattcctttattataaaataaatttacctttattatcattattatgttttataccctcaagtggattgccagtactatcacagggaaaagagggttcttgggtctgagaattttgaaattttgtttcctcttaagaataaaaaataagtgttatatgtaacatcttgataaggaaatattaatgataccgagctctgaaaattaaaattagcgtctgtggaaaaagtaagccaaactagttttattcactaaaacacctaaaatcaactttttgatatatacaatctaccgtggttattatgcacttttatatctttgccaaattatccttacaattttccgactcactgtaatgaaacatattttccacttcatgctataccgtggcatttcattagtgtctataatggtacttgaattcaatcagccatattaagaactgacctatttacaggatggttcaaacaatggtgatacatacatttagatattgatagttttaaattctggtaaaaggtaacgttttatgactgatgaaattaatactggaacaatgagtttaattgaccaccagacagtatgcaaataaaatgtcaaaaattcatataatttaatagtccattaagcctaatggagttatatcccatataagccaaaggattcaagtagaattctattttggataatcatctgttactatttgaatataatttagaaaaatgcttagttctttactgtttgaatgtaacttagaaaaatgcttaatctaaaatatttaaaatatttatatgattttttactggataaaaataaacatgctcaagagtttaaaaatagatgcattttatcacttctaaagaggttataagtctacaatgcaaatattgtcagtgtctagatgtgccggcaagatggcctctgatctgccaccacctgatagtgtagttcccagaaaaccttgagttatcaaaagctgtgttataaaaattgcatatccatgagaacaaaagggccttagggcctagagagtttgaaaaaaaattacaaaaaaaaattatagtttcctgtagaaattttaataaatgctctcttagattctctaaaagatgttataaatctaaatgtgaaaacaaaatatttattaacatattttcatgaccttggagtaggcaaagttttctaaatgagacttttcaaatcattaatcataaaagaataaaactaataacctggaccatattaaagtaagaacttatcttcgtcaaagtacattattaaattagtgaaaaaacaagcaatggagtgagagaaggtattttcaatacataaatctcatattcagaatacataaagaacgttttacaaatcaatgaaaaaagatagagacaacagagtgggaaaagtggtaaaaaaaaaaaaaaaattgaacagaacttcatcataggtatccagacacccaataggcatatgtaaaggatctcaacttccttagttatttgagaaatgcaaaataaaactacaatgagataccattacacatctatcaaatggctaaaatgaaaaagacaatacaagatttgaaaaagatgtgtagcagttgaacctcttattcactactgtagagtgtaaattggtacaactctttttgataattatttggcagtatatattaaagctgagtatatggataccctgtaactgagaaatttgactcttagctacatacccaatagtaatgcaaacataagtttgccaaaaccaccatacaagtatgctcataatagcattaccaataatagccacaacctggtattactcaaaatgcccgtcagtagtatcatttttaaaaacaaaagatagtaatggtatgttctcacaatcagacactgtacaggaaaaaaatcagtgagtgaaccactacatgtaagtataacaaggtagatggatttcaaagaaataatgtctacatatacacaaagctagaaacataagaataaatacttaggattgggtttatttacagttcaataaaagacaaaactaatcagtatgttatgtcaggtgagcgcttccccatgtgaggagtggtcttcactgggaagaatatgaggagggcttttggagtactgctaatataggatttcttattctagatcatagttacacagatatgttcaattttcgaaaattagttgagatacttacgatttctcatcatttctgtattttctacttcagtaaaatttaaattgtgttccgtgcaggtaggcaaccatcaaaagggacccagttcacaacaaggagataaaccttggtagcctctttatcccttggttccgacactcttctccctcacttagagacgtagaggcagctggcaatagcaatagggggatcccaccacatccctatctcacagagagacatcctgcagccagccctggaaaatcccttccattcttcccaggtaacaccagtatgtaccagtgggagctgcagaggcaccaaatgtactgtaagaccaacataagatcgcaaaggctatgaaatttaaaccatcattggaaccacagcccaccatagttatgtcaagacctacgtgttatgtgctaacaaagagaatgcctactaaataaaagatttaaatagaactcagagtctcctatgtgagaaacatgtttcctcaaaaattgcttgtagaaatataaagtgatttcatcttttataggaaatagtttggctatacctcaaggtattaaacataggttaccatatggcccagaaatttaactagatacttactcaagagaaatgaaaacataagcctcaaaaacttacatatgaatgtacatagcaatattattcacagtaaacaaaaagtggaaacagctcaaatgtctagcaactgattaatgaataatcaaatcatagcatatccatacagtggaatattatttgctaataaaaaggaatgacgtacagtcatatgccacataacaaaatttcatcatcagactgcatacacagcaatggtcccaagagatcaggagttataggaactgaaacaggacgataaaaaaagaagaacccccaagtaaattcatagtaaacaggtcagaagaagctgttgcagacctcaagaagctccttaaaaagtttgaaaacatggacctcaatacctagtggtcttaactaacagagaagaatgtccatggtgtattatctgcttaaaagcaaatctatgatgaaaattaactgaccatatcaccgtggacacatttctgaaaagggtgacaattcctcaagaatagccccacacaagtcctttaggaagcattccagaaaaaggcatgcttgtctaggagatgacagcttcatgaatgttattgctcctgaagacattccggtgtaataagatgtggaggtggaagacagtgatactacttaacctgaagggtaatatatgcatctgtcttagtttttttaaaaaaactttaaaaagtaaaaccaaagttaaaattttaaaaatgtgaaagtaaatcaaagcttatagagtaaagacctaaagaaaatatttttgtatagcagtatgtatgttttaacctgcgttattatggaagtcagaaaattaaaaaaattacaaagcttataaagtaaaataattaaaaagtaagctaaagtcaatttattactattattattattattattattattattattattattttgagatggaatctcgctctgtcacccaggctggagtgcagtggtgcaatcttggctcactgcaacctccgcctcccgagttcaagcaattcccctgcctcagcctcccaagtagctgggattccaggcatgcaccaccacacccagctagtttttgttttgttagtagagacagagtttcaccgtgttggtcaggatggtctcgaactcctgacctcgtgatctgcctgccttggcctcccaaagggctaagattacaggcatgagccaccgcgcccggctattaacttcttattaaagacagaaaaatatgtttataaatgtagtgtgacctacttatactatacagtttttataaagtcttttataaagtctactatacagtttttataaagtagtatacattaatgtcctaggcttccacattcactcactactcactcactgacaccaagaacaacttccagtcctgcaaacttcattcatgataaatgccctatataggtatgacattttaaatcttttatcctgtatttttactgtaccttttctatatttagatatgtttagatatatagacacttaccgtagtattacaattgcctacagtcttcagtacagtaacatgctgtacagtttgtaacctaggagcaataagctgtgctatatagcctaatatactccatgatgttctcacaatgacaaaattgtctaatgatgtatttctcaaaatgtatccccgtcattgagtatcacatggctatattaatatgtatagtaagcttgaaccttgcatgcattattctaagtgaaagaagccagacacaaaaggccacttattgtacagaatgtccaaataggcaaatccagaggcaaaaagtagttagtggtttcagacactttgagagtagggaatgagtagtgactgctaatgggtatggagtatcttttaaggaaaaccaaaacattatggaattagatattggtggtaattgcacaactgtatagaaaaactaaaaaccgctctttggacatgaacatggcgaattttatggtatgtataaaacttattttaaataaagaatcaaatgaagattataaaactgaaagattcagtaagagaaataaaaataatttgctggattagccagtagtaaagtagagatgacagagaattgaatcactgaaattgcggataaaacaatagtattcactctgcagataaaatagagtgaaagattatgaacatagcatcagttcttacatgataggaactaaagagccaacattaataccatctgagtcacaggagtggagaagagggtggggctgaaagaatatttgaggaaataaaggctgaaaactatcccaatttggcaaaatacagaaacctacaggtccaagaagacaattgaacaccaaagaggttaaatgctaagaaatccccaccaaaatacatcataattaagtttttgaaaaatataatcagagaagaaaatcttaaaagcaaccagaaacaacacactacatattgacaccaatttgaatgtcagcaaatttctctttttaaactatggagtctgtaaagaagtggcataatttccaagtgctataagaaaagaacttcaaactgtgaattctgtgtttagagaaactatccttcatgaatgaaagggaaacaaaaacactgtcagatgaatgcaaactaaaatcatttatctgctacagaccttcctttaaaattgtgtaacagaagttcttcaaatggaaaggaaatgacaaaggaaagtaatttaaagtataacctacataccattggctatcctcttcctcatgaaatttgtaaatcttttatgattgaaacaaaaagtataatcctatctgatactcagtgcaatgatatttaaaagttgagaaggtaaaggtaaaaattggacatgtggtttcacacttcattctaagtggaaaatgctgatactggtgaactactttaattcatatatgtatgtagcagtacacagagcaaccactatggaaactacacagggagatacattcaacactataaataaatcaaaatagattcctaaagtatgttaaagtagtccaaaggaaggcaaaagaagagagagggataaaatgatgaaaatgaggggtttttttttcaatttttttgattatactttaagttctgagatacatgtgcagaacgtgctgtttgttacataggtatatacatgtgccatggtggtttgttgcgcccatcaaccgtcatctaggttttaagctccacatgcattaggtatttgtcctaatgctctccctcccctggccccctacaccccgacctgcccagtgtgtgatgtgttcttattcaactcgaacatcccgtgtttggttttcttttcctgtgtttgctgttaatgatggtttccagcttcatccatgtccctgccaaggacatgaactcattcatttggctgcatagtattccatggcatatatgtgccacattttctttatccagtctatcactgatgggcatttgggttggttccaagtctttgctattgtgaatagcgctgcaataaacatatatgtgcatgtgtctttatagtagaatgatttataatcctttgggaatatacccagtaatgggattgctgggtcaaatggtatttctggttctagatcattgaggaattgccatactgtcttccacaatggttgaacctaatttacactcccaccaacagtgtaaaagcattccagtttctccacatccttgccagcctctgttgtttcctgactttttagtgatcgccattcaaactggcatgagatggtacctcattgtagttttgatttgcatttctctaatgatgagtgatgatgaagtttttttcatacgtttgttggccgcataaatgtgttcttttgagaagtgtctgttcatatcctttacccactttttgatggggttgtatttttcttgtaaatttgtttaagttccttgtagattctggatattagctttttgtcagatggatagattgcaaaaattttcttccattctgtaggttgcctgttcgctgatgataatttcttttgctgtgcagaagctctttagtttaattagatcccatttgtcaattttggcttttgttgcaattgcctttggtgttttaatcatgaagtctttgcccatgcctatgtcctgaatggtattgcctaggttttcttctagagtttttatggttttaagttttacatttaagcctttaatccatcttgagttaatttttgtataaggtgtaaggaaggggtccagtttcagttttctgcatatggctagccagttttcccagcaccatttattaaatagggaatcctttccccattgcttttaaaggtaggaacaaaatgcagttgcttacaaccaccagtgttattttgccctgatctggaagatgagccaatgcaagcagataagaagcatatttattagtaatacaatcatatctattgaagaaacagcaaaacaataatataattcattattgcagatagttgtaacattatattaaagcttttaaaattctttgcctatggaataattatagcttcctttctaagtctgatttcaacttgatcatataatcaattgatgcttctctatactcttccaggctggaatataataggagctaccatttacttgtttgataggctctacctctgtcatgctttcacagaagaggcttttactataaagaagtcacacattgccctagttaaactgtccagttaagttcctgaaatattgttacagtgccaaaaccaatcatctttgtagatatggttcttagtatttgagaaaacaaatcaggttgtttaagagggagaccttcctagatagaaaaactagactccacagatagaggattgtgtgcacctatgtgatattactactctactaaattctatattatttcatttaactatttacataattttctcataaaacattagctagcaacatgcttatttaaaccttttatgttaaaatttttgtaattttgcactgtaagatgagctaatgcaaatagataagaaatgtatttattagatattcagtcgtatctattgaagggacagaaaaacaaggtaattcattattgtagataattataaaattattttatataaaatattttaatattctttgcccatgtaataatcatagacttatttctcaatctgatttcatcgtgattattataatcatttcatgagctctctatagaatatttgaaaagtatgtgattgattacttaaacaagtaaactataatgtaagctggcactattataaaataaacacgcagagcaatagagttattactatatatgtgaacctagagattttagtattataatgttactaatattttaaattacatcgtacagcataataacaaaagttttcagactcaatggtgttagcaagggtagcacatacaaggccaaaatataaaatcaagggtatttccatatattcacaatgaacaataagaaattgaaatcaaaagaatgcaattcctaaaacttcctaacataggaaacacttacatatgaatttaacaaagtgttctgaaaactacacaacactgatgaaagaaatcaaagaataccgaactaatgaagaaatagacattttttgaattagaagaattaatgttgtcagtcttcctcaaattgatcaatagattcaacatactcctaataaaaattctagtgcttttttttttctttttttttgagatggagttttgctcttgtggcccaggctagagtgcaatggagcaatcttggctcactgcaacctctgcctcccgggttcaagcaattctcctgcctaagcctccctagtagttggggttacaggtgcccaccaacatgccaggctaattatttgtatttttagtagagacagggtttcaccatattggccaggcttgtctcgaactcctgacctcaggtgatccgcccgccttggcctcccaaagtgctgggattacaggcctgaaccactgcgcctggccaattctaatgtatttttatgaattagtaggctgataaaatttatatggaaatgcaaaggaactaaaatagcctgagcaattttgagaaagaatgaagttggaggattggtaacacttgatttcgaggcttattctaaagcagtggctctcaacagaggactcttttgcaccctcaggaaacatttggcaatgtctggggacattttgcttctcataacttcgaggtttctactggcagctagtggatagaggctagggaatctgataaacatttgcaatgcaaagtatggcactcagacaaattatccagcccaaaatgttaatattggcaaggttgaaaaaacctgatctaagctccagtaatcaagaaagtgcaacattcattaaagagtagatccatatatcaataaaacataaatatacccacatatatatgatcaactgattttcaaccaagatgcaaaggtgtttcaatggagaatagataaacccttcaacaaatagtgctggaacaattgggtataaatatgcaaaaaataataataactttgacctcatacttcacattcatatacaaaaattaactcaaaattgattataaacctaaacgtaaagctgaaaatcataaaatacctaaacaaaacacaggagaaaatctttgtgacctggaccaggaaaagactttctaggtatgatatcaaaaccatgatccatgtaagaacatattgataaattagaattacaaagtaataatgaataaataagccacagacagggataaaaatttgtagagcacatatctgacaaagaacttgaatctaaaatatataaaggattctcaaaactcaagaaaacaaaaatgatgcagtttttaaaaagggcaaaagatttgagtagacactttaacaaagaagatatatggatgaccaataagaatatgatgatactcaatatcattagtcttagacaaatacaaattaagaatgcagtatgacaccactgctgcacctacttctactactactactacacacacacatgcacacccccaaacaaacaaacaaaaaccccttaaaataccagatgagaacacagaacttctgcaattcctgtgccttgctgttgggaatacaaaatggtacagtcactttgaaaaaacaggcagtttttaagtatagttaagcatatacataccaatgacataatctcatttctccatctttaccccaaagaagcaagaacttaggtgcacacaaaagctgtatgtgaacgtttgtagtggctttattcataaacaccaaaacctgggaacaatctaatattcatcacctggtgaatatataaacaaagtgtagtatgtttacacaatggaatgctacctggtactaaaaggaactaaactactgatacaacagcgtggatgaatctcaaatgcattatgccaaacaaaagaagcaaaatttcaaaaactaagatcttatttgattccccagcagcctgaaccaatcacattgagcttgttttgtgttacagaaaaacatttttttactctttaatctgtgtgttcttggaggcctctgttacaatggccaaccttaccttaactacgcacagtgtgtaccaaacactgctgcactctcacatttagttctcacgacaatattgtatgtaggcattttaaactcatttttacagaagaggagaatgagtctcaaagagatagagtaacttgctcaaggtcgcatagcccaaacattttggattcagatctattccaaagtctgtatacttttgccatatatagggttgtaagtcagacagacctgggttcaaatcctcatttagccatttactcctcttaagatttgctagacgttaaagataaatttggatgtggctatttcacagtgctgtgagaatttaagtaataaaaggatatacaatttggttcaaagtaaacactaaataaatgctgactgttattatgcctcaatgcctctcctcatctgtatacatacttgggattttgcagtaattataaaactacatataaagtgcttagaagcaatatatctgggatgttgttagctttaattattattcttgtatttgttatacatgcttaattggggaaacttctttgattccagtaagttcattctcaaaatgtgctttgcattctatctaaaatttctcgtgaaatagttacattcctgaaccagtcacttgcaagatagaaaggcgtatatcacttctgacattcattcccagttgagtttggagcatatacagtcagagatgttatcaagataccaagattttgcttcattactcaacactaatggacaagctgaagtagtttatttttcgaagagactctgaagcacacttaaggttttcattgtttactatgctattctgtgttcaacaatagaagggtatatatcaagcttgtccagttcattcacttacatgatattttataatataaatgggaaactgtatgggatacttctgtttaagcccataactcattttttttaaaaaaagtattctcttcatctaaatacattgtttcttgaaaaaaaattttccaaaaagtaatgcagtgaaaattgttctttcttccttgttcctcctctacactgttcctattccattctcaatgggagatatatatatatttgtatatatataatatagatttatatatctatataatatatttatatatctatataatagagatttatatatatataaatataaaaaaatatatatccctctggatatttctccttttttgaatgcatataaaagcactacagaattttccaagaattttgtcatttaaccaaactgaactcttggcacaccatttagatgaaaagatgtgtttgttccatgtggatccctagtatgtctgctaacaggattgacaataacagacattagaaacatactctgaatgtttactagttttacttaatctgtttgtctctggcagtgattcagaatggagttagtctggagctgttattgaacttcattgttactgttcttgaagccccactcatttcctgccaccccatccctattgtgtttgaagtagaaagctaaagtgttgtaagatggtgaagaggaacacagacatgttttagtccttggcatctcaaggcaaaattggtacttgaaaccagatatcaacctttagatcccatattctttcacctatacattgctctagtccatttcatcctctttggtatgtttttacaaaattttaaaatttacacacacacacacacacacacacacacacacaaacatatatgcccatttaagctgagggaatactagaagttatggatgatctgtataaaggagatgatctttattgaaagagccttaaaattatactgattttttaaaacaaagaataactttattctaatattcgtttaaaactgtacattgatattattttataataatggctgctatagtgtgaacatttacgtccataaggtctgctttggaccctttattagataatttagtaatactaattataataaccaaaggaatgtatttacttctcatggaccagtttaatgtggatgttcgcaccagtaagatgttttcctccatatagtgtgttaaagacccctgttctttccattttatggctgcttcattttctagactctacagctagcagaatgttaaagagacagtggagaaggcatctggttcttaaaaactatggccttgaactggtgcataaccacatctgctgcatttcagcaacaggaaatagtaatcatgtggtcatacctgcttggaagaggactgagatatgtggtctttttcttttctttttttcttttttttttttatgataaccattgttaatattttattaaaagccctcccatacttttccctatggactaatacatatatatattcatgtatgtgtattaggcagggcataatactatacatactattatctaatctgctttatttttcactaaatagcatgtatgaattttttttattatactttaagttctagggtacatgtgcacaacatgcaggtttgtcacatatgtatacatttgccatgttggtgtgctgcacccattaactcgtcatttacattaggtatatctcctaatgctagccctcccccctccccccctccccccaccccacaacaggccctggtgtgtgatgttccccaccctgtgtccaagtgttctcattgttcaattcccacctatgagtgagaacatgcagtgtttggttttctgtccttgcgatagtttgctcagaatgatgatttcagcttcatccatgtccctacaaaggacatgaactcatcctttttatggctgcgtagtattccatggtgtatatgtgccacattttcttaatccagtctatcactggtggacatttgggttggttccaagtctttgctattgtgaatagtgccacagtaaacatatgtgtgcatgtgtctttatagcagcatgatttgtaatcctttgggtatatacccagtaatgggatggctggatcaaatggtatttctagttctagatccttgaggaattgccacactgtcttccacaatggttaaactagtttacagtcccaccaacagtgtaaaagcgttcctatttctctacatcctctccggcacctgttgtttcctgactttttgatgatcgccattctaactggtgtgagatggtatctcattgtggttttgatttgcatttctcttatggccagcgatgatgagcattttttcatgtgtctgttggctgcctaaatgtcttcttttgagaagtgtctgttcatatcctttgcccactttttgatggggttgtttgattttttcttgtaaatttgtttaagttttttgtagattcttcatattagccctttgtcagatgagtagattgtaaaaattttctcccgttctgtaggttgcctgttcactctgataatagtttcttttgctctgcagaagttctttaattagatcccatttgtcaattttggcttttgttgccattgcttttggtgttttagtcatgaagtccttgcccaggcctatgtcctgaagggtattgcctaggttttcttctaggatttttatggttttaggtctaacatttaagtctttaatccatcttgaattaattttagtataagctgtaaggaagggatccagtttcagctctctacatatggctagccagttttcccagcaccatttattaaatagggaattttttccccatttcttgtttttgtcaggtttgtcaaagatcagatggttgtagatgttcaggatacaaaatcaatgtgcaaaaatcacaagcattcctatacaccagtagcagacagagagccaaatcgtgagtgaactcccgttcacaattgcttcaaagagaataaaatacctaggaatccaacttacaagggatgtgaaggacctcttcaaggagaactacataccactgctcagtgaaataaaagaggacacaaacaaatgaaggaagattccatgctcatggatagaaagaatcaataccatgaaaatggccatactgcccaaagtaatttatagattcagtgccatccccatcaagctaccaatgactgtcttcacagaattggaaaaaactactttaaagttcacatgaaaccaaaaaagagcccacattgccaagacaatcctaagccaaaagaacaaagctggaggcatcatgccacctgacttcaaactgtactacaaggctacagtaaccaaaacagcgtggtactggtaccaaaacagagatatagaccaacgaaatggaacagagccctcagagatatgtagtccttttctaggcagttacttcctatcattaactcctccccaaggaatgggaaccgttgataaatagctattcatctgtgcacaaactctatttaaggtagtttattacttttggtattgtttcattatgtggccctgaaatttaatatgttggtgggttttgtgaaatttttattttaattcactgaagtggcaaaataaccaccacactttgttgtgtgccattttgtggtagaacatttgtgtgtgaattctcattgcaatgcagagtatttcttgagtgagaatcaggtctgtgttcacctctagcctctgtaactctctaggtgtgaggccttggagaatcacttaatttctctgagcctgtctttcttcatccataaatcaaggaggttagataatgtgttataatcttcaaaggtccttacaatgttaaaattatatgatatttgagtgacataaattttaaaagtttatagtgacgctttgttttatttatttgtcgctttaattattgtgcttaagaaatacgttatcattttgagttaacagtcctcactaaaagattaaaaatttgctatttgtatttattcaggcctagttaaatttaacagcaacatgaaataaatgattacctgttttagatataatttcataataaggcctctgaaggtcgtttgaaatactgcactaattaacgttttatttccagccttccttaattattctagccagatggtcctttatttatgttattgctagaggtttccagctgaggttgtttgattgttgaagaaaaatatgtgatggcaccataagataattgtaattgaattgttaggtatgttagagcatttgagccttctgtcccggttctatccacatctgggaaataagtttgttaacaaagcactttgacacctcatctgatgcttgagtgagattctgaactgtccagatggaattcaaatggggaaatgactgtgcattttattgtaaaaggcactttgcaaatatctgtgcaaaattcattttgtgaatgaaaagaaaaaaacctttaaaataaagtacacttttaagggcatgatctgttttccaagtgtcataataacttcaggaataaactgttgcattaaggtcaaatttaaaatttgtgcagattaaccaccatttaggaagcagttaagtggagtttttatggcatggaacttcaaaagtgtaaatgaattatcagctgaatagatagtccaataaaagaagcagacttaaagtggaagataaaagtgataaagtgacagtaaattagagaatagaactaaaagctctattgttatgaagaacaacaatagacctgaattatctatgtttctttacaaagtatcttttctcatttctgtgcttatgagttttacaattactaaataaatagtattggatctgaaagcttgtatcagccaagttaggtagaaagccttattaacatggccactggcaacttaatactgggcaattttcctccaagcaaacgtgatttcattattatagtacttaagctgtgcacatgcaggataaatcagttcaatgaccttcttcccaatatgttcaaagatgttgaaatctcagcgtatgcagagctgacacgattggacatgattgttcaacatcttggtaattgagatgctgttttttcaaatcatggaggcattgtttatcttatattgtttatctgatttatatataaataaaattttattggtcagaagactttcataagtcaagttactggttgagtataaggcactaatataattattaatgattatggaggtatcaaatctggatgataatttgatacctaatgaaatggtaaagcaaaacaaataagtaacttccagtggaacgcacacacacatgcacacagatacgtttgaatagaaaagctgaccatgttgatttaaaaagattttcaaagaaactagagaggaaggggattggatctgttgttttgtcttctttttttaaatttcttctatcactttgctttcttttgcccataaaaattaaatggcatacttaagtcacccatcttagaggcactgacttctgctaaataagagaaagagcttatggagtgttgtgttgttcatttttttgtgttttttatgttttattttttccttattgacttgtcccaaagccatttctgtgttttggttcgttgattattcccacttgaataatctctctctgcaggaggctttttgtaccgatcactaaagtaagtctcctaatttataactctgaatatattttaatttgcccattgtggaatatgtgctatctaagaatatctacatgtgcttcaatacatatacttagttctaggcagaatgagagtcaatttgaatgttccgctgacttgctttggaaacacacataactacaagcccttattcagctattggccacgacttagtttataaggggagatcaatgttcctagactctgcatgaattaaaagaaagtgtatgtttgaaaatgtgatccagtctttttattcatgctactagacgtggagtgagagaagagaacaagggctacctattgggtactatgctcactacctgggtgatgggatcattcgtaccctaaacttcagcgtcccgcattagacctatgtaacaaaagcttgcacatatgccccttaaatctaaaataaaagtcgaaattattttaaaaagaaatactaatatcaaaaagaggaaattagtcattactactattgggtttcacttgtaactgacaagtcatttccttttactgctttcaagattttctccttttctttctttggctttcagcaatttaatcacgatgtatctatatgtggatctctatgcatttatcctacttcatgtttgtttagcttcctggatgtgtaggttaacgtttttcaatgaatttgggaatttaaagaaaatgaaaatgtgagcaaggcattcgtgaaactaatacagcttacgagaaattagagagggggatctttacataaccatcttgctagaagttattaaatgtgtttctattgggattaataagaagatgcaatgatacctttggttagtttgctttaattatgtatttcgaagttggctttttctttaccgatgattggttagtgatgaattcatcatccttctatatggcaacagtaaataaatatgatatagagaatttgtaattggccaactaaaagatacttgtagaaaatatatgttagaatgaactgtttagttaactattataataatgaaaacaactgtagtaaccctgtttaaaggatttatgaaatagattataagatttctttgttctatacattaaatgaccattttgttcacaaatttgttatggattgtagtaaatttatgctgcaaagtagactcctaaataattgttagtaaagatttatgcagttttaattttttatataattttacatattttcatagctgtaaaggggattgttagcatttctctatccaaacatacctgccagaaatcagtcattgttgttgttgttattttttttttccattatactgacacagtctaaggaaagttagagggttttctattttgtatttttctcattatgtttgagatgacaaaatcattcatcattctcaattactggaaggcaattcactgaattcaatgtgagttaaaagccagatacctataaaattcttgcactgaccagtaataataagttgtgatgcacattttatccctaacatattaataatatacctattttctattgaattatttctgagatatgccaaaccagtgcaagtgaacattaacggatggcttaaagaatggagaacatatttacgataactagaagaaatggacatattaataacctttactattaatagctagtaaaatgtctttgatcttttttgagggcagcaccttaaagaagcagtatatattcgaggtctcatatactgtaaaagcatcagaatgagtgcataccattctgcatacagtttacttttaagagaacattatatattattaatcctaaaagccattagacaagagaacatttgctgtttatttaaattttacttggataaaaagaatttttctgaggttatcttatgttttaactaaatatttgtcatttattatagatgaattattaagagatttataatgcatgtagattttccttcaatttagtaaaaaggaaagtttattactaatttatgtattgtaagttatgtagtttctagttaaaaactagaactgaagcttttgatttatttttaaataatagtttttatttgtcattgcgtaaaataattacaactcttaaactgtaaactaaatcaataggtaatctaataaatgtaacaattgaaaagacacatttggctggtaagtaaaacccttcagatttatgacattaaatgtaaaggctttcacatgcttttatttttaagctctgatgtgtcacttttcaaaagtgttatattggctgtttacaaatatgcttttatatatgtagctatgcacatgtaagttttcatctgaaattgtcatgtacatttattttggtcatgagtgcctctttgtggctttcagtatgaaatccatactcattagcatctagtacaaggcactaagtgatgtgatcacagtaatctccttaggcctatctctcaatgtgacttcttgccccagattttctcttcaccctaactggctttgctctgaacccaccatggtttttgttttctagatctgtttgcaaactttgcctttccgtttggaatgtttgctaagtcctctgttacccaaaactggcccctattttcaaacaacagtaacaatatccttctgatggacctttagcactctggttatcattgttttctggaaggtcttccattgcatattaaccctcagtccaggctaagtattttctctgtgttctctagcagcctgtgtttacctctgtgatggtcatgctgttatggaatttcctgtttattcatttctctccccaacactctaagctccttgtttgcaaatattgtgtcttatttatctttttatctccaaaacaatcctgcacagtgccctggctcatagcagacacaaaataaatgtttgtttcattagtgtttatcaaacaaaatcactcatgagtttcacctacaaatgcaatcttaaatgtgcctgtgatcacatccttttttatgtgtaacttctggaatcaacaatgtaccatgaatactgatattaaatatgattatctcaggtatctcctgtgagatagtgaaataacccaccatatttgtctctaaaactatgttttatcctcagaactaaatacaatataagcagtctgaaatatatattgaaatctatgcagtctgaaatattcattattgacatttcctgaaaacatggaagtgttttccagttatttgtttgagagactggcattgctgttgtagacagaatggaaatctgtgaatttcttttcttttttttttttgtttttgagatggagtctggctctgtcacccaggctggagtgcagtggcgcgatcttggctcactgcaacctctgcctctcgggttcaagcgattctcctgcctcagcctcccaagtagctgggattaaggcacccgccaccacacctggctattttttgtatttttagtagagacggggttttgccatgttgaccaggctggtctccaactcctgacctcaggtgatccgcccgcctcagcctcccaaagtgcagggattacaggcatgagcaactatcattcccatcattcttcttttctcattgactaatttaaaatgttacctgggaaactgtttaactgttaatggttgccttttacattttttgagtaaaaattgtaattcctttaagtaagacactgtgttttatatagctcctttactgtgcatgttgttggtgtccatgtttagatgagtaatgaaaattattgatgggaaatagggtcatttttattattgctgcagacaagatgtggtggatttaagatgaccacaaattctttgacattactcacaaagaaaggtgacatttatgtcccctccccttgaatctggatggactctaagaaggctttgtccagttgtgtacagtggaaatgatgctgtgccagtttcttagccaagaccttaagagactgacaatttccacttcttgtctcttagagcacttgctcttagaatgtttgttctgggtaggccagctaccatgtattgaagtctgtcttccctgagtgaggaggagtgaaagagggaaaagaggagggagagagaaagatggagagagaccaaggaacaccaggataccagataagtgaatgaagaatgtgaatccatcttggaagtggatttcccagtcctaatttcctcagcggccacaacatgagtcagagatgagctacctatccaagttcttccaagattcctgactcacagtcatgatttaactatgggtatcgttggttaagccattgataaccggaaaaaaagggcgatcactttatacaaataaggaaatttaacatagtttagtctctaatttgtgaatagtacatataaagagtggattgtgaattatatcttgagcgtccttggtaataggcatatgttgccaaaatttctttcatattccttattaattaagtattaaggttattttttcttcatagatcgacatgaacaaagtttgaaggaccctaaggaataaaattttagtaaataaagtagaatgcaagatgatcatctcattctgtgataactacttcttttgaattttgtaacagtttctgtgatatgcatgttgattttttaggcttacttttaccttttgggcaagcccagtcctctgaggtggcagcaagaacaacaagccactacaaatagctagtaatccaagtcaatttcagtttttccatatattaatgaataaaacttaaaataaaacttaaaattaattcaaatgtgaattaatgaaagttctgtttatttatcctaccaatgatcatgtcagatcatgtcagtaggagaagcaaggatactttgagctgttagggtcaatatattttctttaatttataactaagatctttgccctgtaattttatcctttgtctactgcaaaaatttcctccccaaactcctacttgcaccgtgcactaaataggaaaataagcctgaccatatgtgctgctgcccctaaatactctttatttgcacatgagttttctctttattatgttattaacataaatcaggatcccatgaccaggacaactgagattagcacctctactctttggtattagccaggccttctgctatgcttaattgatctccaacagtattattggcccgtttcactgttgtgcttccatgaatgtaactgattctgaattacatgtcattaaaacaaatactttgtaatgtcccctttattagcaagaaatgaaactcatcaccagcatgacttatatatatagctccttaaatcacttcttttcattcaatgttgttttgatataatattaaagagaaaaaaatacttcctggatgaagccagtatctttatagagtttgcacattctccccatatctttatagagtttgcacattctccccatatctgtatgggattctctggctactccagtttattcccacatccaaaagatgtgcatgttaggttcattggcctgtctaaatgatcccaatctgagtaagtatgggtgtgtgtgtgagtgcgccctgcaaagggatagcatcctgtccagggtgggtacctgcgttgctgccccaaggtggataggttctggccacccaccaccctgaactggaataagttggttcgaatatgaatgaatgaatgaatgaataaaatgattgtaaaataaaatttcatgaagtttactatagtcatgcaagtgtatggcagtaaatgatgtggtaggagagtgttcactgacccccaagttgtgattgtttgtttttgaactgagtggtggtaggaggttctccttataattttctcttcacaaacatttattccttgatacatcctaccaccactatgattactgtcactcactgactcaccaaaaattgggtaaatcattatcttacttgttttaattactccttcttaaatatatatatagctcacatttgtttcaatgtttaatattagaagtgtttgaggtctttagttagaagcgatgatgttacataattagaaatataccagaggaaattaactcttgtttatatcaattagcctgcagtaaagttggtttcattatacatcatttcactgaaactcagtttccaaggacatatcaataatgttaggtgaggacttaatatacatgattttaaaaaaatacagtaaaatgtcctaatgtaaaagatacataaaatgaaggtaatttataataaatcaatatatatttaatagctaaatgtttatgtgactgtgctacaaacataacgatgtagttagatgcttgcatctattcatagaattagcagaaatagatggctacagatgctgacaaatagatgcttgttgttttggtgactcatccaccatgggcagcattgcagtacagtgacattttttgaaaggataaatggctcacaataaatttagaaacaaagtgaagggaagtcttctcttaaaatgcacatggcatggcagttgcattcttgaaaaattcagtgttaataactgtgcaaaatgtacttagtatttacataaaaatatagttagggattggatttagataattataaatgggtgagtacttggttagacatttgaatgtcatgcaggagtcacgatggttcacagtggggaaagtatcttgggcattgcaggatctttagaattcccggcccattaaatgccagcccagctgtttccccattcattgtcataacggccacactgacacacacccaagaaatttccattacatccctttgggatgtcacttccaccaattaagaatctttgctttaaacactctcccttttcttctttatcttttctgtttctacccctgtatctttctgacagtacatgtttcctgaattctctggattaatacataaaatgtatcctaactaaacatatcacaaaatgttatcaaacttatgtaataacataattgtaactctttatgaattctcttaccaaatatattctcataaatcttggcatataaatgttaaactataccctatttttaatagtataccttttaactaatattactcatcatattgtataattctcaatttatactgttagtaatttttttcctttttttttttttttttttttttgagatggagtctcgctctgtcgcccaggctggagtgcagtggcgcaatttcggctcactgcaagctctgcctcctggtttcacgccattctcctgcctcagtctcctgagtagctaggactacaggcacctgccaccatgcctggctaattttttgtatttttagtagagacggggaatttttttccttttatatctatatatgagtctactcatttgtaataatacaaaaccccttaaaggaaagagcacatttttgtatttaggggtctcttacccaaaatagatggatatatgtatataatatttattatatttgttgaatgaatgaaaaatagactattctattagtatccttcttctgtggataattatgagtcttggaggtttcaaccttttttagtgataggaataatttgataaacttttaagcaatttgtttcaaattagcagcattctccactgaaggagggagagttccagggggtatagtatcctccctatctggtcaggaggatatcagttcaggcaccagcttggagtgtaaagcacactagtgaggtaaaggtatttattccctctgcctcttccctgtagagttgcctcaagctggctgtgtcctttgctgtaaggtcagagtttttctcaaggtagccatctgtatcagtccattctcatattgctaataaagacatacttgagactgggtaatttataaaggaacaagtttaattgaaacacagttcagcatggctgtggcggcctcgggaaacttacagtcatggcagaaggggaagaaaacacattcttcttcatatggtggcagcaaggagaagaatgagagctgggccatgggggaagccccttataaaaccataagctctcataagaatgtactcactatcaggagaataacatgggggaaactgccccatgatttaattgtgatgggtgtctcccatcacacatagggattatgggaactacagttcaagatgagatttgggtggggacacagccaaaacatatcaccatctctacacaacattctcctctggcttctaataaccttccctccttttctctttttggcttgtggagggtcctacacaacccaatatagtttccctgcactctgcccacacctttgtaaataatccttttgtgaaccttcctcaaattatcctaatttgaatgtgtcatctctttcctcttaggcactgactgatataacccccaggcacagttaattatctgcttggtgtttccatgacattgtgcatatagctcctttattcatttctttattacataattcagcatatatttattgtgcatccactaagtgtcaggcagtctcctgggcccacaaggaaaatatatccatgtaagttatgccagcattagttaggcagttgtatgctatttaatgttatttaatgtaatgttatttacattacattatttaatgtattgtaatacagttatttatgcagttattgtaatgcagttatttaatgtaatgagtcctacacatacagaagtctatagtgctatggaacttcataaaaaaggttcataacttacacataatcattggagacattgtctcaaagaatgtgaaatccaagctgagaccagaaaagtgagtaagaattagacccgcagagagggctgacagtgagaagggaatgttccagctcaagaaaaacatacttacaaaaccaaaaaaggaagacatggcatatttgagtaatgaaaggtaacagatgatgtgtttatgacgagtgagggtgtgtcaagagatcgttctggagaatatgggtcagattataaaggacattgtaaactgtgctaagaagtttacctttattctaatgaggatccactgaagcaagaagcatgacatgaacaggttgtaactttggaaatgttattctgattagttgtagagcataggtaagaggagaataagaatggagggagggagactgtatgtatggtcatgatagggggacgaaccaatgtatattcacctggtggggaagaagaagagtaatcagatttcagagagattttacagatagcacctacaagacagagtaatttactggtatttgggggtctgaatccctaattctaaagacggtgggagatttcaagcctaaacctccaagtttatgaccaggcaactagttggcttgtagtgatagtcaacgaaatagagaaggtgaactgtgagcaagttttggaggaaaaaccatgaaggcagcaatagataaatctaagtggaggtgtgtagtaattatatagataagtgggcttgagttttatgagacagatgaggattggtagtatggttttagaagtcatcaacataagctgaccattaaagcaaaggagataagatgaagcagtgggggcagtaagtcagaatatgattgtatcatattctaaggcaaggatattttaagaacgcttcaggatgacacctaagtaaggactgagaagggctcagagaaagaaatgaacagggtgacaaaccttgattgagacagtttccatgataaggtggggaagaaagcctagattagagaagtaagagatgagaaagtagagtgagtaaaaataactctttcaagtatttttttccctgaaagagaagagaaaggattttagttttggtaaatatggtggtggctcaggggcatcgattgcatgcatgcatgcatttacatatgtaagtacacatatgaatatgtaggattctatgtatgttaatgggagtatcttaaagtggtttaaatgctgatggagacaggcactagggagtggattaaaggtatagggaaatgaaataatcattagattcagatttaggggaaggtaggataggaacaatatcattattatcaatgtatattgttctttcttactagcttgatccctaaaaaggcaaagactatattttttttgtatcctcagcatctaagacattacctagagaatactgggatcttctatattttagttttaggaaaaaggaataatagcttgctaaaataaaatagttaatttacctcagaactcttccaagatcctcagccaacatttgcattatatcctaccttcaaaaactgtcaaacgtatgtcctttaggtattttatgcatagaaatgttttttaaatgatcccttttggacattaaataacagttttaataattttgaattagtactaagtgccatttaagtgttctcctgatatatactaaatgaaaacagaaaatgatgcatgggagaaatgagttagatcaatatggttaaatttaataaaattcaaattaaagaatctacattatttctatggtgatatcactatgatatgtgataataactccctcaatgtataagttccagtcagaagatgattatgtgcagaaagcttttgcttttgtgaccctatatctcacctgttcttttttattgattgattatatttgaagagactcaaatctgtttacattagattaggctatataccagccacgtgattttctgtcatactaaaatttcaaacttaagatcagaagtaatctagattctataataaaaaatcatgacatatgctatggagcttggctgtgactcaattaaaattgcattttttttattatactttaagttttagagtacatgtgcacaacgtgcaggttagttacatatgtatacctgtgccaggttggtgtgctgcacccattacctcgttatttaacacgaggtatatctcctaatgctatccctcccccctcccccctcctcccaccccacaacaggccccagtgtgcgatgttccccttcctgtgtccatgtgtcctcattgttcaattcccacctatgagtgagaacatgcagtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatatgtgtgcatgtgtctttatagataccatctcacaccagttcgaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagcaatcccattactggttatatacccaaaattaaattttatctaattatgttggtggtagtcagatgtgtactctttgaccagttacctgtagccaatttgtcacactttctttctgaaacttattgaatagtttttaaaagatattttatcttttgagaatttttggtaaaatgcttagttggcaataacatctgatttatgaatttatatgatatccctcataatagaatttcaaaatacattttaaaaattactttttaatgatagaaggcaaattccacctatctgatcattccaaaggcagaattattaatttgatggcaaattgattttcatatattataaaaaatgatgctccaaatagaaaagttttacttaaaatcataataattttgccattgatcttatacaaactttaaaatccatatgttcaaagtacttaagggaaaaaggaagtagttgatatatccttgacatctgctgctaaaaattagattactttgtattcgcatttaaagtaaacaatgttaaacatggaaactatcaagtgaagaaatatgtactgttatctcttctgaagagttattcaaatttttattgttatataaattaaaatttagtgtaattttaaaaactcgttttctctttgtaactggttagtatatgccaaggcctgtgttaagtgctcaatatacattatattatttaatttatgcaatactatgaattattattatttccacttatccagtgagtaaactgaggttcaaagaatttagataacttgatatgctcacaggctagtaactaggcaaaacatggattcaaatttgggtttctgtgacttgaaagctcatacactagacccttactatgtatattataatttcagccatttgcaacatttttactatactttaaatgtaatatttgtgcatacataatataataggctatatttgtttatatatcttaaatgcattaaaagaatatgtggtacctgttactgtgcttagaacagctgtaggaattatgatttacaagcatgtataatatgctatctacctttcattctgcttggaaaaggatgacatatatgagtaaaatagtgagtgatatcatccaaattgtatgatatacattatcatataatagtataatatacgaaaagtgtgtgttagaggcagcaaatcctataggagttttgttaaaaatgagttcaatgtagtcatatgtcatcaagtagaactttttgggggagatgaggactaaacatggatggatgccaaaaaatcgcattggcttgtgtacacacaaactggacctgctgagatccatctgctttaggattaaggttcctctaaaactgaagagcgtcatgaattttctggttctgaaaatacttttagcacagtggccccatgaatctctatgccctgtgactgctttatattactccgatgtagccaaagaagtttacttggaattctagcacctgcctttgctcattggcaaatcccactgcttgacccataccattttcccacagctcccactttacctgagttttgtcctggacggtctgtcccaccatgctctcacctaaatccagccttcctacaatagcatccttccttgattcctgttctcattgagactaccttcctggcccctttgccagtgttctccgctaaagagatgttccccacagcttctgtggctggcttctccagaactttctaactccctataccaatctgtaggaagcctcacagtcagtattatgctgtgttctccatggctgagtcagatattcagaacgtgtgttttaaaagtagtaacagcttcaccatagcaaaagcatagcaaagaaaggcagtaaatcctgacacaattatgaatctcaaatgtattctttcttgctgtgctattagatatgagcaataatagtttataaggatatatgtaggcttttgataatttctatttttaatttgctatgaataatatatatgtgaaaagaaaatatttgtgttcaagatgagtcagtattttgcttattaaatatatgtcctatcacggtgtataaataagcataccactttgaaacaattaaatgttttgcaataaaataaaattcagatataaaatagttacacatttttcaaattagtctatttttatcaaggtttataatcactttccagtacatgaaaattatcatataaataatttaatagaagactctgctctcttcacatttcaaagtttattttttaggtatagaaaaaaatcaatattttttttctcattttcactcctagaattagaatccaaatcatttttaggtatttcttttaatgcttacttttaaatttacctaactgtaattttatccagcggtgaaaatctacaggatcagggtcaccttgccctgtgtcaagctattccacttcttaactgtctctgtacttaaaaatctatgtcatttgatattaaattctgagtttgtgtttatttaattttaaagccaaagataaaatagttcaacacaggaacattatcccagaaatgttgttactacctggtcatttggccactgaaactgaagaccagatgggaaaacatctaatggtttctcattaatacagagaatgtagttcaatagaagaggcaatatgtttgttgttgtggccagcattaaaataaaagtaatcaagaaggtaaagactactgatgtaggttgggagacaggagttggggagagggatttagtcactatgtttaatagaaatatataacagagtcattgattattaaactatgaagatatttaaagatcactaatacaaactcctcactttcctagaaaaaattgaggcacaaagaaggtaagtggcttaacccagtataatccaaaaaattaataattaaccaagactaggatatcatctcgtgactttcagtcagtactcttttggcctttgaaaaaatacagacctgcgtaagtatttatatgcaccaatatttggagaaaatatataaggaggaagacgagagggaagaagaggcagatgacgaggaggaagaagaagaaatccatgaaaaagctactgagaatcagtgaatacttctaataaaaaatggacaccaatttaaatctgttgctatctggaaattctctttcttcaccacatatatttaagaattactaaataaatgttagaaatcaagcaaaaacataacttgtgactccccttgagtcacagtttgaccactgttgctcatccagggcaacctgtgaagagtcattatctagaaagattcgcctgaataaggcagacattggaccaaagcagcctcaccctatgactaggactcgatttcagtaagttgtgtttcctgtatatttttgttcagaaagtggtacctgttcctcactggtctatcagactcattaaatgttaaggattcttaaatgggttgtaactttgaggcatcttctcttttgcagttttggttttgtttctttgcttaggtttcagggtgaaaagttgatgaaaataacattggtatggtaatttgattatgataaatataaataaaggttagatgttctaagacatagttaaattcaaaggacacctgtaagaaagtggaaagatagctgtaaaaagtttcactgacaaaaatatagattctttctcaagcctcatattcagaaattctgatgtaggaatatacaattttaaaagaaacttccagagtattttaaaggtcgtccaaggtttgaaaaacactgacttacactgtctaaatattggctgttatgattaactgataaagtttatattcaattcattgtgtatcatgttttgactagtttattgttgcttttatgtgtttgtttatgcttttactctgtgtttggattattcatagcttccttaacacccattaccgtagtttattgagagttggctcggttgctttggaaagctatatttctgcaattctacaactccatacttttgtaattaaaatagagttcagacttattatttggaactacctttaggggtaactggcaaaacacataaagaaattagcctcactgctatagctatgcctcatattttttccccaaaaagatatctagatctgagccttccaatatgacagccactggcaacatatggctatttaaagttagttaaaattaaatacaatttaaaatctagttccccagtcataccagcatcatatcaaatcctcagtaggcacagtaaatacttggtatttaacctctcaatattaaacagcataaatataaagcaaaaagttctattggacagcactcatctagaatgaccacctaccctattcacaagactagtctgtagaacttttaattatttgcaatacttaaatccacttttaaagggtaaaagaatttgccaacactaaagatagtcaaataattttgccataggatctaagggaggggacagtgctcgtattttgagcaatatctcaaatacatgcagtttagggactgtggatgactatagatgaatagcacagcttttatatgaatatgtacattttggtagtgtaccaggtatattctgcctgcccctccaggtccactcttcactgctgtctaccctgctctctgccccagaagctgactgtagttactatgccaatggacttccttacactttgtcttccagtaggtttggtatggagtatgagatcaggatattgtctcccactcccttctaaaaaggtctcaaaggctgactgcactgcacaacccaaggtatatcagttatctattgtggtgtaacgaactatctcaaaatttaatgacttaaaacaacaataatgtattcattctcacaatttgatgggttttctgcgttaataagtaatctaagaagttcctcttttccatgttttgttggcttatgcgattacattgaacagggaggtctgcttaagtcagaacctgtctggcatctcagttggagtagctagaacagctcagggtggctgatcttttctctatatattacagttgaatgacactacatcattgctcaggggttcaagaggaggaaagtacaagtttctagacctctgaaagtctaggcctggaactggtccagcattacatccacaacattacatctactgcatcttttttttttttcctcctttgagatagggtcttgctctgtcacccaggctggagtgcagtggtgtgatcatgactcagtgcagcctgaaactcccgggggctcaagtgatcctcctaccttagcctccccagtagctgggactacaggtgtgggctaccatgaccagctaattttttaattactatttttttagtagaggtgtggtctcactatgttgcccaggcttgtctcaaatccctgggctcaagcaatcagcctgcctctgcctcccaaagtgctgggattacaggtgtgagccaccacacctggaccatcactgcattttatcagccaaagcaagtcatgaatcaacttagtttcaaaggatggagatgagacttgatgggagaagcagcatgcacctacaaatacaggagggattgctggtagccatatccaccattgaaaatcacagattctgtctagggacctttctccatgactttcttgcttttgatttcttggtaaccacttgttccccttacccctccaagcttaggggtggtgtgactccccggttcttacgaatccctacacactgaattacaccttgtgaatttcctatgcctgtttaccccagtggggtaacttcaaaatacctgaatggagaattattttcctgcttgatcctgtttcatctattctcaaaaattagttatgttgctttatcttactaccttatacctgaaattgttcacaatattctattaatttttttgtagcaatcataaagcatttaaaattttcctttacccagttagctttacatttagtctttatgatttcttacattaggatttaatcttgatggagaatgaatattaagtttaactaacatatctgtaagccattatttcaaaatgaaatcttctgattttggtaacatctgcaacctccagtgaccagacctacagtctttaactgtatgactcagttctgtgttctgtgttcagtatcaatgtcagtagtgtactaaaatgtccattttttctctaggattacataaatcttttacatttgtgtcttaaacaggtcaccaagcatttaactttaacctttttatatcatttatgttcaatagaattcactacttttactactctcatcagtgcttgtcttctgacttattaataaattaatgagcttgttttaacaattgaaatttaaaccagatggtcatatgattactcagtgttttcaggatcgaggattttaaaaactaaatgtcattattcccctcagacatactgatttcttgatattaaattattttaaggtttatagaactagatccagaaaaaaatgcttcgtattgtagaaggaagagagctttccatctttaatttacctaaagtggttttccaaatgattatatgtaaatatctgacaccacattgttttcttttataatttatttttgattctgcttaaagaaatacaaggctttagcaaatttaaagtggtccactaccccaagacttaagaaaacatttatactaaacaaatttaacaatgtatatgtcatatcaactgaaaatctgaatttttacttttttgctcatttttctgacagaatatgatagctgtctgaaggatatgtaatatttataaatgggatatagcagatacaacctgttaatatgatatacactagagttagagtatatctagatatagaaatactagatttgtaatattgagaccacattactgtgatatttcattgcagctataataaatttttatgacttatcataaggtaaatgccaactttgcaacatgtatctttttttctttgcaactgacattctatgttcagattcattgtgctcctgatatattcccatcatttcctttcctgggagaatccctttcttgtgaactacagtgacttttttattgacatactgcaagtgcagaagctttccaacaaagcattgctttgtaacagtagaccaggtacattctgctaagcaataaatcatgtatatattcactggagcacaaaaatattttggtgatataccaggtaaaaattgatattctagtagggagattttgattaaatgccctttcttctacaactttggtcaaatttcaggtgtttaattcccatatatgatgatgtttgtgaacttcaatatacattgttatgtttttcacctgaattcccagctgaatgtaaaaactgagaacaagaaaaggtgttattacttagaggtgtttttaacagctctccaatttcataacttgtcatttcccttttctttgatttagaaatgtgttatactcctggaagttttcacatttgatagatgtaaaaaatagaatactttgagagggattatactagcatagtggttaagagctcagactctggagccagagaactgggttttacatttcatctgtttcttacttgcttttaacactgtacatgttaatgtctcaatgcctcagtttcttcatctttaaaatggaaataatatccatatacatagggatagtcatactttatacagttatggtgaggattaagagttaatatatgtgtagtgcttaaaaagtggctgtcatataataaattctatgtgtttgctatcattgttgctattgaaagacaatgaaagcacatttgctcatttaattagttccagtcattgttattaatgtatttcatttcatttttcctgcagtgaaaaagaatgcaatggatccttttgccattatttaacattttaagttgcatttttaagtttatatataatgtattctacaatatttcacaatatatgagatattgggactttaataataacttgtgtgagtaatgtctctagtcttaaagactctaacactatcttaaccaggcaaagtaaaacactgtcttaactactgagcaagtagtctctttgaaatcagcccattttgtggatgccatatacatgttacactttaaagcatataaggttgatactttactctttctcaacattgattagagactaagaccttgttttgactataaaatatatttctttaagagggagaaggagacagtgccctgtgtttcagtgaggtatggaacacctgagttcaggtcaaggtcactgccatttacttgctatgttgatctcttacctttgtgactcacagtttctttatcagctaattctgtgattagtataaaaatcaaatatgagaaataatgtcgaaacactttagatgctgaaaatattacagaaataaaaagcagtgttattgaagccactgtacctttatcctgctgaagaggttaaggattaaattggttttgaatatatattctgtggtagtggggttggagcattgcagaacatgctgatgcacatgcttagggagagggacaatgatttctagccaagtgtcagaaggactgtgtggtcgtgaaacacaggctgcatttggcagaagtgatccaagctagaggtcagatcagtggtgtccaaaagatgatttagaagtcttctttttgcccaaagccttttgatgaatttcctatcaagtatttttctaagaactgttaataaatgtcaaaattaacagatttcagttgtatctccttttcatcctgactctgcaagatagactccagaatatagcctaaaggaaagagaagaaaagaaaaagtaatggatagagtagatgcttctaatataaaagatttccaataggctgagtgctatataagaaaaaggaaaaatatttgatatttttaactaacatttattgcgctacacattttgatagcattccaatgatgattcgacctgccttgtctttgagattcttcaactagttgaggaaagacatctatcaaggaaagtatctacatttctcctgaagctatctgaaagagttccactgtttccctaatcaggttgttaggtaaggacaaagatgagagcatgagtaatagaatttgtggggtaggtgagggcagccagaccactgcctcggcagggaacaatttgggcagcctccaaaggaaagggatctttgaggcaagagatttaaagaaggttttttacgaagtttgtttgtaagtaatgtacccttctcttcttatcccaagaaagcgtcactgaacttctgtatttcatttcagtccatttgagttgaagttgtgggtatttagagttatttttggatatgatattatcttgagactgcccataaggtgagagaaacaagatgtcccaataaattttgcatacagatttataaagaaataaacaaaatacagggacactgccactagatttttacataatattcactttaaataacattttaattgtaaatatttttggtcacgacctctaaacaagtcaataattgaaagaaaaacaaataacataattgtatataacacattgtacttttaatgataaaaacaacaattacgactaccatttatatatgcccagccaggaaatattctagatgtctttatatgatctaaccctaacagtaacttgaaacatggtagatgttgatagcctcatttttaatattagaaaaaggaagctcaggggttaagtgacttgccctagattaaacagcctaggaagttgcagagctggaatttcaattgaggttgcctccgaagcctattctttttccaacttattgtattccttttgaaagaacacaacttattttaggaattactcatagaagcatctcctgttaattcgatatttatagtctcataaattgaatcctaaattatagcgttttagaacataatatataaaaaaagtggaaaacatttcgactggtgcaaagaaaatgattaagaggataaaaatagcccaaggcaatagtattaagttaggcaaacgtaagctgaatgttgagaagttaagaatataggcttcttagatttcgattttcaaagtaataacttttcttattacagaaattgttttttatgtatggtgcttattactaaaaaaagattaattatctgtcattcatgtcaccaacttactaagttgttacattggccaatttttgtctttcttaaattattttttatctcatgtttctatctcatttgggggaaagaagaaaaaaggcaaaagaaattcctttctgaatatccatacacattgaagttttatgttcatagtaaactaataactatttcttcagtgtatgacgttatagtattttttcctccaccctcaccacaccttgttttagcaacttagttcattgccaaatcctgccacacctccctttattccactcccatatccaatccagctcatcttttatcgtactgattttaggaatgaatatggtccccttatttaccaaaaggtgtctcagaagttcgtgttgtttcctagtgttcattaaagcttgcagatattgaagtgtcaccagggcattctgatggagatgcccagcaggtgtttgagattgtccctgggaggtcagaatttaggattctatttaagacagtagtttcaaatctgagtgatataatggctctcctttaagagaagtaaaaataagaaatctgcaaaagacattattttattctttttcatggctgtgtagtatttcatggtatatatgtaccacattttcttcttccagtctaccattgataggcaactggccccatgagcatcttgcaaatcccagagtcagaagcaactacagtaagagctggcatgtaagggttgctgaactgcaatatcagacaggcatttgagtctcagtgacagcagcattttctagaaaacagtggtatctccattggtaaagatgattggaatggtgggagagacacttcttatgaaccagtaatttctaagccaagtacagtaatgttaagttcaagaactatatgcaaccaaacactagataatataaaagtaaagcaaattaatataaccaacttcaacatctgtgacagtttgtgttttccagtgatgaccacaatatctcctatcccatatattcttctgtaatgtgactttgctccttccccataaacaggtagtcttattcccctctttttgaatgtggactgaccttaccaactcatttataaccattggaatggaaaagaattcatgtgtgttccttccaaggctagatcagaagacgtgtagcttcttccttagtgtactgttctggaacactgactctctggaaaattcccgctcagcatgcttcctcttgggagctgccatgctgtcagaaccccaggctacataaaaaggctacgagccagcactacacttaatacatccaactgggcccagcctccaagtcatcccaactcaggtgctagacttatgagtgaaggtctttatgtgcaaaggagaaagcaaagagatctttgatgaccagaagaaatatattgccacagagacaataatgcttaccaaatattctatgcacacactcacatttttttaggccccttgcagttatttgaggccaagtaattattcttggagagtgagctatgagtagcatgataaatgtcacttcccaaccataacagagaagatcaggtatgaataaacatgacatttctgatgtcggagctttagatagcctagatccttaagtcactatgtggaagagaaagccctgccaacctctgttagacatcatgtagtgtaagtgaaaaacagacattcttatactactgagattttggagttattttactacctggcctattcttgaataatatactttcttcatttttaaaaaattccattttacttaatcattgatttattacacttactgagttcctactgcatgtcagctacatcctgggaatagaaagatgaataagatgtagtcccagttctcaaggacctccgagtctactgatgaaatttttgtaagtacttaactgtgtatttgcccatttatagactttcttcaaaagagatcttcttggaaaattcaaattatttagcctggaatgcaaagcctttcaaatctgattttacttgtcatacatgtattatttttcacaaattccaaccacaccacatctcacttttctaaaaaaatggactgtatttctagaccactgtgattcttgcatatgctagcaactttgcataaaatgacataaattatctctgttcataaaaattcaacccagcctttataacccagttaaaataccacatctttatgaaatatgtcatgactgtatcaccaaatatgatacatttctctcctaaaaccttagtgatagtgtgttcatttcttttaactctgtctccactagactgtgggttccttgaaaacaagaactacttgcttatttctgctgaacctacacacagtctagaatgcatttaaaatctcatgtttagctgcacatggtggctcatgcctgtaattgtagcagtttaggaggcctaggtgggaggattgcttgaagccaggaattggagacagcctgggaaagatagcaaaacctaatctatacagaaactaaaaagattagcctgtagtcctagctagttgggaggctgagagtggaggatctcatgagcccaggagtttaaggtttcagtgagctatgattgtgcgactgcacactccagctccagcctgggcaacagagcaagaccctgtctcttacaaaagaagaagaagaaggagaagaagaacaagaagtggaagagaaagagaaagaagaaaagaagaagaaaagttcattttctgtcatggggtatattatttatctgcttaagccaaacagacattttaggagcttctgtcttgccttatgttcttgcttgtctagaaatacattgtaatgaagttccttttaacagatatttctctaggcatgctatcttccaaagttcagtgttcattttattcactgcagttatttttattacagcaaataagaacggaaaaatgcaaaaggccataggacttctactcgggtacccactgtggttacatacctggcaagatgttgttaataatggtgtaatagctaacatttatgagtgctactgtgtgccagatagtcttttacatactttacatatattcaatttaattcttataacaaccttattaaatagcttattattatgctcatatcttaaagatgaagcatgaagaaagctcaaaaagctagtgagctagaaaacagtaagtcgagatcgcaggaatccaggccgtctgtctccagagctgtgctggcaatgctctcagcaagaaaggaagttccaagccctttgtagttgttcctaaataacaccgggcaaaattttgcaaatcaatctatctggaaagaaaatctaatagtcgtttcagtgactattaaacaataacaaaaagttaacagtccatataattatagtttcctaaggataattcttattgttagatgaaatttactctagcatatgaaaccatatacagtgacaataagggaaggatgttgtgatgcacaaaactttaatcacaaaaactaaagaaagcaagtttctcagtaatcatggctggagaaaacaaaaagaactttcaaagatattgtacattttactagagatcgaccatagcttaactcattaaagaaaacagttaataatacttctagagaagtacatgtttattcagcaataccttggcataaccatctgcaatacatgtcttatatgcaaaatttagtagaattatttactcagttatctaaataattctaatccacatgcaacttcactttccaaatgagaaaaaatagcagattagttatatataatttggagtgagtgactgagatctctgtctatgtatgtatatctgtattatctacaactgtatctgtatatgtatatatatatatatttatgattcagtaagtatgcagttaagaacacaattctgaactttctaacatctaatgtctaatttatgctgtgtcaaatgtatttttttaaaaaaagataaaaggcaaacataagtcaggggaaaggagcatagagtggagggggaaagaaaaaagagtaacagtggagaaagacggacaggaaaaggataaacaagcagagcaggatggctgattacttacagcatgtgctgaatggagacactcacaggaaacatcatgtcagatatgcttaaatatcgaacttatttctgagtttgtgttttttctgctacacccatgaccaatgtctcagttaaagaaagtagagacaaaagacaaatgcttaaatttcctgatacatacctcttatttacagtacttcttccattgctgtacttgtttttatttctggcagctttatttgcttatttctgagtacccagcataatgtcttacatatagtacacatttggttaatatctgttgaataaatgcattcatgaaagaatgaataaaagaaaacaagtcgatagagggctattgatgtgtgtacatagtctcatgggctaaaagctctaaatgcaaatataaggggttccaggaatttcagggctgctccatgaaaaagatatggccacaggtagaggtagcatacataagctttattttgctaacactttgacaggtttgatacaggaaaatccctcacagcatggaactgtccagaagttactgcatgagagccaccattcagaaggggaggacagcaagtgatatggtttggctgtgcccccacccaaatctcaacttgaattgtctctcccagaattcccacgtgttgtgggagggacccagggggaggtaattgaatcatgggggcttgtctttcccatgctagtctcatgatagtgaacaagtctcacgagatctgatgggtttatcaggggtttctgcttttgcttcttcctcatttttcttttgctgccgccatgtaagaagtgccttttgcctcccgccatgattctgaggcctccctagctatatgggactgtaagtccaattaaacctctttttctttccagtctcggatatgtctttatcagcaacgtgaaaacagactaatagagcaaggaaactcccagaggagggagagaatagggagggggcttacctatctaggtgatgttcctcggcagcaccacattgagtctctgcatcagagagctccaaagggtatcagtggcttggcatatatatagcccaggtgctatctatagcctggggccagcagatatcgggcatagtttcatggggtatgcaaagtaggctgtttgtaactatttaaatatctacttatttagtctatgttgaaaacatagtgaaacgaatgaaaatttgagtttggtatgggtttacttttggactaccaggtctcagcctgctgtgaagaaataaacaatctatggaccaatatacaggagccatctttggctgatttatataacagtaaataagcatgatataaaaaataataattcaacaaagagaggaagtgagtttattggtttttaccaagcattatttcatatactaaatttcttcaggcacatcaagctaaaacattatattaagaaacaggtttacaccactgtacatgtgcaaaaattaaggatcatttctatgatttaactaatataagtacaattgaacaataaataccaatctctataggttaagaaataaactacgaatctttttataaaattgattatgaaatgaactctcccacttttgttattattttaaaaatttatgtggagtagttaaaatgaattaaactccgaagaaaagtaaatcatcattacattttcttttattaccactttgctcattaggaaaactcagttctggcttctgttttgggaaacagtttgtaactgtgtttaatatcatttgaatatctataatcattcttatgcaaatagcatgataataagtattaacattaaagacagaagtttatatttgtcttatattatctgtccccttccaaaaggaacttaaatcttaagtcaaatgctgtaagtgcatgtaggttatttatatcatttctgtcactaaaggtgtcatatgcatatcatagatgccagcaagggagaacaaaccaaaagtcctatccagtcactgcagctggctcaagtttagaaatctggtcatataatgtagtctgcacattatgttctgacttgggtttcttggtcctgagacctaggaactgataaaagaaagtatctcctcactccaaacccaatagacaatggtggaagaggaataagttaaacagtgtaaaccctccattcaaaaatgggaaaaatagcaggcaccattaggcatagtctgcaagcattttggaaatccactgtgcagtagttgtaaaagtgaaggatcctgatgcctgggaggaggtccttctcttactatttcctggaatccctgcatggcatgtactctctggaaggtacttcttttccattatcctctttggccatatctgaagtatgtgtgacggaatatgccttacttgggggcttcagtgaaggcttttcttcctacttcctgcttaaagcaagttggtagcccaagtgtaattttaagtcttgaacagtactagtttttgtttgtttggttggttggttggttttttttttaattccaggtttgttgttccttttgcagtacaaccctctctgaaactcactgggcttcttatctgtttgattacagtgagtcctatgtgccaattaccctgcctgcaggttttttttagagatgttattctcagatctgctgtattgctttgctttctctccgcatacttcactctctagactcagtgagagctacattgggactatctgacttctgcagaaaggttgttttcattctgatctctaccctgagtcattttatccagttgaaatgttttggggtaataacccctaatttgatatttgccctgagacatcatagtgagctcaacaattgtaacaataggcatgaaggctatacctttaatcatatctttgatactgattaaattttaatgggcctctgtcattcaaagtcttcctcagctatatttcttactgtttagggcctttagtagttagcttttccaaaattgcaaggcctcaaatttttggactctctgaattccatttcatttctctttgcaaactgacattactttttgattaaaggtctttccttaataccctgttaaaagtagtcaacatactctactaatattctattttccattatcttctcctagaacttaaacacatgagatatgtgatctgtctcccactttatcaaagacaacatttaaccaaatgtttttgtactgcataacatagattgctagctcttcagcttccagtatcaattttctcataatctgcctgctaagtcaatgccacagagtttaggtttttgtaacagcagcgctctactcctgataccaatttctggactagtctagataggctttgttatgctgtgatggcaaattaaccctgaaatatcaatggctttatatgaaaagtgtttatttctcacttctaaggcatatctaagacagatcagcaaagggtctctcttccatctagttactcagagacctaggctaacagaagagccacatctagatcctcactggtcaccaaagcagatgtagagagagtacctggagagttgacatcttctctgctttggcccagaaataatagatgttatttccactcagtttattggcaaaattagttacatggccctgcctaatttcaagatgcctagtaactataggggatcatatgaaatatttggtgagcattgcagtctcttctacagagaaaactcttaaagtatatgcagttatgaaaagtctatgtaaattaacggctgtatgtatttgctaaggctgtagttccagagctattagaaatcctgagctttgtagtcttggaagactagaccagataaacaaaactaattcttctttcaatgggttaataatgtatttatcaaacacattaaggaatgatatggacaaaaattttaaagtaagttcaagaaagagatgtattgaaagcaatagctatatatatagcaagtggactatagaaaacaagtggtatccttgaagtgtatccttgagctttggaaagataatcatgtgaataccatgctctttaacagggagacacttgggacatttattagactgaatgatgggcttgagagaacacttgtctgacctggtattgcactttttgtgtttcaggagaaatgatttatacctatagtgtatccatatttgaagtctagtgtggttctgctttagttggcagtctatgaataatatccttttttaaactatcaaaatttacattacgtacctctttccagacatgtggaatgggattctactattactagggaatggattatgatgaatacatcttctcatgtacaaaatagaaggatttaaaatataactttgaatgtcaattaataggattattaaaaatagatttgtttggtccttctatgtcatgtgttaattagaggctaagtccttgaaaagttaatagatcaaaattaatacagagtaagtattggacaaagtcactgtaataataatgctattcattgagttatcacataaagacttttacgtgtgttatctcatttatttctcataataatccagtgaggcagtaaaattattatccccactttaaagatgtcaaaactgatagcagtaggttcagcagctgacccagtgtcacacaaaaagtagcaggactggtattcaaacccaagcagtctgactccagaagaccacattcttaattccaactgtatactagtatccttccgtttgatagaaggttgtgtttttattagatcatcaaattgaaccatctcaagagtgtatttgtgttgttagagtgtaactcagtagttatcatgtcataatcaactgaggggaattcttcaagctacatagatctttttcctgctcttctcccttgcatcacagtcagtcattcattctcacatgtttacctgggtgaatatataactaaaaaagaactttcatgtaattttaatacaccatcccacccaccacttctttttgagaaccactgctcttggttatattggtaactgtttttgctgtgtaaggagaaaggtgacatgtgaaagaaatataggtaattttttctgaaacacattaccataaattgatcctgagatacaatgcagtggttaaaagtaaaggattcatggtcaaacaaggtgttaacttggtgtgcagccctttattgttgtagtgatttttttagactgttttagacttgatagaggtctaataccagttcttactctagctgtgaaaataaaactctgttggattttcctttcttgttctctttgattagcaggatagataaactgaacacaagtctcaccctagctccacaacttactgtgtgaatttaggcaaattgccttaggatcctgtgcctttgtttcctaatctgtgaaacagaaaaaaaggaatatgggccaggcatggtggctcacacctgtaatcccagcactttgggaggccaaggtggatggatcacttgaggtcaggggttcgaaaccagcctggccaacatggtgaaccccatctctactaaaaatacaaaaattagctggcattgtggtgggttcctgtaatcccagcgacttggggggctggtacaggagaattgcttaaacctggttgggggacagaggctgcagtgagccaagatcgcaccactgcactccaccttgggcaacagagtgagatgccatctcaaacaaaacgaacaaacaaacaaaaaggaatatgtacttgatatgttgctgtgggaaccaaataatgcctatttgtaaactgtatagaaatgtgcccattttatagtaaacactcaatagataatacatatgatgatgatgatgatgatgatgatgatgatagaagagccagccagttccctacctttatgctcttgtgctcccaccagtggaaatctccctctaaaggaacaaaacagttgacaactgctagctcttagaagctgtagacctctaagtcaaagtttcatcaagaaactacatttttaagtatcacaacagaagcagtattaggaaagagattaaaggcacagaatctagactgagattacttggatttgaattctggttctgccttttctagctatgtaactttaagcaagttacgtattctctcagagagtcgagttcatcttctgtaaaagggggatggggaaacaatcaaaaacttttctcataaggctattattaagtacatattagcattactaaagtgtttgtaaaacaatgaatacatttgtataaattgataaagtttttaatttaatatatgtttatacatatggatattatgtattaaattatgttttaaatttaaatatatttgtctgccaacacatatgttattccatattaaaatatcttttcaattatttcatggaattctggaccaacagaggtgcaaacattaacctttagatttgactctgagcttcctagaagaccaaacaaaaagacactgtcatttatataatttttattatgataagctttccagtattgaatttattgccacttaatttctcaaacattaagttaatttcattatctgtaaggaaagcattatttctaccttctatacctagagagtttttctgaagatcctcttagataatgaaaatgaatatgctttctgtgttgatagaaaccctacaagcaaggtatatgggaagaagaagagaactagcgttttttttttttttttgcatgcctaatatatttaacaccttttgatattaacctcacagcagcctcactgactagataacttatcaataaaaatacatgactaaggttttataacaaattgtagtgctggaaaattcaacccaaacttacctccaaaacccagagagggcaaataattaaaatccagatgaatcacggagaattaatagaacaatgtaaacaaattcctaagttgaaatttgtataagcaaattgaaatttattcctcaaagaattgatataatttatgtaagctattttttaagatttagcataaattacatacacattaataaagcatataagcagagacatagcaaataaataagctctgcctaagaaaattttcattgacctgtgttttagcccaattagactgtgagataataatctagatatctgatacacatatttttatctaatcatgtatcataagctcttctaggaatagtatcagtatactatttatggtaattatttccatatacagaaattattgttctgtattaattattacatagtagtttaattgtaaggaaagttgttttagatacctggtaatttctgtacaatttatattttttcattagcaagggcttataatttaaactttctactttttgttaattttttttagtatatagtatataatatttatgttcttaacaagatatttctacaaatttatattgggtcctccaaaatcaatgcattttgagggtatgttacaacttgaatatgaagtatagcaagaaatatttttctctgtgtgtctaatgatccactgtgttgcctgtgtgagtataatgttattacaagcattttttgtaataacattagtacaaataaaaaaagtttctgtttttttttttatttttcctctaacaattttatatctgtaaggttttttaaacagattttggttcaggatatttacattaagaaataatattactgagactttgttcaaatagagctaattattgtccataatatagcataatttaaaataaatatgagcttttgagtaaaatttccctgagaaaaattccactatgtaatatatcaataaacttgggttaattatctaacttccctgaatcttagcatccttatctacaaaaattagaatgactgtatgttcattacagagttgttgggtaaattcaatcagataattcaacccaaattgtgaccaaatagtgtaatgcacatatagtgtaatatctgtatattacacactgtatgtctaaatggctagcatgttatgatacttaacaaatgttagtcttcctcctcatttttatgttaatttaattgatttgtggctgtcatcacagaatatagtatattctaaaataatgtttcttttacaataattttcaacatataagaagtaagtagttatccacagatagaattagcaacttggagtacatcagccatttccaatcataaatccatggatgggtactggcctctgacttcattttcactgtacaattagaaaaataaggataataaaatttattaagctaagttaatttcagttaattattgtggtctaattgtgttgtgattcagatgtcttccacaaaattattataacatagtgatgtttgagattttaaaaatacccttttgtagcaaaatcaagaagttagaactcctctgtcaattattcatctttatttctaaatttattttaaatatcaactctgccatgtactacttgtatgacttaggacaagttatttagcctctttatgatataattttatcatctatacaatggagatatcaataatgactacctcgtggattgttaagataaaattagataatacatgtaagactcacagagcagttctggcatataataagtattccataaagagctaaagctactgtcatcatcactagtctgtgaaatccaaaatgtgagaatcatccatttagataattcgtcttatgccaaaattactttaaaagtaggaaagcctatgtttacagatgttataatacctcaaagtcatagacagtctttgtagacacatgaagttgttattgaatgtgaaggtattttacaaaatatacctatttgctacaatagattgaatattgtcattgaatatcatctgtatttttatttgatgattttaaaaggcctatttttatattagactaggcttttgatgcttttgttaagtccaagaatacaattgatgcctatattatattttgcatgtaatttaattatcaaaatttttcttagtttttaaatatttcttaaactttttcatataccaaatgcataatgatgagagtctcaatagttctatttcaaataaaaataaataattgccaaatatggaatattatttctaatttttgttcacttttgagttaccatacatagagctctagaaacttctacaaactttatttatagaagtttaggaaaattagaacaatgtttataatttattaatttattaattatttatccaataattgaataatatttttaaaatagcttagcattttatttgaatatgaatagcatttgttctattttctcagaaggaagtgctatttttatctaaattctgaattattaatgccacactgtaagcaaaaagtacatccatgtttgaatggttgaagacgaagcattgcctttgagaaagaaaacagtacaataccgcaaatggttccttacagcaaaagactctgcttccttacatagttctagagaattctagcctcaccatttcttgagctacacctacttagaaaccttagtctgaccttttctaagtatgaaagatttgccctttgtccttatgggaaaatgagagggtttggtaagacctgctattaaccttcattaatctgcatttttagaacactaacaaaatcccattcctagaatgtaaaagctaagtggcagatactctatcttatttatcttttcatcactattacttagtatgatgcttgcaaggcacattaataggtgctcagttagcatttgtaaactgaatggatttcaagtccgctaaccaaaccagcacatatcaaatatgtgattacttttaaggagtcatgtttcaaatgggtcatttaattcatgtttcacactcttaggcttgatatccaagttatcttccatcattttgcattacatctattacaaaactgatagaaaccttgactgctacatttggagaagttagctaagcaccttattgagtaataatataaagttttgttaaaccactttatttaagggtgacttatattcaaaaaactctgcatatttaacgtatatacttgatgagtttggagataagtatacagccatggaactatcgacagaatctatgctataaacctattcattacctccagaaatttccttccaccttatttatttatttatttaggtgattgtggttttgatttggattttcctgatgattagcaattttgatttggattatgatgttttacataacaatggaaaatctcgtctcagcaaaatgttaagtatataatacattaactatacacattatgctataattatacatataattgtgttgtatagtaggtctctaggacttgttcatcttgcttaactgaaactttgtacactttgactcacacttctccacttccgtcttcccccatttcctggaaaatcaccattctactctcttgcttctatgagtttggccattttagatttatcatataagtggtgccatgtagcatttgcccttttgtgtctggcttattttgcttagcataatgtcctctgggtacacctgtgttgttgcaaatcgcaagattgccctcttttttgaggctaagtaatattccattgtatgtatataccacattttctttatccgttcaaatttaatggacatttaggttggacatggacatggttgttagtattgtaagcaatgctgaaataaacataggaatacagatacctctttgagatattaatttcattgcccctttggaagcaggattgctccatcaaatgatagttctatttttaatttttcccttttattgatatataataatttatatagttacagggtccatgggagtgtttgttgcaggcaaaaattatataatgttcaattcagggtaattggagtatcaatcatcttgaatgtttatcatttttagtgtattggtattctttcaagttctctcttgtacttatttcaaatatacattatattattgagaagtatagtcaccctagcctgctatcaaatattagattagaacttattttatctaactgtatgtttttaaccctaatcagtctctcttcattcactcccccgctccccactgcaacccttcccagagtctggtatctatggttctattctctatacccatgaaatcaagtcttttatcttctataagtgagaacatgcagtatttgtctttctgtgcctggcttgtttcacttaacataatgtcctccagttccatccatgttgctggaaatgacatgatttcattctttgttatagctgagtagcattccattgtgtatatatatattacatttcctttactcattcatccatcgatgagcatgtaggttgattctatagctttgctatcacgaacattgctggcagtaaccatgtgagtccaggtatccccttgatacactgatttcctttggatagatacccagtagtggaatggttggactataaggttggtatactttaagttttatgagaaacctctctactgtttccacagtggctgcactaatttacattcccaccaacaacatatgagttacctgttctctgcatcctcaccagaatctgttatttttggtctttttagtaatagccattctaacttgggtgagatggtatctgattgtggttttgatttggattttcctgatgattagtgacgttggggcatttttttatatatacccattggccatctttatgtcttcttttgagaaacaactattcgtgtccttttctcatgttttaatgaggttttttttgaaactgttgagttgtttgagttccttatatattctgtatattagtctcctgtcagttagtaatttgccaatattttccccattcagggggtggtctattcactctgctgatggtttcctttgctgtggagaaacttttaaatttagtattatccccccttttttatgattgtgcttttgagggctttgccataaaatctttgcctataccaatgtcctgaagatttttctctatgtttcttctagtagttttatagttttgggtcttaatttaagtcattaatgcatcttttgagtttacttttgtgtatgatgagagataggggtccgagtttcattcttctgcatacagttatctagctgtcccaataccatttattgaagagagtatgctttccctagtgtatgttcttggtagctttgttgaggatcagttggctgtaaatatttcaatttgtttctgggttctctactctgttctatgggtctatgtgtctgtttttataccaataccatgctgccttgtttaccataaccttataatatgttttgaagtcaagtactgtgatggctccaacttgtctgtttcttctacaatttttttgtgtggtttgttcttgattttctagctccttgagatgcatcattagattgttgagatgcattattagattgtttatttgaaatctttttggcttttttatgtaggcatttattgctaaaaacttgcctcttagcactgctttgtttttgtgtcccgcaaaacaaagtatattatgttttcatatgttgtgttttcattttcatttgcttaaagaaattttcctctaagaactgttcttatgttgctatgcccatattggcagcagtgggatgagcatgcttgatcttgggccccagaacagcatacactggcaccagtattagcaggatcagacagactgattcttaggcctctaggtggctgcttgcttggatgctggtagtggcagcagtggaccaggaaagtatgtatctctgggtcttgatcagtgtgcactggtgttgatagtggctgtagtcagagatcaccattcacagccccagacacagagctcgcaggctgtcctgctctctgcagcaacagttctgtagaggtggggaaggaccctgcctgtcacacactgtcctggacgctggggccacaccatcagtgggggcacagttgtcattcatagccccacacaggtagcctctgttcatgcacctcagcctccagtggcagcagcaatggctgtacttgtaacagtgtgcagacggaaagaaggcatcctactctgtacatatgaggcctagcagagaggtcattttgctggtgagaggggatctcactctctgcttgcaaggccaagtacagaatttgcactactgctggagacagagtcacttctcatagtcccagacagggaggtcttggcctctgaaaagcatgtgctttgtttcctttgtcccacggatggtgcgctgtaccatcctttccccaggaaatagtactccctgtggattacagcagcagtccccaacctttttggaaccagggaccagtttcatggaagacaatttttctacagatgggggtgggtattggggggagatactttcaggatgaaactgttccacctcagatcatcaggcattagttagattctcataaggagcacacaacctggatccctcaaaggcacagtttgcaatagggttctcgctcctgtgagaatctgatgcccctgctgatctgacaagaagtggggctcaggtggtaatgctcactcacccactgttcatctcttgctgtgtggcctggtttctaacaagccacggtcaggtaccagtctgtggcccagaggttggagacccctggaccagagtactggggactatgcagaatcttttgaaccaaccaacactgtgccactttagtggacactgggtggacactgagagatgtcagttggggctcatgggatgtagagatatgggggctatgattcccagggcaagatgcagtcccatggcaactgtgccctcacaagggtgcccagctgctgctgcttaggtcttggcagggacaggaatgagtgacaatgtgcaagtcctctttctggagcaatgtcctcatggaccctgcaaatcactccctatgctagcgtcagggtttctgtgggcgtaagaactctcccattgctcaaattgcagcagtccacagtagggatgtggactgctgaattacgctttacctacaataccaagccccttggggctcccaagccaaccttctctgagctggctgctgggtaccttttccttctctgcctcaggtgtttcctgtggcatctctgttagacatcagtattctttcctagatgttctattcaaggtatgattatctattcataattttggtgcttccttctggagaaggcaggtgcccaatgtctgtagttagccatcttgaaccagtgttcttatttttaaccttcaggaacttccatagtgttttccatcgtgcctgtaccaatttacattcccacaaacaatgtacaagggttccattttctccacttccttaccaacattgattatcttttgctttttgggtaataagcatcctaacaagtgtgaggtgatagctcattattttgatttgcatttccctgatgggtactaaagttgagcaccttttcatatacattttggccatttgtataccttctttgaaaaaatatctattcaggccaggcgtgatggctcacgcctgtaattccagcactttgggaggccaaggcaggtggatcacctgagttcaggaattggagaccagcctgaggaacatggcaaaactccgtctctacaaaaaatacaaaaattagctgagcatggtggtgcatgcctgcagtcccagctatttgggaggctgagttgagaggatggcttgagccctggaagcataagttgcagtgagctgagatcacgctactgcactccagcctgggtgacagaggcagaccctgtctaaaaatcaatcaatcaatcaatcaatcaatctattcagttcctttgctcatttttaaattttgggtttttttcttatttttcatttttaaattttattgtttttgctattaagttgtcgattttgtttatattttttggatattagtcatttaccaggtatatagtttgcaaatattttctccaaagctatgcctttttattttgctgattgtttccttcgctttgcagaagcttcttagtttggtgtaatcccacttgacagttttaggttttgttgccagtgctcttttgtgtcatatccaagaaatcattgacaaagccaaatataaaattcttaacttcaccaatgaggcagttttgacttcatgaggttctgaaactttttcctagagttgaatcaaataatacaatttaaattcctaattctttaacaaattaaagaaaaactatttcctccaactatagtaaggcaaaattttggctattaaacaactgaactctttttaataatgtgtgaagctaataggtgcctgatgggaccctattgctttgaggatctaattgcagacagaactatttattctttgattactagacttgtaaagcaggagttcaggaataatgattagcaaacaagattgtgcaggaatttgaagaataaattgacatatatcactgaaagcatacaaagtttcagtcaggagccatgaacccaaagcatatactgttctaggtacattacaggtgaaggtcgctgcattacatttaagagcctacgggcccttaaaagtttaacttgacaacagatgttagattgttcaagtactctaaaaataatcccttaatatatctttgtaatacaatagcacttgtattcctaaaataattttataaattttataaataataaaataatttttaaaaaatttgaaataaaatgaaatataatcctataagagattcattgaatgtttttaaaacattttatttatttatttagaatgcattttaacctactgaaatccaatataaataatatgtagaaaatagttataaaaaacaagttgtagttgtagaagacattaatgttttagaacaaagtatttcaagcttagtgttcaatgtatatgtgatgctaaggtcattatcatttggccacagatataacctatgagtaaaggagagtccttgttttttcataacctcttctgaatgcaacatccctctttataataggcaatattgcttccaagttgccatattcttaaaaaggcactgagtaagatcattgatcactgatatttgacatatttatgtactgaagagcacttttgtggaaaattcttccctcaattaattagatatgtttatatgtttatatgtaacagaataaaaagggaagatttcattcaaataagggcatttcaccagcccttttatgattatatatagtaatagttttttactatttaaatggctgaaaggtaaccacttttttaaaaatgttttttacatatatttctgttttaatatcctattatgggcagaaatgaaatgggacttaaattcaggttgttaccaatagtctaagattctaagtgcatcactatttcatgtacgcaaatattggctgagatttagcagaggtattgaaccagacaaatctatttatgcagtggctgttttacatttcttctatagagtattggcttcatgctttttgttagcttcagtaccttttgtccaaaccaaattactcacaagctgaaatgtaagacaattcaagattaaaaacgctatacaatcaggcatcacttaatgaaaagataccttctgagaaatgcctcattagacaagttcatcatagtatgaacatcacagagtttccttaaagaaacccagataggatagcctactacacaactaggctatacggtatggcctattgctctcgggctacaaacctgtgttgtatgttactgtaccgaatgctgtaaacaactgtaacacaataagtatttgtgtatctaaatataaaaattaagtagagcaaaaatgcaataatgcattatataagataaaaattgggcacacatatatagggtagctccattaaattctcatgggcgccctgcaatatatacagtccatcattgaccagaaacataattaaacagcacatggttatctttgacaggagggtgctaggcataaggggccagaagcctactggcttttaattctcctgtgaatggaaaatataatgtaagtcaaatgactatccatatagtatgaagtcataataccagatgactatccatatagtaacccatgtataatccctaaatcatagtacttgttccttatctatgcctctttctatttgccattttctgttcctaaatataactttcctatttttcacttctactcccacagtctacacagacgcacacacacacacacacacacacacacacacttcccactgtatatcagtgtataaaaactagacctgtctcatgattggttgtgtttacaaatatgttcatatttatagtaataaattactgaaaaatatgggcatatatgaattcaaaaaataaaatgtttaatatataaaagcatgttctgaataggtacaatttattatagaaagactttggatgctctaacattatggaactaatgtggataagttctttggaagtaaatactagacaaatatcttgattaaagtaaaattcaggtagcaatgttaaaacttttcataatgtaaacagctatgcaaagcatgacttttgaatttatatataaaatacattttcaaagacacagatactgctatattcattttgtgtatactgaatgttatttctgacattcttttagattcttgatagtaaataaatgatattttggagagtactaaagcttatttaaacatgatttgatgttcaatacaactaacaaaattgtagtggaacacaatgatattataaaaatgaagcttcatttgggaaagcatttccccaggtgggaataaggcattttctatgactagtctaaataaaagattcacttttccttgctttattttgggagggtggaggatggtagaaatgcaatttcaagtgaatgagtgcattctatttttcctgtttttttttttttacaaatgttataaaatcacacacacacacacacacatgcacacacgcacacacacacacacacacagagtatcttcatccatttttatgactccttagagataaaaggggttgagaaacatggtttggatttagttaatatttcctaaataccaaaggaatactgtttttcataaaataagggtgatactttcaaaactgtgctcagagaaaaatcaactgacacattttttaaaagaaaagaaaaaaaagaaaaattcaaaaccctttattagtttagaaaaggaccgttgtcaataccctgagttctaccaaattcaattttggctatttagtacaaatctgaaggagaatttttttatgctcatcagtcaggtccaaattcaaggagccattatcaaagttaggaatttaaacaacgctggaattcaataatgtgaaaatactactgattatttttataggagttttattctgaaaagtatgaagtatttataaataatatttcaacattcttttttttgaaagatggaaggtgaagttagtaacgggtaagttattatttgaatctcctagcattcagtccaagctttcaatactttaaacctaatatgatgtcattctaaaacccacgaggagtaaatgtgatttgtattgtattctacattcagtatgaagtgcacattcatgatgttgataaccttatatattagaactatatcatcatttcctataatataaacaaagaaaatactaaggatattaaattgaataaaaataaagaacatttacatcttgatgcttaggtaatgataaagattataaaataataagaaattcattgactattcccagccatttaatagtaacatcacaatagttgaagaatgaatgcattggtttgctaaggacaatgtccttcagctccatccatgttcctgaaaggatacaaccttattctatttttatggctgcatggtattccatggtgtatatgtacaacattttctttttttttttttgagatggagtcttgctctgtcgcccaggctggagtgcagtggcatgatcttggcttactgcaagctccacctcccaggttcacgccattctcctgcctcagcctcctgagtagctgggactacaggcgcctgctaccacacccggctaattttttgtatttttagtagagacggggtttcaccatgttagccaggatggtctcgatctcctgagctcgtgatccgcctgccttggcctcccaaagtgctgggattacagcgggggagacaccgcaccctgtcacaacattttctttatccagtctagcattgatgctcatttaggttgattccatgtctttgctattgtgaacagtgctgtgacaagcatacctgtgcatggtctttataatggaatgatttaattagctaggcatggtggcatgtgcctataatcccagctactcaggaggctgaggtagaaggattgcttgagcctgggtggcagagattgcagtgagccaagatcgtgccactgcactccagcctggttaacagagagataccctgtctcaaaaatcaaaacaaaacaaaataataggacaatttatgttcctttgggtatatgcccagtagtaggattgctagatcaaattatatttttgcttttgggtctttgaggaatctccatactgtcttccacaatggttgaactattttacactcccaccaacagtgtgtaagcattcctttttgtccacaaccttgctagcatctgttatttttttgactttctaataatagcctgtatcagtccattttcacactgctataaagaactacttgagactgggtaatttatgatgaaaagaggtttaattgactcacagttccacatggctgagaggcttcaggaaacttataatcatggcagaaggcaaaggggaagcaggtacagtcatcacatatcagagcgagagagagagagagagagagagagagagcgagcgagctaggggggaaatgccacactttaaaaccatcagatctcatgagaacacagtcactatcaggagaacagcaagggggaaaatccacccccatgatccaatcacctcccacctggcctcttccttgacatgtggggattacaatttgagataagatttcggtgggaacacaaagccaaactatatgatagccattctgactgttgtgagatggtgtctcatgatggttttgatttgcatttctctgatgatcagtgattttgagctttttttcatgtaattgttggccacatgtatgtcttttgaaaagtgttcatgtcctttgcccactttttagtgtgttttttccttgtaaatttgtttaaagaaccaatgtattctgccatgttaacagaatatcacagttggaatttatactttacaatacaagcatgttttgtatttttttgagataggatcttgctctgttgctcaggctggagtgattatggctcactgcagcctccaccttctgggctaaagcaattctggcacctcagcctcccgaatagctggcaatacagatacataccaccacacccagctaatttttgtattttttgtaaagacaagttttcaccatgttgcccaggctggtctgaaactcctgagctcaagtgatccacctgccttggcctcccaaagtgttaggattacaggcatgagccactgtacctggcctatttttttaatcaataaaaaatttctgtgtgttacatatataattctattataatttacttttattaatgtaaatgttatgacatgtatgatatgctattttggaatctcatttgagttagaggtctttatcttaatgcctctcttaatgctatgaaaacaaagcattttttataactaagaagacagagcctccttttgaccgtgtctttgctactatcctgtacttggctgtcctttctgttgtaaattaaaatagatgaaggctgtcgagccaagccaatgatggaggctaatttaatgcgatataattgatgaactctaaattgttccacttttcccttttgaaacacactaagtagagcttaaaatgccagatagagtattttgatttatgctctttgtcacattaatactgaaaaactcattgtagtgatagagaaatgggaattaaccctttatagatactttcatagtttctgtatatttggctgtacaacaatcagagaaatggacccagtttaaatatactaccagaataaccattaaataataataagaagaaatgtaatgaagaggctactaatttaatgctcatgaaactagttaaatgatatgaaaacaaacaactctaacagaaaaaaaatcaaattaagtccaagtaaaatactggatttatatccacatgatttttgtgaattttgctaaatctgatgcccttgaaccagaatacatggagaatttacaaataaggacaggggaaatcatgaaggcattttaagatgatgaattttcttaacatgtggcatactgatagagttcagttgaacataaagttgctacagttgttgctagtgtcaagaagaaatgtgggctgggcacggtggctcaagcctgtaatcccagcactttgggagtccgaggcaggcagatcacgaggtcaagagatccagaccatcctgaccaacatggtaaaaccccgtctctactaaaaatacaaaaattatctgggcatgatgtcgtgggcctgtagtcccagctactcgggaggctgaggcaggagaatcacttgaacctgcgaggcagaggttgcagtgagctgagatggtaccactgcattccagcctggcaacagagcgagactccatctcaaaaaaaaaaagaagaagaaatgtgagtagaccaaaaaaaagagcagctatccagaaatggccattactagcaatattcgtctcagtgctttttgtattaagttattaaattttagtaatatttaaaagttaacaaagtagccagataaactaaatacactaaaggaaatttcatatttatatacaccagcaacaaatagtaaatatgatttttttaatctatattagcaacaaaaatggctatttaggaataattttaacagatgctcaagattgttatgtagaaaattatgaagtcataaaattgtaaagttttataaagctttgttgagagggattaatgatgactcaaccaaatggagaggaatagctactttatggataaaaagatctagtaaagtcatcaattctactgaatctaagaagattcagtgtagtaaagttatcaaattgatctatagatttaataaaattcccattgcaacatgtttttataaaacatgaaagatagttctaaaatttacatggaaaagcaaagtatcaagaatatccaagacactcttgaccaggaagtataagattagatgacttgcctttcaagatactcagttttgttttgttttttaataaaactagagtaattaagaaatgtgattttttgcgtaaggataggcaattagatcaagagaacagaataaagagttcaacaacaaactcacatagaattaaaaacttgatatgtgtcactgcaaattattgggagtaaaatgaataaatgagagcttcacacagaaacataaatggatgttagaaacataagctgaagtgaaaaaagcaagatataaaggaccattcacagtcagagaacatttatttgtttgtttatttatttatttatcatttattattttaaataattgcagcttttattttagattcaaggatacatatgcaggtttcttacatgggtacattacgtgactgaggtttgggataccattgaccccgtcatcgaagtagtgagcatagtaccccatagttactttctcagccctttcctcctgctctctcatctctagtagcctcctctgtctgttgctgtcatcattatgtccatgagtgctcagtgtttaactcccacttttaaatgagaccatgtggtatttggttttctgttcctatgttaatttgcttaggataacggccttcagctacatccatgttgctgcaaaggacaagatttcattcatttttatggctatgtagaattccatggtgtatatgtaccacattttctttattcatctgtcattgatggacacttaagttgactcaatgtctttaccattgtgaattgtactggaataaaaatacaaatgtgtgtgccttttttggttaaatgatttatttcttttggatatatacccagtaatgggattgctgggtcaaattgtagttctgttttaagttctttgagaaatcttcaaactgctttccacagtggctgagctaatttacactcccagcaacactgtgtaagtgtttctttttctctgcagcctcaccagcatctactgttgtttgactttttaaaaatatgcattctggctggtgtgagatggtatctcattgtggttttgtggttttgatttccatttctctgatggtgagtgatatgaagcattttttcatatgtattttagccacttatatgtcttcttttgagaagtgtctgttcatgtcttttgcccactttttactggggttatttgacttttccttgttgaattgtttaaattccttgtagattctgcatattagacctttattggctgcatagcttgtgaatattttctcccatgctgtatgttgtctgttatactttgttgatagtttcaggctttaaaccaataacagtaaagaaggacaaagaagggcattatatattgataaagagttcaattcaacaaaaagacttaactattctaaatatatatgcactcaacgttggagcacccagaattataaaacaagtccttctagacctatgaaaatacacagacagctacacaataatagaggggaagtgcaacaccccactaacagcattagatagatcatcaaggcagaagactaacaaagaatttctgggcttaaattctatgcttgaccatttggacctaaaagatatctatagaaaactacacctgttaaccacagaatatacattcttctcatctgcacatgaaacatactctaagatcaaccccatgcttggtcataaaacaagtctcaataaatttttgaaattgaaaatataacaaccataccctcaatccacattggaataaaagtagaaatcaataccaataagatctctcaaaaccacacaattacatggaaatttaaaaacctgcccttgaattgacttttggataaacaacaaaattaaggcaggaatcaaaaaattattggaaataagtgaaaatatagatacaacataccaaaatttctgggatgcagcaaaagcagtattcagaggaagcttatagtgctaaacacctacctcaaaaaattagaaagatgtcaatttaattatctaacatcacagctagaggaactagaaaaacaaaaactaaccccaatgctaaagaagaaaagaaataactgaaatcagagcatagctgaataaagttgagacacaaaaatccatacaaagaatcaacaaaaccaaaagttggttatttggaagtataaataagattgatagactgctaggtagattagcaaacaaactgaagaagatccaaataaccaaaatcagaaatatcaaagatgatattacagccaatcctgcgaaaatataaaagttcttcagagaatattatgagcacttctgtgcacacaaattataaaatctagagaaaattgataaatttctagaaacacacaatttccccaagattgtatcaggaagaaatgaaatcctgaacagaccaatattgagttctaaaactgaatcagtagtaaaaacctaccaaccaaaaaaatccctgggccagattgattcacagctgaattctactagacatacaaaggagagctggtattcattctactgaaactattccaaaaaatacagcaggagagactcttccctaagcattctatgaagccagcatcaccctgataccaaaacctggaaaagacacaacaaaaaaagaaagttatgcaaaattcctcaacaaaatactagcaaattgaatccagcagcacgtcaaaaagttaattcaccatgattgagtagctacattcctggcatgtaaggttggttcaacatatgcaaataaataaatgtgattcaacacataaacagaatgaaaaacaaaaagtttatgatcatctcaatagacaccaaaaagttttcaataaaatccaacatcccttcatgataaaaatcctgaaaaaactagtcatcaaaggaatgtacctcaaaataataagagccatctttgacaaacccacagccaacataatactgaatgggcaaaagctggaagcttttcccttgataattggaataagacaaggatgctcactttcactattcctattcaacatagttctggaagtcctagtcagagcaatcaggcaaggaaaagaaaaggcatctaaatagtaaaagaataagtcaaattatctcgctttgctgatgatataattctatacttaggaaacactaatgactctatacttagaaaacactaaagactccaccaaaattctcctggaactaatcaacaacttcagcgaggttttaggatacaaaatcaatgtacacaaatcagcaggatttctatacaccagtaacattcaagctgagaaccaaaccaagaatacaatctcatttacaatagtcacacaaaaaataaaatacctaggaatccatctaaccaaggaggtgaaagatctctacaaggagaactacaaaacactgctgaaagaagtcatagatgactaatgaaaaacattctgtactcatggattggaagaatcaatatctactgcccaaaataatctacagattcaacactattcctatcaaactaccaaagtcatttttcacagaattagaaaaagctattgtagatttcctatggaaccaaaaagaaaaaaaagcccaaataggcaaggcaatactaagcaaaaagaacaaactatagacttcaaactatactacaagagtacagtaatcaaaacagatggtactggtacaaagacagacacatagaccagtggaacaagatagagatcgcagaagtaaagccacacacttatggccctgtggtctttgacagagtcaaaaaaaataagcaatgaataaatgactccctattcaataaatggtgctggcatagctggctaaccatatgcagaagaatgaaactggacccctacctttcaccatatacaaaaattaatgcaagatgaattaaagatttaaatgtaagacctcaaactataagaatcctagaagacaacataggaaacaccattctggacactgaccttgggaaagaatttataactaagtcttcaaaagcgattgcaacaaaaacaaaaattgacaagtcagatctaattaaactaaagagcttctgcacagcaaaagagaacattgttataaatatcaaaaagtaccaaaactacttatgacagtggttacctctggagtgataagcagggagataaaatagggaagtagcacataggttgatggatgatctagtaacattctggtttttaggttgagtggtgagttcatggatgttcattatcttatgtttttaatttaataaatgcatgtaacatgcattaacttaatatacaaacatatatgtagataatatataaacatataatcttttgtatatttaaaaatatatttaaaacaaacatattaaagaaatgaaagaaagaaaaccagaatgctctataaaaatagaatagtttgggggaattttctttccaaatatcaaaatttactgtggagctttctgaaggataaatcctttatggaactgaatagaaagtctagatttaggcctcttatcaaatatatggaaatttgatctacggcttgattttcaagtcagtgggaaaatgatagaatatttaattaatgatggtgggacaactgactgtggaaaaaaatgaaatagaatcccaatttgcacatgcacaaaaatgaatcccagatttattaaagacagtcagttttcacttaaaaggaagaaaatttttaaacttgaaaaagtataggagaatatttgagacaacagaaatgtattcttttacgattctggaggctataagtctaagatcaaaatatcagtagggttgtttccttctgagagctgtgtgtgcctcttcctagcttctggtgggttgctggcaatatttgacatttcttgacttgtaagtgcatccctttgatctttgccttcttcatatggcattctccctatgtctctgtctctctacattgaattgtctttataaggaaactggtcatcttgaattagggggcccaccccattttattgtgacatattaactaattacatctgcaatggccctatttccaaataaggccccactctgacatacgagggtttaggactttaacattacctttttggggagacatattttcaacccatgtaattgttatttttaaattgtatatatgagttatatgtactattttcaggatacatttaataattttatttttaggaaaaatattaagcagaataaatatgaacaataactattttgttccttaaactaaaatttttaagctaaaaaatgaaagctaacacacctaggttcgccatccctatagaatactttttgtgatatggggtatacggtcttgcctacctgtctagcttcattcccaccacattttcttatattctaaagaaagcaaaatattgactgttctatgctattttatagaaatattggtgtctttccatttcctattatagtctttctgcttattatatcctcatctttcttcttctatctctttctcctcctttcttcttccataaccctcttctctttctctttcttctcctagttaactccttcttctccttcacgtttcatgtggaagccttcccggccccactctccagtcactctcatatgagacagccctcctcttttgcttccatggctgcatgtggatttctctttcattgcttatttgatttatgtgtactgaagacagagaatctcaatgcctaggatgatccccgaaatctgatctgtactcagtaaatgttaattgaaccaaaccaatgatgttaaatatctcatttatgtttcatctatacctatgaccttggccatcagattgcctgcttcctctggatcctgagaactaaaaatactgtctgtatgcttctatttttcaagcacaagtacacattatagtgattcaaatactaatggatattttagcattacatctagaaattttcttcacttcccagaaaataagattggttaaaataatagaggtattgattttaaaaagcagggaatatgctgtatatttattacttctcagaccagtgatatttcttcatttttttatacttagtgaattttatctcaagcctcattttactctaaatctgttctctactacaggatagctccttgctttggttaatatttaactttttaaaatatatcacattaccttggtgagtaaaatatgcatgtactataagattaccatcactataaaattatgcaggtactataagattattgtcttttactgtaagattactgcactatagattactgtaagatcactgtcataataaaatatgcatgtcctataagattactgtctcccaaagatttcagatttgtagagtaaaatgctttcactattcttttcctttgaattaccaggtcagaccacagggattatgcagaaagtagtttatttttgtgcgttgtgtttggtttctttctaaacaatctaaacaactttttctaggcttaaaaaattagtttgtgtgctaatgcattacttattgacagacatggtcatatttagtatctaattagtggacagagttaattttttcacacttcttacattttcttatatcatcccagcctcaggccgtcttccacttagctgtcatattagttccctgtggctagtacaacacaattactgtaaactcaatgacttaaaacaagttattcccttgcagttctgaagatcagaagtctgaaattagtcctaccctgctgaaatcaaggtctctgtagccaagcccctgctagaggctgtaggggagaatccatgttcttgccttttttagtttctaaaactgcatttcttgcattccttggctcctggcccttgtcaaaaccagtactatcacatcttactttagtggtcacattagcttgacttcttctctagttaaatctccctatacttctgttataagagcactatgattacagttagggcccctcaggatgatccaggaaaaaatccccatcttaagacttaatttaatcacatctgcaaagtctcttttgccatataaggaaacttgcacagattctagagattaggacctggagattttttgggggtgggcattattcagcccaccacagctactatctgaccaaatcacatagtgcacttttatctgccacagctttaatttcccccatgaatttatttaataccaatgttgtcttccatttttacacccatttcaaaactctgaaatagaaataggttaagtgcagacatccgacttgtatcacactgaccaccagatggcaaactttgtcattatatttttaggcctaatctgaattaatttgacagcctgagtagttaaatatgccaatttaaagtcatgtatagtgccatgcagtttagatcaactgaagttttatcacactagatcattttttatgagaacagctacacataatcagatattaatttgagctactttaatggcttctgaaaaagattacttccttatctagctaacgtcaacaactaagcatgcttctatttcacagaaaattcttccaatgcagtctctcttagtttttgagtaatttcttacaaattctaaatttaattgatatgattaattattaatctcaattttaattacttatatacaggatttttcctagaacttgtttcattaatgaattcaactcaggcaggtactaatccgtgtcgcttttatcctgtagtatcacataatatataataaaaataatggctacaaataaggcagctttctaaaatagcaaaaattattattgttctactgttttccaaaatcattgcactcttatcgtatcagtctaaacaattcagagacatcaaaataacagctaatattcttcttctttccctcttacagaaacttttatagaaaagttcagaaaatgtatatttaagtaagttaaaattcatgttctaaagataacactttttgtatttcccaggcataaagatataggtatagatgtggatatcaatgatatggaaatataattgggatgattcgtacagtgagttttttcttcttttgaacctcattcacaatatcatattaagtttattggccctcccctattccatctccccgtatcccccaagccaaagtaaacattattccaaatcttatttgtattttaaatatatgtgtgattatatatgtatgtgcatttacctatacatatatatacacattaatttattctgatttttcatataaagttatattcttaacattttccaatgttattaagattccttgaaaaatttttaatggtcatatgatattttacctttttggtattccagtttaaccaaatagaccaaattgtctccaatttttcactatgataaatgacactttcatagaaacttataaatcttgcttatatctctcattatgtatttcattaatatagaatcttagcggtggaattactaggtcagaggatatgtggacttttgatgtttttgatatctgttggcaaatagctttccagaagggccaaaccagtggcattctcttaatactcttgccaaagtgcttcattaatttaatttttgccaattaggtaaaaatattccttgatgtgctcctgtttactaatttatgactccctttcaagttatttaaattatatataatgaaatttatataaaataatcattatccagcttactgcactaatattgaaaaggaacataaacatttgagatgatgaatataatttataaaggtggaagggattacagaatggaattcagagtcctctttatcttttagagtagggttctctggcttcttacttcacatagatcagtgttgtcaatactgtaatagaaagaaaatgagaataaaagtaacactattaactagaattttttgtgtctttagcttttagtaagtcccataattgctttgtaacttcttttccctgagaaaattggagcctgaactctcagggttcttatgaagatacaatcactttaaaaagtgtgatcttcctaaggggaattattgttttaacaaaatctatatacgttgataattttaaaatatttgaaaatttataaactctttcttcctttttaatactgtttgttagaaatggctaagatctttgtataggaaggggacataatttcaagtgacattatatttgctcttcctcttttgtttgcactagagaaagccttgccatatctgatacatcattgtctgaaggtatgcttgcgtcatttccaattaaatgttttaagtcagcagtatacagtaaattatcataaatgttattgtaagttcaagctgaaatgttagcaagaaaattgctaaaggatatcatttaagctcttactggttctgtgtatttgctaatgtctgtggtgtatattactttgacgagcctacagtgacttctaacttgaattaaaatacagttttggttaattttgttaaggtcaagacaagatttaaattagaatataatttgcttagttatctcactttttttgaagcaagtaagcaatgaattgggaaaataaattatgattgtttacttaagattctcagaaagggaacacacatgcttcgttgacaacagtggcatcagtagactgaataataatttatgctatattcattacttttttattcctgatggaaagaagagctggttaaaaggtagcagagaccagttaaatgttcaggtctattttaataatatttatacaaattcattgactttataataatttgcatatttatttgaattttgacctacttggccttagaattgtcagtgaatataaggcagtttctgaagaaagcccgaaacactcactacaatgctagaattcaatcggtatttgttggcatgtcacacattcagataccttgcatgtctaattattatatactgaaatatatgtaatgaagagcaaatatagtgaacaaaatatatattgggtgagcaaagtttatgtcaagtaaatgattgacacaaatgtagttctgcttttttggaattctggtatcacaaacttattccaatatatctgaagagtaaaatcttgttcctgtggttactgtaactaaaagggaatggaaaaggcagggcaggaaaagatttatgggattcagagatgagaaaatgtgagagatttgaagaaaaagaaggtagaaaagaagagcaatgtatagactttgacaaatgagaagaaataatgaacaggaatttatagtataaagaagaaggataaaagggtacatttagtctcacaaaactagaattgtacaataaaagaattattctaacccaaattatttaattatcacaatgttgttattcaaatcctgcacatcctttgtctcacagacatctgaaggcctttagtaccagtccagtccatgacaatgtcttttcctaaaatctcatcacttgtttatgctacttacttgacaactgattgaacacttgtaattctgagttgttctgtgattaaaatctgctattataagttaacattttatgctttaaatctcaattttctaagtagaatacaaatctggaagacaagcactctgtcctatttcttgatagtttctgtagttttagcaaagcatcttgcattgtagagggatctcaattctttaatgactgagtgtaatatatagcatttttcaccaaaaagagtcatttatcctatagtaaaaaaaaaacaataaaataacactgaaagcatgcagagacttgggtgaaatttagaagctttggaacatgtatttcatcagtaagttatttactttgtttatgtgatagtcctgacatggaaaatcagtgtaagccaagatagtattgacagaaagagcataataaatagaaaaggggtacatgaatcagattatttacattttgaagatggtggctgcaatgagtactgcacttgaattaatccaaaagatctcccttgagctgaaagtgtgtgtagtcataattgcgtgacctgtgacacattgtctttgtcccactggcaggttacaaaattggcactgaatcaagatagagtaattataggaaagtagaaactgtctggatattccactgaaagctgaagatgtgatccattcttgatttgctttgctaatagctttaactttgagaagacagagagaatagtaagataaacaaccaacaggtgggggatgtaggagtcctgggagagagaaaattatcatgccatttgagagtatataatataaggaaaagagaatagagaagtgaagcatttacatacccccaggttttggcaaaatgtattccaaaatgtttacaggaaagctattttgattctgtggcaagagagctaaaataaaataccctaataaatcattcattcatttattcagtttaagtaatggtattagaaagggtaaagctataagtgagttaagccttcaaaatgaactttttttctttttttgttaggataacctgactgatacagcaaggttatgctgcagatatgatatatcttaactttgtaatggcatttatgaatatctggtgttcttttgaagttgacagaaaaatggacactgggtaatagcatagctattgttggtggtttctgagaggggccaataattagcactcttttctttctctgggttctaaacaaataggaactaacagttaatttgaaaatactggtcaatatatcatttttattattgataaaagtcatgctgcaggacataactttgggtccataaaccaaattattttgctaattctgaactcaagaattaggcagattttgtcacctgccatggataatacattaaggtatgctgcctcctgtgggtaggcttcccagataagaagttatgagagacaggatccaaaccaaactcacatcatctgcaggcagacttgcttctaaaaggaagagaggcagattcatctgtagaattaatcacttcacctccttggaacacaatgagtaagagcaggagagaagctaggagagtatctatggaaaattcctcctcatcaaaattaggaatggcaaaagcttttcccctctaactttgccttgcatctgttctcttaggccactgagtttaaccataaagcctgtggtcaactatgtgagggaggagatcagcagtttatttgggcaggaggcgaattctaatgtcagctgctttgggcattatcctgagatccatggtggtcagttttgattctacactgagaagattctgaaatgggttggaacaggacatatatcaaatcagcttcaatgacactctgtatctgaagctggaaatttaccgccaacttatttcttatcttaaattatatataactctatggccatattaaataactctaatactagaatgtgtaaagatacatcagtaataaaattccaaaaacatagaaatgccctaattaaataaaatctcctcactttatcaacttcccaaggaacaatcattaaagtttaaaagattatatttcttggcaagttaaaaccataagtaaagtctaaaattattttgcctttgtgagttaaaaattcttcaaataaattccaaaaccattcttcagtatttcttattaaaatattaaacattcttcaatattagtctcagccataagcactcaccattcacaggaagagttgggattgtctgtttctcaccagaatgcctagagctccttcagtgtcaacactgctatattagttcaatgccaagccttctgtgggcctgattttaaataactcaaattattaataatacatggaaaattttcagagcactggccacacagtgaccaaatttagaaagcagaccaattcctaccctttaaatgagttatctcaggcaaaatgatatgcctaaacctaattcttagtgtggccaaacaccataccagagactcagtggtatctaaggaaagaagggtagattgtaaaccctgattttaatcttgacatgatactattggtctataaaagttgtccagaattcttgagctatgggtttaaatcccagtgggagaaatccctaagcaaatggttgattttggtattatgcatacttacctcttagagaaacattgctgccttcttgcaagatttagaaatttgtggctgggcggagtggctcatgcctgtaatcctagcactttgggaggccaaggcaggtggatcacttgaggtcaggagttcgagaccagcctggccaacatggtgcaaacactgtctctactaaaagtacacagattagccaggcgtggtgatgtgcgcctgtaatcccagctactcaggaggctgaggcacgatgatcgcttgaacccaggagacggaggttgcagtgagccaagattgtgccacttaactccaggctgggcgacagagtaagacaatgtttcaaaaaaaaaaaagaaaaaaaaattagaaatttttaatcatatcaacccagtcccgagcacatcttattcatgccttctcctccaagacagtatttttaaaactttagtttccatttatcccaaccctaaattgagagtgactgtgtttggtgaatagcacccatgcttttgtgactaactagaggcatttcaatcttattttgctgtggctgttgccactgtatgtctctatgactttacttcccaggaagtatttgtctctcctctgtcattagccaattcagagacaatctaagaccacatggtagagagtgaccttgagcttgtgttcaaactaaacgattgtaagtttcatccataggtcctatcttagtcctaaattaatttttaaattcaacaaatatttattgaacatcttctatctaccagatactttctagatgctgagattaacatacataaaaatccaagtactatcagtagagacaaactttaaataaacaagcaaaatatgtagcatattagatgatagagaataatgcggagaaaaacaaaacaaggaagagggaaagtggctgtgtgtgtgtgtgtgtgtgtgtttgtgtgtgtgtctgtgtgaagatgattgacattttaattgaggtggtcagggaagaagtagaaaatgaaattttaggtaaaggaactagtgttggctacttaagcctaacactaaccatttaaagctcatgcacattctgtttatatatatacacacacacacacacatatacacagtaaccatttaaaactcattcaggttctgttttctatctatctatctatctatctatctatcatctatctatctatctatctatctatctatctatctatctatctatagtctctccataagagattgaatgagccaagaaagctgtctagtcatcagttgctgaaggactggctaagacagaaatacacagatacgtttctcagttgccccaagtttgggactcactcctcatatatgtgtacaaagtacaaaaattaaaattcaagttccgtaaatttagaacttgacttctttgtagtttactatgtttggtaacagcaaatattctgctcaataatttccaaagcctttttttccatgtgattaagtcattgcctcagcaaagcttagaaatagttgcatttgcatagtaaatggcatattaaggccttggccctagttgaagcccagtgatcttcatttttgttttctggattgccccatcacttgttctatccttaaggaaatggagtggcttatttgatttctaaatttaagtgaaataaacagcatcagttataaagatgatgttgtaggaccttttccttagttcagctaaaaatggggtccttatcacatgaccatgaaaggttaggctcacagatacattgaagggtgggaaaaattgaatttattgggtgaaaagaaaaaaaaaaactcagcaaagtgagagaatttcctgttaacaggcccccatctcaccaattgactcccaggtaccaccctagaacaggagaggccacgttcctcccgctgcaaacagcacgaactttctgaggctccacccagtgtgcattcctcccattgcacaggcctgtcaaaggttctgccaggcggcccattttacttggctatctcaatgatattatgttctttatcttcactttttactttttaacttgttcagaatcccaagcggatgagaagggtctacttaataatagaaaccttatcagagaccccaacagttcaatagattcattattgattgctatgtaagtgtccatttctagagaaagggtaatgaagcatgtatttcttttctctgatccacttaaaattttcatcaaccaagaaataaatggcctgattatcaaatttagatatttatgggaaaattcatggaaaggaaatatattagaataaagagaatttgtagattaagtgtgaaatatatagaatatatttggtgaaagttaaaatgcttttggtaaagggaagaaaatcatagggttagatatgtcttcttagcaggaatatatcataagccaatacattcaagaaaatttaccagttggttggtgaagcagacaaaacacaggaagacgctgcaaagtttttgggagcatcattagaccaagagaggttgaatgagccaagaaatctgtctggtcatcagctgcagaggggctgactaagtaagaaatacacagatgcctttctcagttgccccaagtttggaacccactccttataaaaatatatacaaagtacagaaattagaattcaataacatatggtccaaaaagttgtattccagagcaagggctaaggagggtcaagttttgggtaagttttgcagtggacaaaggatggtttcacaaagtttgaaaataagggaaaacatgcctagtctgctagctagggaacttcttgggtatcatatacctcttgccacccagagtagacataataaactgaatgtttctaaatccatataccttatctgtcctatcttttgatatacgacatggagggaaccctggaatatgaaaaagcaatactcattcttgtggtggcttttatgatttttattgaattactagcaagtatggcaactcactatcttgattctctttgcccccaaagggcattgacctgttcaggggatggaatcggggtcaacatgaaagaaaacatgcagagagacaactaacacattggaagtttaaaggttcaaagagaattctgcactcaataaaaaaacaggttaaaaataatcacaacagtaaaacatgaaaaatgtataataaataccaatgtgaagttccgaatttagtttcaaaaatttactcatagacatgctaagtaaagaagacttgtcttgatcaaagttcacgtcaaggtattcaagggtcctagatgaccatctgtcaggaaagtcacagcacttctgagcctgctttaataggaacattggacttagtaacctccagtattccttccaaatctgggaatgagttactccaatgagcctgtgactttctcaccttctgatttttgtggtttaacacattgttccaagtacataagaaagccgatttatatcagtcatgagtaatctatgctacatcaaactgcccttcacatttaaaaaattcaaacaattgaaattcattttttttaaaaaacatcatgtctcctttcacaaaatcttaaaagcaagtcagattgcctattcatttatcacaccagttagtcaatgattattataggtatcttccaatggagacttaaaaaaattatatttagcagatgtcttcacaaaggagcattttactggagaaccattttttagcattttgcaatattgaactgaaaatgactccattagctaatagcaaaataatcccattttcctcaaaggaaaaaaatatctttaatatatgtattgattaaaaggaaaatgccagtgtgtgggtcatttacgtatccaggaagatttaagaacctcttgaagaacttcaaaattatagtcataaactacttaaatgttcaacacgaactccttatacactaaatgaaaaagctaactggattatgttgcatttagaattttttaacctagaagctagcatgttgtggctcagaattgaatcattagctttgcattaattcccagaatcagggagaaaagaaatctttcttcagtaaattacttcttggggttgggggaactactgagagattgatctgagctttgttgcagcaagagcctcaagtcataaattattggcacacaagcagaagtcagtgtgtcatttctattgtagtcagatgcttttatatttccactcgtcaaggttgacttgatcatattgtacacctcctggatgtccgagacatagcattcatttgtccctctctttgagagcaggacaggtatttctttcacaacttaaacctctaagtttaagaaatatactccatagtatgactgtgggggtattctatgtgtgaaaaattttttcgagtgcagatttcaaaatttgaaattaaccaggttctcatttttgctctttgaggagtaatatgtattaaaatccattctgaggatctagcttttaaatgaccttttcagtactcatccttttgctcattttgatttgctcagataaattacaaccacctggccttttgtattaaaaaaggttacatacaaaattgaccttttgatacttattgagggaactaggttcattgtatttgagattaactgctgttgctgttttctgaatgatgtcttaaataactttacttgaggatggtaaagcctatttcttgtgccattttgttccaggctaattctaacaccataggaatggactgtctgagatatacaaagaaaattatgttttagaaaataatgaatctaatttattcagctcctgtgtgcctaatgatttacagatgtgatttcaatgtatcttaatcttgataaacccaatattatactttggccagtctgcccttcaccatattgcttattaagattctagcttctttctgtctgtttcttgaatattttaagctcaggcttgcctcaaaacttggtgcttgattttcccgctgcctgaaatgttctttttttttttttttttttttgagatggagtctcgctctgtcacctgggctagagtgcagtggtgcaatctcagcacactgcaatctccacatcccgggttaaagcgattgtcctccctcagcctcctgagtagctgggactacaggcgtgtgccactacgcccagctaatttttgtatttttagtagagacaggatttcaccatgtcagttggccagtatggtctccatctcttgacctcgtgatccacccacctcagcctcccaaagtgctgggattacaggcgtgagccacctcacccggcctgaaatgttcttttctagcttcctttgttccattcacctaatattctatttgccaccctacattttctggcttctgtgtaattaggttggactgtgtgactatttctgataatgagttgtatcacttgtgggctgaagcactgaaaagtccgtacacgattcactagtcctttttctgccatgattcttcgggaagttttgggttgagatggaaagtgacaagattgaaacaatctatatggctgatttcccaaatgggaagttacctagaccagaggattttgtgtgtgcaaaaaataaacttttctgtgttcaactactgagcttttgggaatgtgtgcctattctgattaactattcagggtttcagggcaaatgtcatttctcttctgtaaccattctatctaaagcactttccctctgcactgtatctttcctctgagcattttgtttcccatagcaatttttttccataatacttttatgtatttgtttatgtaagtcaacgtcgaacaaacaagacttctgtgtgctgttaattatgattcttaagtgcccagagtatttttaaagttgtcaataagcattcatttttcaacattttgttttaatgtcaacaagtacaaaaagcaagataaaatactatcttgcaaaggtccattgaatttcctgttggtcaccagaaaagatagcctgtatcaagccatagcacagtttttaagactctcctagataaatccattttgcattatttcttttatcctgaaatgagatcatctttggcaaagtctttataggtaatgctatctgtatcaacacagaaaagatttagagtccgtattttcattttaaaatttcccgaagagtcaccttcaaaaattctgcaatatttttgcatatatggaggtgttcgtccactaacgaatagctttgttgcttttaactccaggctacataagtacttcctccaatagcagactatactatctgccagctgcctgcttccagttttctggcacatggttcagaagagtctctggtattttttttgctggcatggagaagcttgctgaatagaatcaaaagagtcaccccatacatcagttactagaaaaagggcatgcagtaggagctcagtaaaaattcattcaattaattattacaggcaaatttattcaccatggaaatcttgatatgagcaaactatcacatttttctacaaataggcttttattttttaaaaacgatgaaagaaaaaaacaaaatttttcctagaattttagtctaagctattcaggatcatcctttggaatttgaagtaaagaacttcataatttgcttccagtccttaatggagtttcttgacaaggcattaagactttacagaaaaatattttcttattgctaatgcatgaagacatgtgccacatgaagtacagaacttcatttctcattaaggaacaaaatgagatatgtgatcaagtagaagataaaaacaagtatacacaggtatatcatctgcataatcaaagttttgcatggaatattcatcttcagtgttatgaagacttaagtgattttcttttgaaaaagtgttcacaagttggaattctttgttaatgagaagtcagcaagcacacagttgacaaaaaccagggattgtctatgctggatcatgttagtgtttcacttagactaaaaagaaatgatgaaattctaatcctttcctaatttacttcaaaatactcagtgttagcaaacattagaaatttctggaatggatgtgataattagatagggatattattttacttttctttgtttgctccatactgcaaattagcatgatcatccccccgccaccaaaaaatgattttaccaaggtctatccagagatacaaagcttaactgatttgattaacaactttgtgatatgcttcaagacacagcttttgtgttgagaaaaattcaaattttggtaaaattctatccacccccccacacactctttttttttttttttttgagatggagtcttgcttttttgccccaggctggagtgcagtggtggtcttggctcactgtatcctctgcctctcagattcaagccattctcctacttcaacctcctgagtagctgggattacaggtgtgcgccaccaggcctggatatattttttgtattttttagtagagacagagtttcgtcatgttggctaggctggccttgaacgcctgacctcaggtgatctgcccgccttggcctcccaaagtgctgggattataggtgtgagccactgcgtctggcccctatcccttttaaattaaatttattttcatgaagacttacaaatggacagatgtcaggcaacccttccattttcttgacttcaaaatttaattacaaagaatcgcccctgtaagaagtactgttttgtctcccatgatgtttaagtaggaatggatagcatggatatgtaaagataaggaagatttgctaatgaagattattcattttctctgacatttcctaaattaacctaaacaatgacagcccatgcttaaaaggaccatacttgtaaaagtaaggtatattttatttaattcctgtcagtagaaaccttttaaaaataccttattacaaggaaatgatggtgatgctatcaggtcatgtagtttgtaccaccctgctcttgttaatattgacaatttccagagttccatgagactgattttacattgaagttatgatctacaatcagtatgtaaggctgatatctttaagaaacaagatcattcagtatagagtataggtggcattgcatatacaccaaagtttacagaaaaaaacaaagtttgagaaccagtgagctacatgaagaaaacaaataaatgaaatgtttccaattaaatgtctgagctttgaactaattctgccttgaagatcattttcaaattcttatctagcaaataggaatgtgtcagtaattctaaagtagttttgctggcttttagaatttgttcccttttgttttaagcattaatatgagttgattgatttatttcttgaaataacttaaggaagtagagttacattttggttcaggatgaggggctgttagcttctgaagacagcagtaagttaatgattgaatccactgaaattgcagggaaataattaaagtatcatctattagtgccaggttcatagacttttccagtcctcatctatttgccctttagaggtctgtgatctgcagtttgaggaatctctggcctagaggttctgtgaggttcctgccaggtctaaaaatctgtggagattgtgtcttggtcatatgaattatataatcagtgttatccaggtgacaacaagaccctcatttgttgacataatttaatccgttattttgaccttttggtttaattttactttgagtgataacgtatttactttgatacgcatagtcatgcttatactttctacatacattgacatgcatatgtactatatatgcattggtatatacatatatataagcttattgtattagtcccttttcacactactgataaagacatacttgagactgggaagaaaaagaggtttaattggacttacaattccatatggctggggaggcctcagaatcatggtggggggccaaagcacttcttacatggcagcgttaagagaaaatgaagaagaatcagaagcagaaacccctggtaaacccatcagttctcatgagacttattcactatcatgagaataacacgggaaagaccagcccccatgattcagttcctcccactcggtccctcccacaacacgagagatttctgggagatacaattcaagttgagatttgggtggggacacagtcaaaccatatcacttatatatgctattaacattttagaggatattttgaaatctatattttaatcaaagatccagaaacattttccgtttttcctttgtctttcctctgtctggtagcagacctgatgacagtgaaaggtaggtttaggttttggcacattactgcccaaatagcaaccccaaataactgaacaacctacctggaaaatctgctgtggctatttgacaatattttgcttttgaataatgaagaaaaaataactaatcttaaggttttatggaatctcgcattattaaaggccttctggacagtcactcaagtttactttgcaagttaatacaaatattgcaaaaataccatttgacaaagaaatttcaaaaatcattggaaatgaatattatcagccaactcagtgaatacttgtcagtgttagacaggtagaattttttttttatttttaagttaacacattatgtcaaacacagcatattgccggcaggtcaaagattataaaagcctagaaaaaaaaataacaactgtaacctgaataaagatgtttttccaaaccactcccataatgactaacatcactatctaggaaaattaacctcacactggaagactgaaagcagaagatttccaatatttttctgaacaagaatttgaaccttgtgccttgaagatttagttatataaaatggtagaaaaccatgctttcctaatttaatgatactaaaagttcttgccacttctcttctttacaccatcctaacatcaaaagaacaaaaaatgattttttacttgtattactgtatgctaagtatgtttgtgttaataacagaaagcctcttatttcatgaattgttgcataatcttttcttcagaggctttattttagtttgtagctcaaaactaatgacaaaatcattttgagtgctctttttatacctttccaaattgttttgaatataattgctgttagaaatattaatgcattgtgatgactttatggcagtttttttctatgatctttgcagtattgccataagctagatgatgaggaacaatatgaaatctgatattgatttgcaagacaggtccacaaaacatccccattctaaaaaaataaatgtctacctactttcaaggagaagacataaattctagaacatcaaaggacatataagagttttaaaagtttatgcataattagagtcagttttatcataacttgcctttacccacatttggatgaaacagattcttatactatattttattcactcattcattgttcattcataaaacactgttgactatcaactaagtattgtggggaatgaaaaacaaaaataggcttttgccttaaagaagatcccagaaaagcatggagacataaagagatggtgccatattaatatcacaaataattcatagaagaggtgatcatttcaaagttgaggtgaggtagaaggacatttgaaggtggaggagagaatagatagggaacctatgcaaaagagtcatgtagtaggaggtatgaagacaattgcaggcagagttagtcactgctttgttttttatgtatgtgtatttttaaggagtattatcctaaagtcattcaaagagttgtatgccttgtggtgtttggaaaggtagctagtatcaagtttggggaatgataccgtatttgaagtaatagtattaagttgaagaattatctgtattcatatttgatagaatcactgactctacctggttgtcaaatttaagcgtagatattcttttcttttgtatttatttatttatttatttatttatttttgagacggagtttcgctcttgttacccaggctggagtgcaatgacgcaatctcagctcactgcaacctccacctcccgggttcaagtgattctcgtgtctcagcctcctgagtagctgggattacaggcatgtgccaccatgcctggctaatttatttttatttttattttttagcagagacaggatttcaccatgttggtcaggctggtcttgaactcctgacctcaggtgatccacctgcctcggcctcccaaagtgcttacaggcgtgagccgctgagcctggcctgattttcatatcatttttaattccatggtttgttttataagagattttgaatagcaaaacagttattatgtacaacaaataagatagtaacatctctttaatttttaaattttcttcacaacaatgtttatggcagtatgattataatctattgtattatgatcaatttgttcttttggctttattgttctgctgaataattggcaatagcagattagttataaaacagacacatctgctatatggcttcttatgggtatacaaaatgttaagcttcattttatataaaacacaatcctggaaaatctattaattttcaaattttcttaagaaaatacgatacagtttttcctaattttcaggatgagtttttatcattcttagtcacaaatggtggaaggcagttccaaatctaaattcattttaccacaataatgacagtttccaactgtctcataaatttgcaaaacatttgttaaaagggagactagtagagcaaaatgtgtcactgttgctgaagaaaatgggcctgtggtaattagtgtgccgtcttctgagacaaaaatagtgcttgaaatttaacattataattgtaccaattagcagttattgagtgctcacaatgtgccagcctctgtgtggaacagcccaagtgtgttatctctttagtctcaaccttatgacttaaagatactattgctattcccattttatggagagaaagaatgagtgaaaggtctcagtaattagattatgatccaattgctggtaagttcaacagctgggatttaaaacaggtcctctaaggtataggcgtagtgtaggtactgttattatttatagatgaaaaaaattgaggcttagagaggtctaaataatttggttaagctcaaacagctaaaaagtggagaaactggtatttaaaagtaggacaattgttaagaattaggggaggagggcagaaattagttgcaaagataatcacgatttactccatttgattattttagggctatcacactaaagcaagagtgctacgagggaaaatgatgttctcttcctaaatttcacagtaagaacatttgcattagtctcccaaaggcagaaactcagctgtttcagcaaggactctctaactagtcttctactaggtgacacagaataaatttatttgtctaattctttatttgtaactttactgacacactatattgtgccctaattatttccattttaccagatttgctttacaaactatagtagtaaagtcctgggcaagaagaatatttttcttgttctttacataaagtaatttagtaggcattcagttcttaaaaactgatagaaacacaaagctcaggaaacaaactagaatttttaaatatactttcgcattctacaaatttaaaaattgaacaaaagtatcagtcactgatttttttatgagtttttgggagtcacaataatagattacagtccatggaactctattttttgtcaacgattgtgagtttggaatatttgttgatttatattacaatatgtgatattgagtattcattaattctattttgtagaccttatacttttagatataaggaaaaggcaagatgaggaaaaagaagctgttcattttgtctagcaatcacttgtcatatgagatgccgtttatatgctgaggagaacaaatacaaatggagataattgataatacaaatcttagaaaattgtgttcaaacacaaagtggaatttacaattttctcaagactttttgtacatgagtataggaagggtagattgtatatttgtgtgtgttgtctgggcatgttggtgtgtgtgtttttaccaaagacgaagaacctggtgtcttctgcatttactatccttagcatttgagataacattatgtttgcattttgcatagacatactattcagatcaatttcccattcctattgagagaggcataaaccagattctatttgccaggagctgtatttttaataatataattttgaagttatattaaagtgaataatttgataattcagatcacattcactttttactttgaatatgtatttttaaaatgaatttgttacttcaaaaaaatgtgatctacaaacttaaattgttacttattaacagttgcattatttctatcccatattgtcatgtgaatgttctctttttaataataaaaaccaggtattaaaacaaacattttaaataataaactgtcatggcagtttattatttaaacttctgcttaaataaataaacttgtgtttaaataatttggcctgtgttcctttatcatctacaagggaattttatgaatcttcactcacaggactacatccatttacattcaaagactagtagttaacattttaagtaaatgacagagaatctttaaaaatatctgtgaataatgaagccattcattgtgttcaaggattttgcctttcttcaataatacaattttcttctcattttaaagagtatttaattgcatcacacgtcctattttaatatttaataataattttattagctgtatagaatgagaagggcaagaattgcaatatctagtgctggtcatcaatttttttatcatgacttaatgaatatcataattacaaggagaggcaaaaagataaattagcttagtagttggttgggacttgctagtttattggttttagcctgggcacagcccagaatagtcacaaagagaaagaaacaagtatctgggggtgctgtagaagtccttgcacacaatttctgcaccttactaatcatgcctcattttgaatgataaacagaggctttgaacaaaattataaacactgccaataataattccttctggttccatagcagttcacaggggattctgatgacttacaaaacttagtcttggcaggtatatgttcctttaatttctattaatgcattttgacaacttttcattatcttttcttaaatatttttactgttttttttttttctttttcagctaagacaaaaatctgagttattttgagtaggaaaatttggcatagccatcactgtaataacactttttactcaagtagcacctctcacccgaggctttcagagtgcttttgagtacattgtattaggcctgcaggatggaggtcaggggaaaagttatttgtaggcaccgtacatttaaagcttctgtggacatacagccaaggccacggggagaaagtaattttcatctttagtattctagatatggatatctgtataaaatgattcctaacttttcaatgccatttgttaaaagagggaaccagatattgttgaatttcatgtgcttttaaacctattttaagataaatcatttttaaccccctccagcaactgcttcgagaacgacagcagatggccagccgtccctttgcttctgttgatgtagctctggaagtgggagctgaacaaacagagtttctgcgagggccattagaggtaggaacagcggtgctgaaagaggaccactgtgctttgcatatttattatattgcttctctaatctacatctgcttatgaagccaaacagagtctgattatctacagttgacaagattcagctacatatgttatgccattttcaaggcacatagttttaatagtatgacatgagctgtaaccaaagccactggagaatctattagcctaggcaggagtgacagactgctcacctggcagcctttctctgacagaggagctgagggaatttaagatataggtatgatcgaagaaacaaagcgcctatatttagtctttggagtactctgtgcaccaagttaacaattcacatctatctttattaacaaagtttacttagaaaaggtacgagtggagatgagttgcattttaattacatagcttcatttttgaatgttgaaaagtgaatgtttctcacatataaaatgaatatttttatttgtggttaattgctgtattattacattcctttattgcaaaggcagaaatagagtatgatgaaacagaaatcattatatgcaactaaatatggtattagaatccaaaagtaatacatgaagtggtttctgaaaataataatccctaaagatgcaaaattcggccgggcgcggtggctcacacctgcaatcccagcactttgggaggccaaggtgggcagatcacgaggtcaggagatcgcgaccatcctggctaacatggtgaaaccccgtctctactaaaaaaaaaaaaaaaagaaaaaaaaaaaaaaaaattagccgggcgtggtggcaggcacctgtggtcccagctgctcaggagactgaggcagaagaatggcgtgaacccgggaggcggagcttgcagtgagccgagatcctgccactgcactccagcctgggcgacagacagagtgggactccgcctcaaaaaaaaaaaaaaaaaaaaaaaaaggatgcaaaattcacaaattatgattaatgactattcaaagcattatgatgcatactaatttaattgtatgtttattacttttatttacttttatatgtggtaagatatatttaagtagaaaggttaagaaactctagaattgaaacattttattctcttttttaaaaatgtctttatttgactaattttatgttgccattttcagattttactttttgtcaaggaaaataaagaatggaaaaatagaatcattcaaaaacctaggtatacatataatagattctgtctgtagcatttttgttttttctgaaaaaataagacaaaatcacaactcatggatgctactcaaagggtcagtttttagaggaaatgaaatattgggtgcatgtttccctatgatttttaagacattttgtgtacttgattttttactactctagatcacaggttaccatggaagcttagaacatcaggaaatttgtgtgtatatcttctatttgttggggaaaaaataacaaaaaagaatgattaaatgaaagttacagcaagtgctctaatttcattttggttccttgtttcaaataacttttataaaaaactttcacacacagaaaacttagactatttttggactattataaattctttttatccccatctgtttaaaacattcttaaatactgctaaaaatcgagtaacaagagaaaaaaaatgtaagtaatgcacacatagactaaagaagaaaagaaataaagaactagaaaattcacaaactcaaggaacaaatatgacacagacatatgtcaccatagtttgtcagttgcacgttaatagtgttcaataatgtattgttaggtacccatgtgttcataatcatcatatcttcatgttctattttttccaaatgttggttctttctttatcattgtgaatttttaaccttaaattgtattttgtagagttaaaaaatgtctagccctactttcttttagtccatattttctgatattccttatttcatttgcaatttcgctatatccttttgttttacaactatactttctggaaaaaactgttagcttttttattttttcatttactctgttttttattgatgttaacactgacattaactactgttctaccaaggcttatttcagctaccccattttgtgtgtgtgtgtgtgtgtgtgtgtgtgtgtgtgtgtgtgttgttactagccttgcttctttttgtttttttttcccagcttctgtccataaactgattttcatctactaaacagaatattgcatattctatttttatgttgcttatagctaccctttccttatcaagattcatagtgatttttccctagctatgctttaatcttattaaaacatattcctccattgcccatctcaaataaaattaatactttagcatgctctcaacttccctctgtttctccttccatatgttaataccacctggaatttttatcaaaacgttatggatgtacttctttctttattatggcctatgtaaagaacaatgaactttatttgttctcctttacttttgatatctagttgtttgctcatgcatttcttttatttttcactaagattacctctctaaaagatttttttcaaagagaaactttgggtccagcatggtggctcactcctgtaatcccagcactttgggaggccgaggtgggtagatcatttgaggttaggagttcaagacctgtctggccaatatggtgaaacgccatctctactgaaaatacaaaaattagctgggcatggtggtgcacgcctgtaatcccagttactctggaatatgaggcaggagaattgcttgaacccaggagatggaagttgcagtgagccaagattgcaccactgcactccagcctgggcaacagagtaggactcctcaaaaaaaaaaaaaaaaaaaaaaaaaaaaagagagagagagagaaactttgtatggcattatctttgagaacctaaatgcctaccaatatgtttttctcacatgtacaaaacagtttaattgaatatgaaattttaggttcaaagttctcttctccacagctttaaccattgtctcaagtctgatgtcaatttgattttttgtcctttgtaaatgatctccattttctttttggaatttttcagtattttctcctttctcagtgttcatacatttttctccaatgtgtccatatgtgtgtgtatgtgtatatatacatatgtttcttatttcttcccaagtaataaaagatacacgtaaatttacgtatttgctagatcggcagttgaggcgggaagaagtgaatgtttagggttatctagccatctgcttttatagctatgggatttcttccctgagatgagccctataattaccctgtcatcagtgtattagtcagggttctatagagggacagaactaataggagatatatagttgtgtatatgtatatattctatatatataggagtttattaagtattaccttacatgattacaaggtcccacaataggccatctgcaggctgaggagcaaggagagccagtccaagtcccaaaactgaagaacttggagtccagtgttcgagggcaggaagcatccagcatgggagaaagatggactaggccagtctagtcttttcgtgtttttttctgcctgctttatattctagtctcgctggcagatgattggatggtgcccacccagaataagggtgggcctgcctttcccagcccactgactcaaatgttaatcttctttggcacatcgtcgcagacacacccaggatccatacattgcatccttcaatgcaatcaagttgacactcagtattaaccgtcacaatcagtctccagccttaggctggcacttgactggttctgctgctttcctgccccacagcaggtgggatcggtaccaatctatccaggacaatgtggactgtggcccatattatctccatgtttaaaatcaggagagggaacaaatgactcattctgatttgctattttgttgtctgtggggtcatttttgcaagtacttggtataacataaagcattatattaattgttgcaattcttactatttttatttttcactcagttctcttaataactagcatgcctctatttcttttgtatgactttttgcagaaaaataattacatgtaaattctcgtttaggaaaggcctttatatttggggatcaagatctagttattaatgtatggtatttttatggaaatagctttattgaaatatagaacatataccaatagttattatatttatatttaatatatataatgttctaatatttaatatatataatgcactgatttttggtatatatacagttatgtaaccaccaccaaagtcaattttggatcctgtcatcaccccgaaagaaaccctatgcctttcagcagtctccctaccccacatttttcttcagcccctgcccccccaccccacacccatctcctagccctgggcaacgattaatctaccatctttacagattttactgttttggacatttcatacaaataaaactatatacagtgtgatcttttgtgattagcttctttcgcttagcataatgtctttaaagttgatacgtgttgtagcgcctgttagtgcttcattcatttctattgtcaaatgatattccattgtatggatgtggcacagtttgtttgtacattaattagttgatggttatttgagttgttttcaccttttggatactatgaatgatgccactgtgaacatttgtgtaaaaaaaattgtataaacatgtttacatttttttgggtatatgcctaagggtggaattgctggattatatcgtaactttttaccgcttgttgaaaagtactttctttctccattgaatagtctagggacccttgttgaaaatcaatttaccataaccatgaggatttatttctggaatctcaatattattctaccaatctatttatctattcttatgacagtaccacactatcttgatgactctacctttgtagcaagttttggaatctaaaagtgtgagtcatccaactttgttctttttaaagactgttttaaagattgaatttcaacttcctaggtcttgggaatgatcaaaatgtttaaattgaggttaaaacattatttttcaaaattcctttacatacactatctcaatctcatttgagtcttaagtcaatcctataaaataagcagaacatatttcatcttttttttctatttactattgaggaaactgaggctctgagagcttcagacctatgctgaagatcacaaattcagtcaccagtagagcaagaaccagggttcaaatctcatattggcctaagggtttctttcccacattgctttttatatatgctgattttcgttcaaattgagaagacatcttagaccttaatatatctatagaattttttttgtaaggaatagagttacttaaagttcatgtagtatactttgattccaggtgctcaaatagtcatagataattgtggatcttaaggaagaactttcacttggaaagttataggctgtcttagtatatcagagaattccagcagttatccattgtaatctaaattgctataaagaaatcaaagtgacttactaaactgcaataaactcagcacacaagctttcttttatttttatattagaagtttcttataaaaataacttttgtagttttgttatgctaataaagtaacagttctgtagaaacaaagtaatttaagattgtttatttggtaattatagtcaagtaggctaattaataattttaaagacagttgtttacagcatgattaatttttaccagactaattatttcattagtattctctgtatatattttaactactttataccagaattttcattttacaaatttgtaatgttttgattctctccacctataaagaaaattatagctttcgagtactataaagtggagttttcaaaaagacactggacatgtaagaagcatacggtaacctagaaaaaattaatttcgaatctactttctatttggtagctctaacagtgctaattttgacatcacattgaagttcattctctgtttattgggacagttcagcctcgtatcttatgtaagaaacctcgctcccaaggtgaaaaacgcattgttcaagtctaaggcagtcaaagtgaagcagctgtcctattaagagcattgatggcctcattcctggaccacattaagcccagtcctctgctcttgggcacagccagtggtccccctggttcctcattcctgtcctgccatatccatggacagtagttccagtgactggcctaagcagcttatttaattttccccaggtttccttttttcttatagctgatttgtgatatttgatatttttaattattatcatttactgttaatattctgattatgtaaagaatacatcctcattatagataaatattaatgtaaaagatataatacaaattaaaatatttcattatcccattacccataaatattcagtgccagaacttttatttctttccaataacattttcattttgcatatttgtatttttacaaaattgagagcatattttatagtgattttgcattctgtttttctcagtattagaataagaacatttttcacatctaagtttgattcaaaaatacattttaattattttgtggtatatcatcatttatttgcctattctgttttcaattagcattattctaatttcacactattataaataagactgcatttcatttttgtatataactcgatcttactttatgaaaaaaaacctactgaatcaaaagttattaagttttaggatcttgaggtatattgcttatttactttctagaaatgtcgctgttcacactatctttagcaaagtatgagaatttctattttcatgcatccttgtcaaaaatgattgttggtgtttttgcaactgttaatttgatacaataaatgttaccttctttcttttaatcaaatttttattgttagtaaaattgaatatttttgtattgtctgtaaccatttgtatttttcctagatgttcatttgttgatcattattctctaatccttttctattttaatagcatttattgatagtcatctgattatatgagaaatattgtattaattctagaaaacttagaaatgatagctcattcgatatctttcttcatctttctattggaacattccttgcctttttacttctagatcaaatatattaagcatttgtaaattacctgctataaatgttttctctctttggatattgattttaaatgctatattttctctacttttaattaatcagcttattgtgtcttttggtaatatttttcagaccctacctttgctttattttcatcctgaatttcctattatttttccatctttaaaaaatattcccttttatcctcaattgatttgcatgttataaaatttatttattttagtggttactcttaacattttaacaggcatagtttaagtcaaaaattaatgaacatttttccctcttcccaaacaatataaatcttgcttccaatttaagaacaatttaaatcttgcttccaattttctttgtttttgttacctttgttaagttctatgagttttgtcattccttgaattaaacattattgttgttgtattatatgatcaatatgtgtttaaatttacttacatattgtgtattttcttggctcacagttgttcttcgccttcagagcttccttttaaaatgtttctactttcctgctctgtctttaagtaatgcctttagcatatgtcttttgataataaactctcttacgtctttctatttccctctccagtttcagtatcctcttattgtttacaatctaagaaatgtatttaaaatatactttatcaagcattctagttatctttcagtgggagggtcacactcacacattgtgttcacgtgaaaattgttctgacactggcttctgatttccgttgttgctgtagtaggtcccttcatatccccagggaatatgttccaagagtccccgtggatgcctgaaatatgggatagtaccaaaccgagatatacatacctatgataaagtgtaatttgtaaattaggcacaataagagattaacagccgtaactgataataaaatagaacaatattaataacttgccagcatcactactcttgcactttggggccattattaaataaaataagggtacttgaacacaagtactatgatactacaaagctgatgtgataaccaagacagctactaagtgatgaatgggcaagtaatttatacagtgtagatgcaggctgaatatgctagacagagataattcgcatcttgttccaagtcagaattatgtgcaatttaatctttttcttctggaatttttccatttaatattttcagaccacagttgactacagataactgaaaccatggaaagtgaacccatgcataagggaagactactgtactaaaaactttccttcagtatcattgtcactcctttatagagaatctagcttttctctccaaaatccctgtgtttggtgttcagcagttttatcacaatttaacaaagtatacctttatttgtttttaacctacttggcatattttgtgcttcctatatttgaggatccaagtctttggttatttctaagttattgagtcattatcccatttgtattttctttattccccttctaagactctgattagatgcgtgttaaacctctttccatcttcacaatctcttagtctttctgttttgttttctatctccttctcaatgctgtttcttttggcttattccgaacattgttccaattcactaactattttaagtgtataaaatctgtttttgacctgctttctactatgtccatttggattactatcaacacatatttttattactttctaaagttatattttattatttatttattaaagttctatttggttctttttttaaatctgacagtttttgaaagtctcttcttccttactgttttcattacttcatttttcattccgaataaaattatttttacgttgtatctgatcatttcaatatctgaaatccttggaaatctaaatctgttgattatttctgctggccctcaatcattatgactgatttccttgtgtatttggtgatctttatgagctcttatatgatcttagtttgtggtttgctagtgacccaaagaatgctttcctgcatagaggattgcttttgccaaaaaccaagggcctctctttattctgtagtcacttcttccagggtctctggaatagtgcaggaatctcaaactcagttttcctttttatttatttattatttttttgagacggcgtcttgctctgtcgcccaggctggagtgcagtggcatgatctcagctcactacaacctctgcctcgcaggttcaggtgattctcctgcctcagcctcccgagtagctgggactacaggtgtgtgcctccatgcctggctaatttttgtattttcaaactcagttttcttaccgtgtgagttgctcatattaacttttaccctcagggccactctgctgtcatatttgcttgctgctcattgcaccctctccagttttatctggttgccttggagcagttttatctggttgccttggagcattcccttactggctgcattctcagcaatgcattaaaaggtatacttcattgggtaggcacggtggctcatgcttgtaatcacagcactttgggaggcctaggcaggaggattccttaagcttaggaggtcaaaatccacctgagcaacatggcaaaaccctgtctctacaaaacatcccccccccccaaaaaaaaaggctgggcatggtggcatgcatctatggttcagctactcaggagtctgaggtgggagaagtgcatgagcccgggagttcgaggctgcagtgagccatgatcatacactgcactccagcctggttgaacagagcaagaccctgtctaaaaaaaaaaaaagaaaagtatacttcattaagcatttggttattttgaagtgggaaggccctacttacactatctgtagttgtctcctctggcaactctattttactgaacacaggttctctttggattgccattcctcctcctggccttggctcgatattttcattgtcaccaatttaagactcaggctttggcaagttgaaagggatgggaagggaggtccccttcacttgttaatgtggtagtagcatagaaacagtcaagccatccatttcctacagaccttttggtactcccccagtttcagagagaatgaggactcagacccccaattctgcttctttctaagcctcttggggaccagagagtccaggtatagtcttttaggaactgtattgacttttctcttggtgtttacagttctctctagaccaagcctctgtaaaattcttacactgggtcttgatgctggttcctatgcacttggccagtccaaatgggagaaagtaaggcatgagttccctccaccagagtttctataggacccaatccctaattgcacatagttgcctataggccccatgagccatttgccttaagagagggagatgattttcagttggtagtagacagaaggaaattgtaaggaaattgccaaattcttcataaaaaatgatttagaagataatgattttttttttttttttttttttttttttttgagatggagtcctgctctgtcgcccaggctggagtgcactggcacgatctcggctcactgcaacctctgcctcccagattcaggcaattctcctgcctcagccccagtctgtagctggggttatagacacccactacaatgcccagctaatttttatatgtttagtagagacagggtttgaccatgttggccaggctggtcttgaactcccgacctcaggtaatccacctgcctcgacctcccaaagtgctgggattacaggcatgagctgccatgcccagccatgattttttattttaagaaaattatttacaataaataagagatttttataggcacacctttggttcttgaagtgaggaaagatctagtttcccagctgcattttggaattttcttcatctttatgttaaaattataaaaagacctttcttcaccaaaaccatttagcaggcaatgttttggaaaaaatgttttggaaatgtcagatttgtagtattaacataaacatcgtgagtttcatgattgattgaagcatgaaataagaattaagtaatggtgcttcttcaatattaacatgatataaatagaactattaaaaaggtatgaatataatgtattactgaaattattgaaatctacatggttttaagttaatataatctgaactttaagcatgataaaagtcatttgtttacagtttaaataaataatttgataaatgccctaggttaactgtcctaataaagtaaattactgctatcatctttcattcagaattcactgagtcaaaagctaaatatatatatttataattattgtatacatccaaaattaaaattttacaaatgaaatttttcattgcactattgaaatattatttttatcttatcttaaatcatttaagatgaatataagctatgatggagaaaaatgtaaagatgaaaatgaacaacagcaacaacaaaaaactggtttctcttcactgtgtctgacataataaatagaaacatttggatgtacaaaaggcttatagtcctgatcaaccttattcatactggctgccattcaagagaataatgtattatttaagcatatggtcacatcacagctgaatcaatctagcataaactatttttatacagcatccttgcaagtaagaaatggctatgtaaagtaagactataatatcctttattggaaagttataaatacagtttaacaatgcttgggaacagtgttatagctttggataaacaagactgaattgccaacactgtcctccacccttcacctactgtcagataaaagaggtaacatattgaatccaccaaaaataactgtgctcaacagaatgggcagattgtatctcctgcacccaagaacattccacaatctatgaaacacagtagggtaaatttgagtattgtcaaaccctttgaatactcattcctatgtatgttaaaatgattgtgtttaaaacattaacacaaaagtagtattaacatcctaattaatacaactttctcagtaacagcaatcagctagtcatatttttggctcctgtttctaaccttttagattgtcgtgaagcattcattttatgtctggtagtatgcagtagttatttcctagtttttgtttaaatattttattaggctgttattgcctatgacagttacttttacactaaatttatgattttgcttaatatattttttgcttatgtttcatataaaatcagttactaatttaacttgtatatccttttttctgttacacgcagtaggagataatctcatcaggtttatatcctcaatggaatagctgactgtaagaatccttaaaatgctgttaaatcaaatagaatcttatgaagtgaaataccagatattcaaaatgtaaagctagatattttatgtgtagaatctaagaaaccaataatgttatactttagataaacattttcatgtgttcccatattttacttccttagaaaataaaatagcaactaggtcaaaatttagagtattaaatatgcaaatttacctcaaatcttaatatagattttttttcatcaaaggtcatagttcttacatatttcataccagagaccttttcttatattcacacttgataattttgtttatattattatatgtctttttaaatttgctttatagagaaaggctctggatttaccattaatgacatataaaagtggggcagaaagttgggtgcagcagcacacacctatagtcccagctacttgtgaggctgaggtgggaggatcatatgaggccagaagttccaggccaggctgagcaatatcaagatcctatctatctatctatctattttgtttttttgagacggagtcttgctctgtcccaggctggagtgcagtggcacaatcttggctcactgcaacctccacctcccgggttcatgcaattcttctgcctccgcctcttgagtagctgggaatacaggcacacaccaccatgccttgctaatttttgtatttttagtagagatggtgattcaccatgttggccaggctggcctcaaactcctaacctcaagtgatctacctgccttagcctcccagagtgctgggattacaggtgtgagccaccacacccggccaatcctatctctttaaacacacacacacacacacacacacacacacacaaacacacacacaatgttatggaatagactatcaagtatgtaaagtttaagtgcaattttttatgaaggagtttttatttcttgatttttttactcatcccagcacattttggaaaataaaagtaataacagctcagttttatttttccatattttaaactggaaattctaccttaaaaacaaactctatatactatgaacaattgtctccacaaatattgacctatatgcaaagcaatacaggaggtagatatggaaaatatgttatctttacctttcagaaacttacagactaacaagagagatatgtgcgtgtaaaaatacctctaataaaaatatgttattaatgccaaaaggacaataagcatgaagaagaggaaaaaggaatacaatactcaatgtattgctgaatgtttcaggaaaggttgtggtcatttatcttgggctttaaaggtacctaaaatgtcagtaggcagagataggaataggtgaggatggagacaggtaagaagcatgccaagttgagagagcaaggtgagcgagggacggagacagaaaacagggtggtatgtgagtgaggcagtgagaaggccacattcacccaatgaggaagcagctgtgagagttaaggtagcaaatataggagcatatcatggaagacaatttaaacaagatgccgaggatcacacagaaggtttttgagaagagttttatgattaattttagaaagattacactggcagcattttctagcatcaactggattgaagaataattgaggtagagaaacaatttggaagggcaggcgctgaactagtgattgtcaaaatgttaaggtgcaaatattactgaaaactttgacaatgtagaatatatagaatgtaagtaactgaatatagggatagtctgggtcaaaaagagggaggggtcagaaggttgggtcttcttcatatgtacttgaactcatgggagtgagaaaagagaattgaaggtagaatctaggaaaattgctacaaagaaacaaagattcaaatgacaggctgagaaagagtacagaattaagaagattgaagagttttagaactattagaattaagaataagactgcatgccaagaaggatggtgtggtaaaatatgtcatccatttcaaagcagtcaatgaagataagcactaggagaaaagatggaatttggtaattatgcagtcattggtggcttttgaggaagtaatttctattaaatggcagaagccagaccgcaagagatgtgtgaagatgagaaagtggatgcaacaaggatagatgacccattttgaaactgacaatattgaaaggaaggaaggacatgagatagtaatttaagaaattggcagtttcaagagaaagtttttttggggaagaaatattcaagggaaaaaatgtatagtaggataaaggggaggtgaaagcagagaaaggatcaagaagtcaagtagaagtattaattttagaaagatgaaaaaggataataaaattatgggtaaagatgaaagtacattttgagcctttctatttgataggagtttaccttcgatgatcttataatttttcacgataattgagaagtaaggtcacctgcagagagtgaacttgatgtacaaggttgaggcttaagaatagtaagagatgtagaacatttgtttcaaaggctatgatggttaagacaaaaactgagttatccatctcctttcactctattcttcattttctatctgtcattgagctctgcctgttctacagcctaagtatatcttaaatgaatctctttatcatcactactgcccctgtttcaagccttcatgatttttttcctgctctgttacattatcttccttactggtttccctgccttcactcttccaggcagttttccacattgctactaaagtaatctttctagcatgcaaatcttctcatatcaccttgctcagaattccccaatggcttctctattagtccattctcacactgctaataaagacataccccagactgggtaatttacaaaggaaagaggtttaattgactcacagttcagcatggctggggaggcttcaggaaagttacaatgaaggaggaaggggaagcaaatatgtccttctccacatggcagcaggaaggagaagtgccgagtaaaaggggaaaagtcccttataaagccatcacatctcatgagaactcactcactatcatgagaacagcatagaggtaaccactccatgattcagttgcctcccaccaggtgcttcccaggacaccacacatggggattacgggaactacaattcaagatgagatttgggtggggagacagacaaaccatattagcttcctatctcttatagtaaaaaaaaaaaaaaaaatacaactcttctatataatgtactatataccctacatggatctgatactaccattcctatccagccatttcttgtcatttcaccccaataagctgactccacacaacatccctgcccttgcctctgactctgtctctgttgttctcttgtcctagaggaaattgcctaaagtggtagtttaactaattcttaaagttcgaaacaaaagaaagaaataataaagaaaaaatgaatgagaaacattatcttaaggtgataaaaaggattgctgagcaacagtgaagcattgaggatatagaaattatgtaggagcacagtccctattcttgtgaataacagttcaagtagaagtgaaagggaaaactgatgtttaagatcttaaaaaatatttgagttacaaagtaattaggactgcctgattttgctttatttattgattattctcaattagatagatctgtgttttaattgctcaattatgcaactttcttattgtattttaatgcattaaaatactatgtgtattttattaaaattgtatgtgtattaaaatacacatacagtaactcagacttaaaaaaataacaaaaagaactttgtttagaaaaaatatagattttaagtgaacaggaaaaatctttttgtaaccacattgaaagaagttgttcagccagtatattgtacacatctacacatatgtttttattctaggagtaaatataaatgaatatgtattcaacatgaataaatgtgagtaaatattgagtattaatgaacttacataaattttttgcttataacttcctgttagaagaagcattctttcaaaacttttaaaaatgtattgcatatgtggcctcttaaatgtctttgaaagatacatcataacatctatgtgtttggaggaattttagaaatttttagaaactacgttcacaaaatagaatgattatgcctatataaattaaatttcaagcagttccaaataacattttattaaaagtacattaaattttgatgacctcattcattaagcaaaataatgtacagtgctctatactagacattccagatagcacaaaagtgcttatgacataattgatactctagaatatcttagaatctgctgttaaggatgacattaattatatcaccccttgaatcatctctttcttcttctgctactgcttcttctttcattctctttcagtctagttctcttactacacactatttctcatgtgttacaataacatgcaaatgatgataaacccaaagcaccataggatctcagaatacttttaattcatctaagtaagtttaatgttagtataattagtaataaagatatttcattatatttacattaatatataaaccctctttttgccataatatttgattaactatatacctctaatcagcctcccactgtattgaatttaatgtgagtgtatgaatatgtaaatgcacgcataatacatatacacagttttcatccagcactgaacgacaatgtgattgtcacaataattattttcctacatattcttgaattgtgagggcaatatagttataacatcagttgttaatttttaaataatgttagctatttctctaagaaaagtaatatatcttaattgtaaaattttgtaaaatgcagaaaaatatattatacaaataagaagcctcattcatactccatcactgtttgttctacaagtgtgtgcagtcatacagtgaccacaccaatcaagatatacaatgtgctcatcaccatggaaagcaaagcccatcactctgccccaagacccttagaaccacttatttgtgcctttatagttttgcctttcccagaacatcatgaaaatggaactttttttttttgtgaccgagtctcactctgttgccaggctggagtgcagtggcaagatcttggctcactgcaacctccgcctcccggggaaccatattttatgcagacttctgtgtcttgtttctttcacttagcacaatactttcaatgagctccaaccatgccattacgtatcagtagtttattctattactaagtttattccattgtatatccaccacagtttatttatccagtcaccagatagtagacatttgtatttttcaggacctggagctactgtaaataaagctatcattaatgtttgcatacaggtctttctaataaaatatgtttttatttctctcaggtaaaaagctatcagtaggatttctgggccatatggtaaaagtatgtttaactttagcaattttccaaagtgtatatgccatttcgtatttctccccacaacacatgagagtttcagttgcttcacaacctcaccagaactaggtattgttgagattttgtattttgttttgttattctaatgactgtgtgatggtatcttgttgtattagattggtgcagatgtaatggcaaaaactgcaattacttttgcaccaacccaaaatttggttttgaagagacgtaaattaatttccaacattggtggggtctggctacccatttataggtatgcatatcttcaaacgttagttttcccatagctatatatgcatagatatcaactgaggaatattctgtaatgaaatactaggggtggggaatatgtaatatgtgcttaaaaaacaagaatccaaaaattgaattttggaaaatatcttcataaaataaacagttgtatatttccagttcttatgaggccttcttagtgaaataactccattatataagaaaagaaatattaatatcaaaggttaatttttaacttttataagaaaaaactgagtgtacatagaaatagagagataagtcatatcactcaacttcgagaactgctgactcatggccaatcttgtttcatctttatgctctctcaccccgaacttcagcattgattattttgaagcaaatcccaggcatcaaagattaacttttaattgaatctcagagtttttgatttatcatattagtattgaaaataattatcttaaaatgtttaaatttttaaacttttagtattaatccctaaggttttagtagtctcttgatttgacccatttacatgtggagtatttactaggtatgatattccaggcatttattcaataagcaataggaaaatcattatacctgaatgggaataaaagcttattaagtgagattgttttactttattagcatactttgtatatagtttctttgatagcattttatagacattaaattatatgaactgtaggttttgcataatggaagttgccacttaacaatattggcccctattttttattcactataatatatttttgagttacacattgactataatcctaggagtactttcttaattcttatattataatactgatctaatttttctcactgggaagctcagctgaagtgcataacaggttttaattaagaataaaaggaggaaagaaaacaaaacttcacatcattaggaattctgatttctgctgctctaacaaaaaagaccacaagcaatatgagattcatcaaatgtgagaaatgataactaaccatgttaggggtcacctataacaaactacaataattgagaaagtaaccttgacgcatttcagttgaagtgtgagtatctgtagtttattatattccagacagtatacattaccaaagatgtagggccaaattaactttaatgttgcactcttcacaagacattccatagctagcaataacattaagataacgctgttaaagtaagaatttcaattataaggcagatgagattgtgaaaacatgacagctttaatgagcaatagtagttgggattactttgataaggaatatagttatcatagatagaaaagaaacaaaatacagcctgcagccttttcttattgtgtcatgtcaccctctattgataacagctttgggttccaattcatttctattcattctcccaacctgtgctagaatgatgatcctttatcttacatatactgttagaacaccttccaattctgcattccttcattcttccaaatagctgatagcatgttatcttacttgctctcatcacatcttggttaagaaagaaaggcaatcaagatattggccccatcttgcaggtgggaaaactggatcgataactcagtggtaatactgggaatagattcagattacttgaaagatcaccaaatgcttattcaggaggctgactttaaccaaggaatatgtaatgaatagaacccaaatacagtatcattctttgtggttgtatgagacatgctcttgtttttgaatttagagtggtagagagagacatgatcttgtttttcactctggaatgacagccttcttttcctctgatcttattgttcccaccagtgatcttcactattccaactagtgagaggtgtgttattccatctggactgctacaacaaaaataccataaacttctgttgacttataaacaacagaaatttatttcttacaatttcagggactggtaagttcaagatcaaggcactggcacattcagtatctggtgagggcccaactttcgggttcataaatagtgccttcttgctgtatcctcttatggtgaaagatgcaaacacactccattggccttctttcataaggacactaatctcattcttgagagtctggctcttataacctaattacatcccaaagacttcacctgataacaccaggactttgtagattagatttcatatgaatttgggggaggatacaaacattcagaccatagcaagagcgacatattctttgttgcccctaagcatgtaaccattcctacagtggttgtatctactggccttgctagtgaagcctgtaagtcatgtagaatgtactgctattgcttttctgatattatttaacaaagaaacctactcccagggcagccagcaatgttgacaacattttgacctctcctgaagcttccaggctgttttatacaatgaaggaagggtaacaggtcatcatgcttatctgatctataattcatttgattaatgttactgatcagctgcatcttttttttttttttttgcctctctgttgtaaattggtagggattgtagtttcttgttcactttggatttttccattacacatgcaaatggagatttttctttacataaataaatctttatgatcattttggttatttttaaaggtctggaacttttttctgtctctgaaagccctggacactcttttggtttcaatcaccctatgctgtatgtcactatttactcaccatttatataattaatataaatatttttcctcaatttctttttaaatacatttctcataaaacattttcacccacattgcttgctctagagcatgaccaatgttcatagtctttgctacaatatgttgtagaataccataatgtttgtgctgtctactctcatatttacttaatctgtcatcaaagggagcattgccgatgcctttaagtgaaccaatcgattatacagcattatgtttagcttccatagcagcaattttgttttctcccttaggaatcttaattctggaaatgaacattttatctagattcggaatgcttatttattaaatgcaaatgtatttagcttaaataatatatttataatgattcacagtaacaatgaaatgtataagacattttactagagtctatgatgattttcaatataatcacaatgaaatgtatttaaattaaaaatattactgtaaatctctcaagatgaaccacagagctcaatacaaaattgatgttcttaagttaatcagttagttaatgtattgccaaacaaactagaatagaatactatattatcagggcaactttgttaaatagatattcaactttttaaatataagaacatagtgtatttcaaccatcttttaatactaattttatgtatttttattgtacttattttgttttatttctttatcattagaaacagtaaaccaataattccaaaacaaagaaaactcactaattctttttattcttgttcattcctttttgtcctgttaatcgtacttagaaatacagtattgacatttcctgggctgcttttgtgtagagccttgtgctgatatataaacatagaaatttatacatagttttcattatatattagtaaaaaaataagtgaagtagaaaaacgggtaaaagacgtgtacagtaaagatgctgaacaaaaactcacgtgttttattttttaataccaccctcaggcatgtaattaatattattatcctcagaataatgtttaaaactgatcttttataactgttatttcagctctcatgcattctttttgctggagaataattgattcatctcattatttgccaggtttagaccttagtaacttgtacatccctatgataaaaattattttggaatggaaagagagatatctaaaaagggatgaaatcatgccaaacatcttatctctaacataaaaaaaattaaatttgaagccagaatttcagttccagttctacttttagcttgtgtgaccttgagaaagtcacttaagcatttctgagcttcaagtttctcatttgtaaagtcgaagtaagaaataccttttatgcctagcactcagagttcttgttggatcaaacaagatttgtacatttagttggaaaactcaacatttgtatctaaacataatgtattccagcagagaattactgtccaccattttcatttatacattttaaatagtgatttattgatgatcttcaatatgcaaggagcactgctagacactagggaaataaaagggaattaagatagtacccaaacacttcaaatcctcatgggcaaggacacgtgaacacataataaaatactttaatttcaattacagacactaatgggcaggttgttaatagaatgtttgccaactttaagtagttttataataaaatataatagtttaaaagaaaggtctattaataaaaacagaattaaaatatatatagatcaaataaagtatggaaatttagttgaaaaattggcattaatcagtaggaaaaagatgggcttctcagcaagtggtattgggatagatgaacagctatatgggaaaagagaaaactgaatctgttccaaatgtaacagaatcaaattctaaaaagatcaaaaatttaaattcaaaaactattatgttactaggagaaaacaaaggtgaattactctgtaacctcagagtggccaaaagtttcttaactgattctaaatccagaagcaataaaggaaaaggctaataaaggtgacaatatgaaaatttagaaaaaaaaactttttatactaaaataattgcaaatatttttcacttgttaatgcacaataacaaatggaaaatatttgcaatttttgtcataaacaaagggttgttatccctaaaatataaagcacttttaaaattaaaagaagaccagcaactctataaaaatgggcaagagacatccaaagatagtttgcataacataaatgcaaagggtccttaaatataggaaaagatgttccaattcactcataaaaatgctaattgaaatcactgaaattactattgtttatcagtaaggttggcaaaaacacaaaaggttgaaaacatacttgtggtaagcagaaaagtgacccccaaagatgtgcacatcctagttcccagaacttcacatggcaaaagagattttgaagatattaaggattatgagagatgaagattatcctggattactcagatgggcccaaagtaatcacaaaggtccttaccagtgaaagaggagtcagtcagaggagatgtatctgatgatggaagcagaggttagaacggtgtgatcagtgcctttgaaggtggaaggggactgcaagccaaggaatgtgggcaacctctacaagctggaaaaggcaatgaaatggattttctcctggagcctctgaaaggaatacaaatctgctgtcgccctgattttagctccctgagaactatttttgacttctgatttccagaactgtaagataagaaatttgtgtttttaatctactaaatttgtggtaacttgttgctatagcactaggcaacaaataaaatactcttaagaggaaggttgtgagaaaacaggcactttcatttattgttgggaatgcaaactgtacagcctctgtggaggagaattttgctatatttacatatacactcacccttagatcccacaaacacatctctgtcactgtcaaatattgtaaaaagatttttcagccctatttgtaatagcaaaaaatactgggaacaacccaaatatatattaatagaaattggttgaaagaagtgtggtattacgttgtactatgcagttgtaaaaaaattaaagttttcatcttatgctgtggaatgatctcaggcaatattgctaagtgaaagtggcaagttgaaaacaaatgtatgttactatttgacgaagaagagggagaatataagtatacctttacctacacatatatatttgcttttttaacaataaaatgataaactaaaaagtattatttgggttttcttttcttttttagtggttattcataggactgaaaagaccaggatgaaggaaatagggatggtaggtagacctaagtgtactttacttcgtagatctgaccctctagccctataaatgtattacaactatgaagttttactgatttaggaattcaaaatatttcaaatatgcacaagttagaattaatatgtgaatgaatataaatatgaatgactgaatcttatgagaatttcctaatttacagaaagcagttttcaaaactgatagaggatggagttcattaaaaatatttattcagaattcattatgacctcatcatcaagtaggggaatcagatgatatataattatactgcaaggaagatgatgaaacatccaaaagagagatttaaagggatttcagagaaatgagagtgcacttccacctaggagaataagaaagattttgcgctcattcagttagttatatattcaacaaatatgtactgagcccctattatgagcaaactctgttataggcagtagggttcagtgatttttaaaacagtcaaaaactcctaccttcatagagcttacatgcttataagaatgagggtaacagacaataaataaaagatgaaaagaactgataattgaccattacatttagtgtagtggagatcagtgttgaccatggcaagagcatgcacattcctatcaccaggacattcatagtccccctagatgaagacagacatttacataagcaagtactatgttgtatgatatgttgtacctattttaaagaagcctctatagcgcttgtagtacgttgagcactttaatagacagtgagtactccataaatagacaagaaaatgatagttatgcaaactaatgttagcaattattttgtacttatactgtccagcctctgatatatttatgcctagtattttaagtaagtagcgttcttttcattttctttgctttaccaatgaaattccatagaaacaaagtattgccaacacttttggaaatgaagctgtgctgttttgcatgaggactgttctgcgtgagtttggtcaagggctaaggtcaaatttgggagactcccttctaccatgtaatagtggcatgacactaggtgaattagtttacctacagctcaatttctgcatctagaagataggaataataatacctgtgttcagtgatgttgtgaacatgaaatgggatgcacatatggaagatttgatgttattaatcacatatttttgataataaaaattctctttaactagaagtcccttttttattatactttcagttctggggtacatgtgcagaaggtgcaggtttgttacataggtatacatgtgccatagtggtttgctgcacccatcaacctgtcatctacattaggtatttctcctaatgctatccctcccctagtgcctcattccccaacaggccccagtgtgtgatgttcccctccctgtgttcatgtgttctaattgttcaactaccacttatgagtcagaacatgcggtgtttggttttccgttctcgtgttagtttgctgagaatgatggtttccggcttcatccatgtccctgcaaaggatgtgaactcatcctttttaatggctgcatagtattccatggtgtatatgtgccacattttctttatccagtctatcactgatgagcatttgggttggttccaggtctttgctattgtgaacagtgccgcaataaacataagtgtgcatgtgtctttatagtcgaatgacttataatcctttgggtacatacccagtaatgggattgctgggtcaaatggtatttctggttctagatccttgaggaatcaccacactgtcttccacaatggttgaactaatttacactcccaccaacagtgtaaaagctttcctatttcttcacatcttctctagcatctgttgtttcctgactttttaatgatcgccattctaactgatgtgagatggtatctcattgtggttttgatttgcatttctctaatgacctgtgatgatgagcattttttcatatgtttgttggctgcataaatgtcttcttttgagaagtgtctgttgatatccttcacccactttttaatggggttgttttcttcttgtaaatttgtttaagttctttgtagattctggatattagccctttgtcagatggatagattgcagaaattttctcccattctgtaggttgcctgctcactctgatgatagtttcttttgctctgcagaagctctttagtataattagatcccatttgtcaattttggcttttgttgccattgcttttggtgttttagtcatgaagtctttgcccatgcctacatcctgaatggtattgcctaggttttcttctatggtttttgtggttttaggtctaacatttaagtctttaatccatcttgagttaatttctctataaggtgtaaggaagggatccagtttcagctttctgcatatggccagccagttttcctaacaccatttattaaatagggaatcctttccccacttcttgtttttgtcagatttgtcagtgatccaatggttgtagatgtgtggtgttatttctgaggcctccagttctgttacattggtttatatatctgttttggtaccagtaccatgctgttttgctttgccttttagtgtagtttgaagtcaggtagcatgatgcctccagctttgttctttttgactaggattgtcttggcagtgagggcacttttttggttccatatgaactttaaagtagtgttttccaattctgtgaagaaagtcattggtagcttgatggggatggcattgaatctataaattgccttgggcagtatggccattttcacgatattgattcttcctatccatgagcgtggaatgtttttccatttgtttgtttcctctcttatttccttgagcagtggtttgtcattctccttgaagagatccttcacatttcttgaaagttgttttcctaggtattttattctctttgtaggaattgtgaatgggagttgactcatgatttggctctctgtttgtctgttattggtgtataggaatgcttctaatttttgcacattgattttgtatcctgagactttgctgaaattgcttatcagcttaaggagattttgggctgagatgatggggtttcctaaatatacaatcatgttatctgcaaacagggaaaatttgacttcctcttttcctaattgaataccctttgtttctttctcttgtctgattgccctggccagaacttccaatactatgttgaagaggagtggtgagagagggcatccttttcttgtgctggttttcaaaggtaatgcctccagtttttgcccattcagtatgatattggctgtgggtttgtcataaacagctcttatgattttgagatacgttccatcaataactagtttattgagagtttttagcatgaaaggctgttgaattttgttgaaggccttttctgcatctattgagataatcatgtggtttttgtcattggttctgtttatgtgatgtttacctttattgattagcgtatgttgaactagccttgcatcccagggatgaagccaacttgatcatggtggataagctttttgatacgctgctggaatcagtttgccagtattttactgaggatttttgcatcgatgttcattatggatattggcctgaaattttcttttttggttgcatttctgccaggttttggtaaccggatgatgctggcctcataaaatgagttagggaggattccctttttttctattttttggaatagtttcaaaaggaatggtaccagctcctctttgtacctctggtagaatttggctgtgaatttgtctggtcctggacgttttttggttggtaggctattaattactgcctcagttttagaacttgttattggtctattcagggattcgacttcttcctggttttgtcttgggagggtgtgtgtccaggaattttccatttcttctagattttctagtttatttgcatagaggtgtttatagtattctctgctggtcgtttgtatttctgtgggattggtggtgacatcctctttatcattttttattgtgtctatttgatccttctctcttttcttctttattactctggctagaggtctatctatttcgttgatcttttcaaaaaaccagctcctcgattcattgatttttttgaagggtttttcctgtctctatctccttcagttctgctctgatcttatttcttgtcttctgctagcttttgaatttgtttgctcttgcttctctagttcttttaattgtgatattagggagtcaatgttagatctttcctgctttctcttgtgggtatttagtgctataaatttccctctccacactgctttagctgtgtcccagagattctggtacgttgtgtctttgttctcattggtttaaaagaacatctttatttctgccttaatttcattacttatccactagtcattcaggagcaggttgttcagtttccatgtagttgtgcagttttgagtgagtttcttaatcctgagttctgatttgattgcactatggtctcagaaactgtttgtcatgatccgttcttttgcatctgccgaggagtgttttccttccaattatgtggtcaattttagaataagttcgatgtggtgctcagaaaaatgtatattctgttgatttgagatggagagttctgtagatgtctgttaggtctgcttggtccagagctgagttcaagtcctggatatccttgttaattatctgtctcgttgatctgtctaatgttgacagtggggtgttaaagtctcccactattattgtgtgggagtctaagtctctttgtaggtctctaaaaacttgctttatgaaactgggtgctcctgtattcggtgcatatatatttaggatagttagctcttcttgttgcattgatccctttaccattatgtaatactcttgtctcttttcatctttgttggtttaacatctgttttattagagactagtattgcaacccctgcttttttttgttttgcatttgcttagtatatcttcctccatccattcattttgagcctatgtgtgtccctacacatgatatgagtctcctgaatatagcacactaatgggtcttgactgtttatccaatttgccagtctgtgtcttttaattagggcatttagcctgtttacatttaagtttaatattgttatgtgtgaatttgatcctgtcattatgatgctagctggttattttcccctttagctgatgcagtttcttcctagtgtcgatgttctttacaatttggtatgtttttgcagtggctggtaccagttgtttctttccatgtgtagtacttccttcaggagctcttgtaaggtaggcctggtggtgacaaaatctctcagcatttgcttctctgtaaaagattttatttctctttcacttatgaagcttagtttcgctggatatgaaattctgggctgaaaattcttttctttaagaatgttgaatattgtcccctactctcttctggcttgtagggtttctgtcaagaaatccactgttagtctgatgggcttccctttgtgggtaacccaacctttctctttggctgcccttaacattttttccttcacttcaaccttggtgaatctgacaattatgtgtctttgggttgctcttctcaaggaatatctttgtggtgttctctgtatttccagaatttgaatgttggcctgccttgctaggttggggaaggtctcttggataatatcctgaagagtgttttccaactcggttccattctccccatcactgtcaggtacaacagtcaaatgtagatttggtccttttcacatagtcccatatttcttggaggctttgttcatttcttttcactcttttttctctaatcttgtcttcttgctttatttcattgggttgatcttcagtctctgatatcctttcttctgcttgtgattcggttattgatacttgtgtatgcttcacgaagttctcgtgctgtgattttcagctccatcaggtcatttatgttcttctctaagctggttattctagttaacaattcatataacctttttttccaggttcttagcttccttgcattgggttagaacatgcttctttagctcgaaggagtttgttattacccaccttctgaagcctacttctgataattcatcaaactcattctctgtcccattttgttcctttgctggcgagaagttgtgatcctttggaggaggagaggccttttggtttttggaattttcagcctttttgcactggtttctccccatcttcatggatttttctacctttggtctttgatgttggtgatgttgatactattcctttctgtttgatagttttttccttctaacagtcaggcccctctgctacaggtctgctggagtttgctggaggtccactccagactctctttgcctgggtatcaccagtggaggctgcagaacaacaaagattgctgcctgttcctacctctgaaagctttgtcccagaggggcacccaccagatgccagccagagctctcctgtatgaggtgtctgtcggctcctactgggaggtgtctcccaatctgtatacacgggggtgtcagggacccacttgaggaggcagtctgtcccttatcagagctcaaacactgtgctgggagaaccgctgctctcttcagagccgtcaggcagggacatttaaatcactgaagctgtgcccacagccgccccttcccccaggtgctttgtcccagggagctgcagtgggctccgcccagttcgaacttcctggtggttttgtttgcactatgagggtaaaacccgcctactcaagcctcagcaatagcagaatacttttaattcttatgggtgtacataaatgttaaaatacattagcttatttttgtactttatagagtagatgcaacagaatcaattttgtttttataaaaaaacttttggttatgtaatagtgtcaataacaaaatatttgtattacaattttaaaatacttcattcaatctttgcaacagcccattaatataggcatttatactaccttaatcttatagagcaataaaaggagctcagaaatacaaaaattaatgcctataatattgtattattttgtttacgcggatgcaggaagtctgggttaggctgaatatattttgtcttgaggaaattggcatttttaaataaatttttgttttgatttacctttctctttaaatcagggtttctcaactagtgacactagtgacagtttgcactagtgaatacatatttgggttgttctatgagaaaacataagcactagtgacatttcgcactggtgatccattgttgtggagggccgatctgtgaatggtaggatgtttagcaccctctctagccactacccactagatgccaggaacacacttgctccatttgtgataaccaaaaatgtctcctacccatattgtcagatgacccctgggggagtgaccaggggacattagtgagaacgaatgagtgaggaaaaagtgagaattagtgagatgtgttaaactacagtagagcaaagttttaattaggttttgactaatgttttcatttgtattaaaaagtaaagatgataattttaaagcattttatgatatagtcactaaatatttgagtaaataaaactttttttttttttttaagatggaatctctccctgtcgccccggctggagtgcagtggcatgatcttggctcactgcaacctctgcctcctgggttcaagtgattctcctgcctcagcctcctgagtagctgggattacaggtgtgcaccaccacacctggctatttttttttttttttttttttttttgtatttttagtagagaccaggtttcaccatgttggcagactgatctcgaactcttgacctcatgatctgcccacttcagcctcccaaagtgctgcgattacaagcgtgagccactgtacccggcctgagtaaataaaactttctaattgtgaacactttacattgatctgataaaatttacagaaataaaaatgtgaattttagtcaaaacaaagaactatatataatatatatttttccatgtggctcattacatatgattttaattaatactttctacaaaacactgttcattactcccctttccaaaaaaaaagactaaactcttactaaatatatttgtggttttggttttaatggttttgtttttggttttacaaatactgattaaatgttagtagggaagaagtttagttttattttttgctctagtacatgtaatattctataaattttattgtgatgacatgacattttcctccttcaaaaagacagcagatgaatgaaaaatatatttttacgtattcattggtactgaattttaaataaaaataatttataactaattttaaacattcctaaatggtaagtctagaagacttttaaaaattgaataaaacaatttacagtttaattatatgacttagtagagcacattatttcctattatcctattaccctgattgaaagataaatataaatgttgggttattgttggtataattaagccattgaattgtaaacatctttcttctgaaacaatacacacacacgtatataaaaaacaatattattcttattagctatgaataaaaaatacattcctatgtatatactggatttcagatgacagaaacagatagaagatagtgtccaatatttttgttctacttgtttgaaaggttatcaagtagtaagtaataccagcagagcatgaaaatgaccagtaatttaaaagtaatcagacaaggtatagtttgttgtatttttaactacagaaggctggtcaatagctgcactcaatttgctgttatttccccatggaaagcccagtttgttagctttaggataggcgcagtcaatagattcttttttactaagagaaatgatccatgggaggtctcctaaggagtaaagtcatgagaaaacataggcagcctttcatgctgcacaacacaactagggaagtaagactctgacctatttgaggtagcgtttcaaagactgcactgttggagctcttttttaaaaaaatcaaatcatgtaatcaaaagaaagctgaaaataatagcaaaaggctagttttattagaaaacttttgttctattataataatgcattatgtgaagtgcttggaattggcctcaaatactgttaaaacacatattaaagaagccaataattacactttgtaagtttgcctctttgtgggcaccctttgtcatctccttgtggaataatttgagaggtggaggagacacatagacattgggcgaggtaaggaaaaagttacaacacacattccagtgctctaagacctcattggaccacctgctgatccagatatgtgtatggtggagacacaaaaatcataaataacttcccccccagttaaatatcgctgcaattaaattctccatttgagaaaacaggattgaagagtgatgcccttgttgacagcatttattactgtgggctcacctacttccaaaaaagaattgagatgacttacaatgaaaaggaaggacaaaataacagcacatttgctgttgctggtggtgttggtgttgggttttgttttgttttgtgagtggtgtgttagaataaactttggagtcacagcagctggataaaaatcctagctttttctcttataagattttgacttgggtaggttaattcagttctttgaactttgtttccttaaataaaatcaggcacaataatgactaattcaggattgtggtgagaattaaatgagctaaaataggtaaaacacctaggatactacccaaaacaaagtcggggctcaacaataaccattactttcctcccttaagaagatggagattttaaggaagcttacccacaagggctcttttctctttctctgtcaacttattgtcttttaagtatctaagatcacaataaacatctccaaattatgtaaaaaagaaattggccattgtcagaattcattattcaccaaagcttctctgagcacttgctccatgtatgacacctcacacatgaactctggggaatatgagaagtagctggcatgccccagccccagcagaaggctctttgctgcttggaaaaaggaattcaaaacactaagtttccttctttcttctgtttcaaaaactattaatagatatgtcagtaagcctgaaagttttattcctcctggctcagactgcactgatgacttcttcagaaagcctgcctggtcttttggcagatttgctaggatttggatgacctcatccatgatggctaaaagtatatagaagggtcagattaatttaatgcagaaaatctagtacatcctagaaaataatgaaaagttcaaaattaagaattcattgatggaaccagtcatttaatgtgagaagaaacaacacagtaatatagaactcagtatttaaaaaataatcagtacttatgaattattttcttaaggattaacttagagaactgaaatctgccatgtaatttatctagattgtaacatgatttggggagaaagggtacatttacatcccacctaaaactaacctcccataaatagtatataacattatataaattataagaatacaaattactccatacttgagaaagttactatcaataatttatattgacagattctaatgacataaaagttttaaatgtaaccagttaatcatcaacataattattctttaataactttacttttgaatttcttcagtggcttagaaaatgaaagcatacaatttttctaactgttgaaatatctttattcatttttgtttaaatttttgaaatgttctttcttaagttaaataaaaattatttagaaacactaataggtaaaatataaaggtatattaaaatgtgatcagcactttttatggcatttgtataatatttgataaaatttcagatggattgggaaggtttaaataatttatctaagttgtaaaagttatcatgcaataaatatactcagattcttatcagtgagtttttttgttttgcgtatatattttactctatgcagtttgtatcaaaggttaagattcatccatgaattaatgtatttatttattcattcatttattcatcattcaaaaatatttattgaacaactcttttagaccaagatctatgttaaatctggaattggaaacatgaatataacacaggccttgctcctgagactcacataatctactaagggagagacacagatacttgaccatgtgacagtacatacatagagaaatgtacgtattctctgtgaacaaaaagaaaatagaaactaattatgctcaggagaagtggggtaattatttcaatgagagggcagtatttgagcaggatcttgaaaaagaaaaaagataaatttccctagtgaacagagggcattccattcaagagggaacatgatctggttggcctagttgtgacatggagcctaaggaaaatgatgagaggcaaggaaggggagtcggggatgggcacaaagattctgaattctgtagacagtgggggactggagaagacttctaagcacaatcaataagaaaatgtgtgtgtgtctgttatatgtatttagaaagatatctgtgtgtgtttgtatacacacatatccattaatgtatatatacagacatatacatatgtatgtatgtatttatatgtatttttgtatttaaaaatgtatgtatgtttaaaacttctatagcatggaaacacttttagaagaaatattgaattgttttagtagatactaaatgcctattacataacattcacgttaaaagtttgaaagaaacagaagatgatacggtgaaaatgaaaactaagccattcttctatctcaattttctagccacctacttgccttcctagaggcaatcactgttttcgggatttttgtgtttctttgaggtattgtatacaggtactagtatttgtgttctctgctttatagatgcagtgttcttaccttgctagataattccatatcagcaattaaggaacaactacgtttttaaaaaattaaagactttatttttttagagcagttttaggttcacagcaaaatttagaggtaggtactgagatttcctatatacctcctgcctctgcatgcacagccttcatcattatcagcatccccaccagagtgacacagttgttacacttgatgaagctacattgacacatcataatcatccaaagtccattgtttacactagagttcactctttgagttttaccttctgtgggtttgggcaaatgtgtaatgacatgtatttatcattatagtatcatacagagtatgttcaatgccctaaaaattctctgtactctgcctatgcgtccccacacccactcctgctcccaccaacccctggcaaacactgatctttttactgtctccataattttgccttttccagaatgtaatatagtttgaatcatacatttctatgattattgtgataatatgtagacttttcagactgtgaaatgtatattcacacagaaatatacatttaagtttcctccgtgtcttttttgtttgtttgtttttttgttgttgttgagatggagtctcactctgttgcccaggctggagtgcaatggtgcaatcttggctcactgcaacctccgcctcccacattcaagcaattctccctgctgcagcctcccaagtagctggattacaagtgcctgccaccacacccagctaagtttttttatttttagtagagacggggtttcgccatgttggccaggctggtctcaaactcctgacctcaggcaatccgcccgccttggcctcccaaatcgctgggattataggcatgagccaccatgcccagcctcctccatgtctttttatgtcctgatagctaatttcttttttagagctaaataatatcccattgtctggatatatcacagtttatttattcattcacctactgaagggagtcttggttgcttccaagttttgacaattatgaattatgctgctacaaacatccatgtgcagatttttgtatggatataagttttcagctcctttgggtaggtatcagggagcacaattgctggatcatatggtcagggtagcttagttttgtactgccaaactgccttccaaaatgactttaccattttgcattcccgtgagcaaagaatgagaattcctgttgttttatgtatttgccaggatttggtgttgtcagtgttttcgattttggtcagtttaagagatgtgaaatagtatctcattgctgttttactttgcatttctctgatctacagaacatcatctcatatgcttctttgccatgtgtgtatcatctttggtaaggtgtcagttaacagtctttcatccattgttattgttgagttttaagagttcttcatatgttttggataacatgcctttatcagacgtcttttgcacatattttctcccagtctgtaacttgtcttcttactctcttacattgtctttcacagagcataagtcttcaattttaatgaagtctagtttatcaataatttctttcatgaattaagcctttggtgttatatgtaaaaaattattacagtaccgcaggtcatctaggttttctcctatgttatcttctacaggttgtatcattttgcattttacatttaggtctacaattcattttgagttaatttttgtggagggtactacctcacttgtaatggctgtatagtgttccacagtactatattcaactagtcccccactgatgtatacaattagactttttccaatctttagctattgcaaacaatgcgacagtgaatattcttgtccagctctccttattaaccatcctttcccccccccggctcactaaagatcttatcatcatctaacatactatgtattttctttattgctttcattatcaaacttcactcctgtcacatattagcatgttagatccaaaaagcagagattttttttaatttgtttcctactgtaaccctagtcatagaataaatgtttaatgaatatttgttgattgaatgcctcttacacaagtatatctacaggaaaaaatcatagaagtcaaattgctggttcaaaagggataggcatttgtaattttgacagatattgccaaattgatcattatagaacagagcatttcaaccttgacactactgacattttggcctgataattctttactgtgtgaaggtatgtgctgtaggctgtttaacagatcctccagttgtgacaaccaaagatgtttccagacattactaaatgtcccttgttaagaagcactgattgttatgcaacctttgactctcactgacaattatgaaaatatctccccacagccttgccaatatcgtcttttaggaaacagttcactctgaatatctaatggtgaaaagtagtatctcatagttttaactggcatatgaattcacattttgatggaactttgctgtaacaaatccccagcactgtacattgtaatgatgaaggtaagtttggttttccactgtagagggaaggcgggggatagagtgaagatatgaaatccacaatcaagtgtagaaaaagtgctttttgctcttatttttcttcgttaaaatatctgttttataaatcctttcttatcttcagactattatgcattcatgggctgaatcttctctagaattatatcaactggccttgattaatgaacaaaatttggagtcaaaagccttggaatttgagtgcaggctctcctaattactagttgtgttaccttggggaagtcacataaactctgagctgcaatttactcatctgaaaattgtggataataacatttgctctctctacatcactgagttattgtaagaattattttttagactgcaaagcctttcacaattgcaagggtttatgataattattatgaaggttttatgacccgctgctttatctcatgactcacagtgtcccgagagtttttctcttctcagtgcttctgcgatcacctcaaactgttctcactcatttatttattaaacatgggcattgtgtagccttaccatatcttcaactctgtagcctaaataatttcagaacaattctcctcctaactgaacaagtcccagatagactcatcatttattcagcattcattaaataagtaccattgtcttccccaaaactgccttttcctcccaacagccccatttttgtcaatgccatcattttttctagtcttgagggtgggaactttgcagtcatctcttgtgcttgtgctccctgtcccatggatcctgcataccacaaccagattaaagtagactacctccttcttcaggtcccttcttgtgattataagctgagagtcccctgttgagtgccacatcaaatccaaattatatttcagtagcactccttgttacccatattctcctaaactactttttctttccttgcaccagactcattcttgcacctatgcttttgttcatcatgtttttctccctagaattttcttcacctgttcctttacctatcaaccagcaccaactttcaagacgtctatcatccctattactctatgttctctttttctttatagctcagcttactctaatctcttttatcacttcactctcattgttattggtcagtttaacttaatgtatcatagtggatctcaatcctgactgcatatcagaatcacctcagtaaagttttgtttgttgtcttaatataatcccaggatcatgattggggattctaattctagacagagctttgttattataattttagtagagtggtttgaacatcttcatggatattttaagcaggtcatttttctcttccagaccacagatttataaatttactggtagtaagaatgttaaagacatcaatatacccaatgctcaataattgattaactgatagtgtgatataaaaatatttcttattcatttcctgcacagcctataatttgtgtgctacctcttccagtttgtggctctgtgactttgtataaattgctgaatctcttaacctcatgtttctttgtatgtaaaatgagaatagtaacatatatgttgctaattatgagaagtagagctaatgtacataaattttcagagctacatggtggcttttttattactattaatactatatagtctctctgctgttgtagagatgcttaaaaaaccctttttctttcttgctttatgatttgctattttatgacttagtagatttacttatttacattactattggaattaagacaggatatcaaggccctatcaaatcaccatgtaatttgatacctaattacctttgatacctttgaaacctaattacattttcatattttaaggagcaaatgagtattctattttttgaccatcgttctactgactgttttcttggttacaagagaatatgcaccattacagtttttccttgtcagcagcaactccacgccgtgaacacgctaactttatgtatcttcttcactttacctgacattgccaagtaggtgtttcttcctcctaactgtaatttaaaagaggatatttatttttaacttagctcattttattttatttcatagtttataactatcccatttaattttaaaattaaaggaatataatactattctattaaatttagacttacagattgtgctcctgggatcagcaagaaaacataaagtactttgtttccacaaaagacacttcctatataaattatttttattattaagttctgtatctttaaatgagtcacttttaaatctttttcttgtcttactagtgaaaaaatttaaattgtattattaaaggaaaacatatagacatatgaatgagaaagtattcattaataacttgtcttcattaagttagatgaaaacaataaaaaaggaattaaccaaagtggcacattgccaatcataagacaggagaaagtttccagagcaattaaaggaaagaaattatttgttcaaccatggacatttatactgttttttcagtttcaaagttgtaaaagtaatgtatggaggctatcttctcctgcaccaaaacaagaaaccgtataggtttctttggaatgcctattaatcatgcattgctcccataaattagtcaaagctaaagaaaaagtgttgctaaatagtgcacattttcatttccctgaatatttgtagctgcaatttatacagataccaacaacactgtgggctcagaattaaaatgaaagtgcttgaaaacttgtgtgaattacctttcttacagtatatttatggagccaaacagacatatgtttgattctcatttcatccgtaacatgaatatattgatacttactttataaaattattgaaaggattacatgcatttaccatggtgcctggcacatagcgctcagtacattgtagtaacgggctatgctgttttgagaagattgtgtggagagaggatatcactgactttggagttattcatgcctggttttatattccagatctatcatctgataactggctgatttcggccaaattactactctgaatttagtttccttgacaataagctaaagtgaaataacagcaacctcatagggtggttctgaggatttaataagatcatacatataaagggcttccaatgcctgttacatatcatatctttcagtaagtagtagatcttattactcttattcttactgctaaaatctgtgtcttaggttcttgacttctttgtaaatatgcctttgaacaatgtggaagggtcaaacaactattaccccaggagtatattgactttgaagctaatgcagcttaagcctaagggcctctcatttgcacaagtcccttccaaactgacacttaatactcttcttaattttatattctctttcttaaagaagacctccgaagctccaaaaatttcaggtttcagaaaacctgggtctaggttatactattacctgaagggttttttttttaaaactaaaaaaaacaagagaaagtttataaggaagcacaataatgtatgctatctaatgaatatattgatagcaatatttatattaaattgctattttaagcctaaatcctataagttctattttgtgcattcagcttcaaaatgattctactggtaataaaaatggcatactaagcaatgaaaataagagataacttgagtacagcaataaaactcaaaggaaatgtaatcagtgatacagaattatgtaattttgtatactcaatattttctaagctacttttcagaagaaaaagaatagttttaaccaatcagtgagaaaggtaactgattaagcttattcaaaataaatatctgtcttcctcaaggcaggctgtgtcaaaagcatattgaggcatagatcttccaacaaattataaattaaatgtccattactcacacatgcaaaaattgaagttgagaaaattacataactgaagtcaataaaacaaactctggtattatataaatacactgtaatccacagaagatatattcatgtttaaaatggttagcttcaaatttttgagaaaaaaatacttcaaggtctttctggtaacatcagttggtaagttagaataaaaccttaataaaaccagtaaaaagactttgtaatttgcattgctcatctcattctttaaaagaatttattgatagattttctcattatacctacatgttcagtataaaatatgaaaaatatccaaaacgtttttaagtcaggtgcttttaaaatatgtggcttccccttgaaaagtatatatctactcaaaatatataaagtatattaaaatttgttcatcttaaaacaaaattgcaattttatgagacaatattaacttttgaggacgtcaaatgtagaaattgaagctcacagttaataacagaaaggatttgctaccatttatcaaataccttaccctggtattatgataagaaacatcattcccattttacagacaaagaaatatcagagcaaccagggttaaatgactttaccaaagttattattacaaccaggactagaattcataggattcttacttttttttttttttttttgagacagagtctcactctttcgcccaggccggactgcagtggcactatctcggctcactgcaagctccgcctcctgggttcacgccattcttctgcctcagcctcccaagtagctgggactacaggcgcccgccaccacacctggctaattttttgtatttttagtagaaacggggtttcaccgtgttagccaggatggtctcaatctcctgacctcgtgatccgcccgcctaggcctcccaaagtgctgggattacaggcgtgagccaccgcgcccggccagaattcttacttcttatctgcctcttaatcttgttaggtcaaaatctctcagcatttttagaaaatgccttttttattatattttcagcagatcatgagtctaatataccagcgttacccttttctatgctttccttccttgagaacgctttcaggagagaaatcagttatagttttctgtctcttccaaatagttaaaaacataagagatcatagatgtagtaaatcagtttagaatcccaatgccttgattgggatgcttaattttactataatagcctaatctgaaatgttatctgaaaggcttatttcttcacattcttttctacaccacaaaaattgttcataacaagaacaatcttgggggaaaaataagatgagatgttttagacagcttaatggggctgccactgtcttggataaccactgtttagagctgtcttggattagctgaaggctagtgttgactgaacatattgaacaccatcttaagttgtactttaagtcaggatagacagtccttacaagaaatgaaagctgctcctttgaccattataggtgttctgtggctagagatgaagtgccacactaacagaacaaagcttgcaatttgtggaattgaattccaaggtgaaaaagaaggttaacaatttgtgtaaaatcctctctcaagaacagaaattccaaaagtattgattacaatattcacaatggcatttcacactgtggctggtgcttttaaataggagtcagagaaaatatcatgttgcttaatatttaggcaactaattacaaaattctcgattaccaagtctcactgaagtgttcccttacgaaaacgtgaactttattaggtatcaactcattgacatggtccatttgaagaagcaatttattagtctaatggttaacacctgttagatgaagctcaaaaatgaaaaagattttaatgaaaagcaaatgcagtaaatgctagcttttaactggtttcataaaagattgaatatatattcaatattctgtatatatatatatactgtataaatatacaaaatatatactctgtctgtgtgtgtgtgtgtgtgtgtgtgtgtgtgtgtgtattacacaaactctccttttccctggacaatttaagtacattttccctgtaagctaaaagccataagtatccctacagatattttttgcaagtgaaattgcttttcatttggcaaaaactaaacctgtgattcatagcagcttagagcactcaaggccaaagagtacatcttgcttgctttgactgacatttttgcaggctaaatcagacctgcatgattcagctgtactgagattcataatgctgtgagcagagaaatttgggggtggtataaaagagcatggagggaaattgtcttggaaattgtgactactgactgaggcaaaaatcaaccacagccaataggcggtttcaattgatatttgattggggaggcgttttcttgctaccctctttatacaaagaacattagagaaattttagtgaagaaaactactacggaagcagaaaaagagggactttactatgagaaatgaaactgcaatagggagcaagagcagggagaatgactctttttaacagttgtcagctcaaatattaaagggaagtgcacattgtatataaaaggaaaagtggcaaaaaatccattcccaaaaaatttctcctaaatgtctaccattagcaattcattcctttcagatttcttcattgagttcattcctcagttgcccttaaaattcatatgcccagaggagtaaaaatcttcctacatgaagttatttcctatctggactacaaagggagcacaagaaaattgctttgggaagttcaggcctcaggaaaatacggtgtttaaaaaagattactatatagcttatgctaaccaacacctcatttttgcttaatatttattttattctgtctcactagtaatatataagatatagcccagtcataatggatcttattcaggtatggctacgtaatctatggtacaaaatgtaagtatgagccacttattaaacaaattattaagaatttcagcagagcattcagccaagcttagagcccttctaagactggggacccctgcacctgcacagatcacatgctcatgaaatcagccctcattttatttgatggtagtgaactgtgtgaattccaaacttagttaatgaaagtgtttcgttacagattacctaaatattttggcttgtaaatgctcaacacaaatattaataccaaaaattcaaacccaaattctttttgggttaattggaggctttgcaaatcactaaatttaactatttgttcctatctccctccctttttgtgtgatcttctatgggaaagtataggatttatgaggttacacattatcatttcagatttggacctctcccttaaacctgaggttcaagagcctaatcttcactctctattcctaacttatgaatcatctagctgaaaatagccaaagactgctctctaatagccaccccaaaccagcactcatcctagaataaccaataatttccccagccccaggtgtggagttaggatgagtgtggataatacctggttgtgccaaacactaaaagtagattcactttgggaggccgaggcgggcagatcacctgaggtcaggagtttgagaccagcctggccaatgtggcgaaaccccgtctctactaaaagtacaaaaattagccaggcatgatggcaggcacctgtaatcccagctactcaagaggctgaggcagaagaagcttaacccaggccacggaagttgcggtgagccgagatcacaccactgcactccagcctgggcgacaagagcaagactccatctcaaaaaaaaaaaaaaaaaaaaaaaaaaaaattagattagtgaaagctaggggtggctttgggcaaggtgctctgagggcccagataatagggaaattaagcctataagagtcttgatcacctaagctataaaaaacacttctgggtagaagaagtttttacattccaattcaaacttgagtatgctgctgtttaagccaatatttatttcctcttagcatatgtttcaactttagtaccgtccaacaataagatacgtattctctattaaaatctccctcttcatcttttgttgacacagcactataattagtatcacataattcctaccactgacagaatgccccagaatattttgtcttatttttttttcaagattagctagcacttataacacttcttgctaacgtttcactcagttatagttggagttagtgaagtcatggtttgtttttttttttatgtaaagctgtcttttcttcttctcacccccatcccacaggcatcaaaggaagttaaataaaagaatgactattgtgacgttgactaatagtcataagacattagctaagaaatgaataccattgaggttttgaatgatcagctgttaatttttaagattatactttagaaaataataaatcctgcttttgatgagatgtccattaaaaaacttattttaaaagtaatatattttgagtaactacattctgtccaatgcaactctaactgcatacttctgaaatgtttacccccgaatgatcccttctaaaacatatagctttagcttgtcagtttactggcattgaatttcaatacttaagttaaaatatattgaatcagctttgcaatacttggctggatcttttagaatagtattattctttcatcttacttatagaaaacacctaagtaaaatagtattcatttttaaacttcaatttattgtatacagagctttctttcttaatagattgacttcaagaaacattttttcttcaatcagaaaatattgacttattcttctgaattgaatctgtataagatttaaaccttccagttattacccaatataacaaaattaacatgaaaccaaagctctcgagcaaaagttataatatttgaacttaaaaagacaaatatcctatatggacttcaaaatatataataaatcttaaggagtcagtgcaataatttttttaaagcacaattttatttaaggtacaataagggtttaagaaggagaaaatgggccaagcacgatggctcatgcctgtaatcccagcactttgggaggccaaggcaggctgatcacaaggttaggagttcaagaccagcctggccaacatggtgaaaccccgactctactaaaaaaaatacaaaaattagccgggcatggtggcatgcacctgtaatcccagctactcaggaggctgaggcaggagaattgctttaacccgggaggcggaggttgcagtgagccgagatcgcaccattgcactccaacctgggcaatgagagtgaaactccattctcaaaaaaaaaaaaaaaaaaggagaaaatgaatttacagaaaagtcgaatattcttttattaaagcagctctgttatacaagaggtaacactgttataggctgtctgctttcttgatgacatagccaattagtttgtaatctaggcagttatcaaggttaatcacaaatggaagacaatacatatttaaaataaatgagatagttcaggaataagtggtatattatctagcgagtaaattcagtaccaaaatcagtctctaggatcttactccaaagtagaccttggcctccaattatataaagcgtatgttaatctggacatggagtatctgtagctaaatagtatatgccactaccaagtaccatttggcctccctagaagaatgtgacctgatgaagaataaagaatatttcataataatgtacagttgctagataatcttacctcttttggtagattaaagatggcttcaaattctttgacacttcttctgttaagaggtggggtctaggtctcttcctcttgaatctgggtgggatctgactgtctgactaacagaatgtggtggcagtgaagtttgtcagttttggggtccaggcttgaagacaatggcagattcccctcctgtctctcgtaatattcattcttgaaacgaagctagaggctcgtacatcttaatgtttgaagagacctgtgtgcaaaggaaccagtgtccctgctgacagcccttgatgagctgacagctgacagccagcaccacctttcttggcctatgaatgtgttatcttggcaaagatcttgagagatgagccacatctccaagccctacccaaattagattcagttgtattgggaattctgggattggttactgccatttgcagcagggttagcatcttaagagtgcaggagaagggccaggcgcggcggctcacacctgtaatcccagcactttgggaggctgaggcaggcagatcacttgaggccaggagttcttctcagtacagataagcataaacattaattgtaatacatactgaaggttttaaggatgaaatgtactgatgtctctaactttgaaatgtctcaaaagaaaaggtggattaataaaggaacaaactgatagatctgtgatgaggttgtgataaagcaaatgtagcaaaatattaagaattgtagaattgaggtgataggcatatggtggttaatatacaattttacttttttgcatgcttgaacatttcttttatgaaatgttgggaaaaacaaagatgtgaggtgtttgacacctagtaaacattcaaaaagtacaaggattttaaaattgttactagttttatatttactagtaactgaataaaataaagtatttatatagcttcatttccttgaaaaattcttctaaaatattaatttcagtataacttgatatactaaaatatcaagttattgatattttaccaattttgactttgttatatcaagaaatgtaaagtcttgctaagcaaatagtatatttcctgtaatagatcttgaaattcagtaataatcctgtagcactaagaaaaattaattgacccaaattccatggtatttgatgtattttaagataagttttactaaatttaaatttaactctagtttaacacaagaaagaagaaatccagcatacaattctaactgaatatactgttttcaaataaacagttcatttaacaaaaactggccctgtgctagatgctgtgggacagaaaattgagctgcttaacacaaggccctcacccacaaaaggctttcagtgtggttaggaagaaatatgcaacccttggggaaaaaaggaacaatgcgtgagttaaaaatataaaacatgtaacaaagaagtaaatgattaagaatcaagtgaataatatagataatatgagctgagagttcagaagatgaaaaaaatcattatagccttgaagtgaaaattttgggagtttcactgcctatttaagccctttggaacatgaaagaaacttattgcgaacttgtggttttggtagaagacaaaacacaattgaataaagagtaatgttcaggggccggactttctttgagaattatggagaggagggaagaataaaaacagaacttttagccgcaatcagctagaaattgtagctgaatattacaacctctcttcctttcaagagatgcttatttattgtctggttcatataaagcattaggataggtgctgagggttactatgaatgaaatttggccctaacttcaagaggtttaagagtaacaataacaagagctatctactagatgacaagagtatgccaggctagtcgaagcttatggcctattagaagaggtaaggaaaaaaaactgtaatatagaaagtataaaatgtcaaatgccatttaaaaagaccagataaaatgctaagtgaattcagtgaagagttttcttatagttgtataaaggaggataagtatttatgcaggaggtaacactgagttggtctttaaagagcaataagtagattgtgaacagagatatggtgaaagagtaaagaaagggataagaatgatccaatgaacgaactaaatcatatgcatgacatcgaatatgtgattctttccagctacagtgcagactatggagagaaggatgattgaaagggaaattgggccagaccgcctaggccttgaataccatgctgagtgtcttgggctttattctgttggcaacaggaagacattaaagaattatgacctgaggaatgaaaagttgagagctttttggtttttattgtttggtgttagtctggtagcttgtgtaggaggaattggaggaagaaaaatctagaggcaaaatgaccacaaggcaatgaggacgtgaaccaaggacactgaaggagctatttcagaggataaagggatataaccttgcaaccaattcagtatcaagagcaacaggacagcagagtataccaaagtggggttcagtaagttattgacattgtttagaattgccaatacatgataataataaaaagccgactagtttttagttatattattgttcttaaattccctagaaacagtattccttttgctgcctgcacccagggcagattgctcccaatgtcccccacctggtaggccattgcatggaagcagaagcacttaaagaagcttcagaaattcaagcttagcacctgggagtttgatggtgcttctaatagaaatggaaatcaggaagataaaagcagatttgggaatgagttcagttttatacatgttaaatgtgagttgtggttggctggccaattgataatgcccaacattctcaatgtgatagtggatgtaactcagctgagaagttaggacagtgctctaggtcagcgagtcatctgttaagaggtggcaattaaagctagcggaatgcctctaggtctgagggagttaatatttataattgagcatctacaatgtcactcacatatctggtctctaaagctagtggatcttaagccaaacaatactcaatgtgcacaatcaagggcacctaccagaaatttccatcttgaatttcattccttttggctcctgccaaaagtacagctgagataattggcacttgaaagctaaatattaggaggactgtgcatatatccttttttattttttctaaattctatcactacaacttaattatttgtgcctaaataactataaatatcagaaaatagattacactgaatagattagaacttagcttttacaggaaatactctcaatgatttagaaggtaatgttctgccttagccttcctctagggttggtacaaaacatatagaaaatgccaatgtagtctataaaactagtatgaaacatattgtcttatacacacatgatatgtcctggaaaaatggttctttgagaggggcaaagcaagatggccattgatcatccctactgcaggaacaccaaatttcacaactttctacacacaagaaaagcaccttcataagtaccagaaatcaggtgagcaatcacactttctggttttaacttcatattgctgaaagaggcactgaagagagtaggaaatactgtcttaaattgccactgccactcctccttcatcccccagtagcagccacatgcacggagagagaatctgtttgatggggagagggagagcacagtgattgtgggacattgcattgaactcagtgctgctctgccacaggatacagcaaaaccaggctgaactcagccagcacgcacagagggagcatttagaccagccctaggcagaggggaatcacctgttccagtggtcagaaattgagtattagcaagcctcaacaccacaggctaaagtgctctggggttctaaataaacttgaaacacagtctaggccgtgaggacggcaactcctaggcaagtcctagtgctgtactgggccagtagaccttggtagggggcacaggacctagtgagacactagtcggggctgctaaggaagtgcttgtgccacccctccccaaaccccaggctgaagagctcatggcaacaaaagtgactcctttctgtttgaggagaggagagggaagagtaaagaggactttgtcttgcaacctggataccagctcagcaacagtaggatagggcactggtcagagtcatgaggccccctttccaggccctagctcctggatgacatttctagttatatcctgggccagaagggaatctgctggccttgaaaggaaggatccaggccaggcaagattcatcacctgctgactaaagcgtctttgggcccttaaaaaccagcagtgatgctgtgggctttgggtagaatgctataggctttgagtgagactcagatgtactggtttcaggtgagacccagcacattcccagctgtggcggctacagtgagagacttctgcttcagcaaagtggagggagaccagaagaaggaatatatatggaagttctcatatacatctatatatgtgaactccaaatcaatttttaaaaggcacagtcaacttgatagagaaattagcaaaatacttgaggagacacttcacaagaggatctgcaaatgtccaacaagcatatataaaggtgctcgacttcatttagtcatcagagaaaaacaaattgaaaccacaatgcaatgccattacatatccacaagaaaggctaaaattaaagacaagcatcaccaaatccaagcaaagatgtgaagcacccataaatctcacacattactttcgggaatatccattgctacaaccatttggaaaaacaatttggtcctatattctaaagctaaacatatacatactgtatgaccagcaattctcctagatataagcctaacagaaatgagtacaagtgcttaccaaaaaaaacatgtacaagatgatttatggcagcgctctgtatacagtcaaaagtcaatcaagattaagataaatacattttagtatagtcacataatggaatactgaagtgaacaaatcacaactacatgcaaccatatgggtgaatcccacaaacataatgttgaacaaaagaagccagacactaaaagagtatcctacttatatcaagttcagtaacaggaaagactcatctatgatagtacaagccagcatagttgttacccttgggaatgtggaggaagtgcctggaagagggaataaggcaagtttctgagatgatgaaaatcttttatttttctcctttaatatgggtgatggttacataggcctgttcccttcataaaaattcacaaagctatatatttaatatttttatagttttctgtataagctatatttcaataacaacccatccatttaaagaaaagtaatctttctccacgggctgaaatcggccagattgggtaattatggtcagctgttatatagtagcaactcttacccacaatgttttttattctgttgcctttttgccctgaatgataattcctgtcgctccatggatatatttagataatttaggatatttgttccaaatgatgattcatgaacccaagaaaggattaaagaaagagttaatatcactatgcttttgaaaatggaaagactgcaaatgtctcagtttaagtgtctttacgctattctaactcagataaagtggtatgtaaggaggccatatgccacagagcccagatgttcttgaaccagtaaacattcttcaatctgaatcaggtaagatctttagcttttcttaactgcttcaaaccttaaccacctcaactttacagtttatttaaccaagctccttagaaactaacagcaggcacagcaaaatctgtttttaaaggaataaacagggcaaaatgaaattgaacctttacattaaattaacattattttatccctaatgttgattgttgtttctgttaaataattatgatgaaaagaaaaagtgttgatgcaatcacaacttgacattttgttgttaagcctcctcattttgttaaacctcctcacatcatctaattgattattaggtggctgatttcattcacctggctatagtaggccacctgtaaagcaactgtgcctatcctacagcatgactcttcagtgctctgaaaagagaaaagggctgagaagttgaaactgggagtctgtcatgttcttgattctattggtcattctgttggatcttttagaaaatcattttacctctctgaccttcagattttcaatctgtaacttaataatagcccttggcagtgaaatgtcttgaatggtgacttttaacatagcagcagtcataaaaatataagagtataactatataaaagggtttctaggagcttactcttggggcaaattgttttgccacataatattttttaaacggacaggacagttatgaaagattctagagagtgttgtcatgttaactgatcaaatatatttgttaggagcatttttattaatcagtacacatgacttagcctgttttaaacaatgtcttcaaatcttaaatatttcatttaaggatattaaaagtgcttagtgatctggttggtattattcagcatggattaatttttttctaaaagcagacaatgtatataatttattgtggacatctaaagtctaatggcactgcagaggtgatggtgaattgttaacccttctcaatagtttatgaacaggatgaaaaactagaggctatggattcatatttgtctatatgatgccacacacacacacacacacacacacacacatttaagtgtgtattaagggcaggtagtaaagagaccaaaaaatgcttttaatgttctaaattagactgataaaaatccgtagacatatgggcctctgtcatgatcaaataaaaagagttcagatttggagatggaagtagaggttcaagtcccttagacttactagctaaataactgtgaacatatcatttaacctccattcacctcagcaggttcattttgaaaaatagaacaataatgcttaagagcttactgtgactattaagtatgataataaatgttaaaatacgtataaattgcaaagtacctacacatttaagatattattgagataacctttgagttttcacattcaaatataatgtcatttaagctcatagaatagttactctttgattcttgtaagtgaattacaggagatcagcaggaattatttagctcagatagtaatgagaaagaattataaagtgattcggggccgggcgcggtggctcacacctgtaatcccagcactttgggaggccgagacgggcagatcatgaggtcaagagattgagaccatcctggccaacacagtgtaaccccgtctctactaaaagtacaaaaattagccaggcgtggtggcgggcgcctgttgtcccagctacttgggaggctgaggcaggagaatcacttgaacctgggaggctgaggttgcagtgagtggagattgtgccactgccctccagcctggtgacagagcgagactccatcccaaaaacaacaacaacaacaacaaaaatgattcggagtcagaactgtgttgaagacctagctttatctcttatttgttttgtgaactaaaacaagagattaaattctctgaatgtcagttttcttttctgtaaaattggaatgatatgccttatagagtgttgtaaaacttcaatgagactctgtaatcgctacacacagggcttattggctcttaggattaagatttattttgtatgccagacatagtcctagatgctgtggatacataggaaaagacgtgagtcttgccttcaaatccataaacgattgtgggggtaatcacatattaagacataatgtcaataaaacatgataattcccatgatataggtatgcccaaggttcatggagtagtagtagaatccgaaaagattttcacaggagctggtcctaaaccgagggttgacaaatgagttagatgtgtgtcagttgcaaggcagattctgtattagttttctagaactgccgtaacagattgtcataaacttggtgactttaaacaataaaaatgtattctctctcagtcctggaagccaaaatcaagatgtcaacagggttggtttcttttggaggctctgagggagaaaccatcccatgcctctctcttagctgttggtggttgctgggcatccttggtgttccctagcttatagttacatcactgcagtttctgcctcagtcctcacatgaccttcttccctgtatgttttcacatggccttcttataaagatagcagtcattgggttagacccaccctaatccaatacgacctcattttaactaattatatttgtaaaggacctctttccaagtaaggtcacattttgggtggacatgaattttggagggacactattcaacccagtacagggactctctggttcccccaaattaagttctatttcatgtgcaaaatacatttgccccatttcaacatcctccgaagtctcttaacccattccagcattaaatctaaatccaaattctcatctaaaaattcaaaaagtcccaaatctcatcatctaaaccaggtataggtaagactgtgagtatgatctatcctggggcaaaacccctctccatcggtggatatgtgaaactagtaaacaaattatctgctttcaaaatacaatgatgacagaggcataggtttagacattctcattccaaaagggagcaaatgaaaggaataaagggatcactggttccaagcaaatctgaaatcaagcagagaaagttccattaggtttcaaggcttgggaataatcctctcatgatattctatcttgtgggcctttgttggggcatccccaccctctatggcctcttcatccgtggctccacccttagagtcattcctcctccattttctctcatctgtgtccctttcagtccaagcctagcagtgcttgttggtataaaattctcaaaaactgtgttgattgctcatgcaattcatgggagtctgtgccattatgcaagaaggccctccacagatcttttctagataatctcttgtctattgctggcttctgctgagattggttattagatctgttaaccacacacctaatctattcaatgaaatgtccagctacaacctttgtgttctctccagagcatgttttctcatcttttgctatccaaatagactgagaatttcccaaatcataaagtgctggtttgtttttgcttaacagtttttgcctcaatttatctcttccctctcgcattttaccataagcagtaagaagaaagcaggccacacttctcatactttgctttgaaatctccttagctaagtatccagattcatcctttacatgtttcaccttccacacaacacaattgagttgaacacaactcatttctttataacaagcactgacttgcctccagtttccgataatatgttcttcattttcatatgagacctcatcagaggcaccgctaatgttcttatttctagaaacattctgttcatgacaatttatatattctttaagctgatagaagctttctctacagcttccctcattcctttttgaaccctcaccaaaatcacctttaacatttatatttctactaatattctttttaagtcatcaaggcttttcctatcatatgcttcataattctagcctccacccattacccaattccaaattccaaagccatttgcagactttttttttaggtattattaccccttacttggtatcaaaatgtgtgtcagtttcctagggccaccataaccaattaccacagactaggtggcttataccaacagaagtgtatggtttcacagttctggaggccagaagtctgaaatcaaggtgttggccatgcttccttggaaggttctaggaagaatcattgcctctttctacgttcgggtggttcctggcaagcctaggattctttggcttgtaattgtatcactcccatctctgccttcgtcatcacatgcacttcctcttccttcttatgtgtcttcatatggccttcttagaaggatacaagtcattggatttaaggctcatcctaacacaattgaacctcatcttaattaattatatctgcaaagactctatttccaagtgaggtcacattctgagattctggatggacaagaattttaaaggggacactattcaacccagtatgtgttcttacagacctctaattcttcctcatcttctcttttaggtgacaagacactaatattaagttgctatggtgatagtttatttatttgacctactatctgcattctatttcttttcaaaatgtgtttcttatatgttaaacctttattatgtcagactgtggcaacacctagagaaatctaaacattatgtttttgccaagatgaggtcagaaacagtaaaacattgtttttaagttattggattaatatgtctgcctgctactaactgtggttaaataataatctttgtttttattcatagttaattacatgctcaagttgaaaatatcaaaggttctttatctgattctgtgaattgatatttaatacatggtctgccatggttacctagcctgggatttgttactttaacacatcaatcaatggcaaagtcaatgtgtaagctgctagtgatttgggaagcatctttgtattcaatagtcttgtaccttgtttgtgattgaaggtcattctttaagaaaagaatgatatctaagactgtaaattcattgtactttctaagctcttgagagtagagatttgcaacatcaatatatagccaggctttacccattcgggccactaagactgatactcatagttttaattattttcacttgatgaagctaattccaggaatactattctttactttcttggctcttagaagatatgtctattttatcatttggaaacttaggaaacaatatccttttggtttttgtgcaggcttttttctcatcatatacttgcaatattttacttatcttaccttcatagtaatccacatactagggatattatatttagaagcttcatgtcccactacttattaactatactggagtgttatttcttgaggtttattttgaaaatatgatccaagctcctatttcatgtgggtttgttgttggctaaaaaaaaatcctcttcagcaccccatttcccccaaaagatatcatgtcctaatctctgggacctgtgaatgttaccttacttggtaaaaggacctttgcacatgtgattaggttaaagaccttgagatgggagattacactggattattgggatagaccctcaatgcaatcaccagtgtccttatgaggaagagataggggaagatttgaaaacagacagaaaagaaaaaggcaatatgatagtagatgcagagatttgagccgtttaaacacaaactgatttctaatccctggcctccacaattgtgagaaaatccatttctgttgttttaagccaccaaatttgtgtaatctgttacagcagcctcaggaaaataatacaggtacgtaacattttcccttggaaaatatgagatacaccatactcctaacaaaaatgtaattggctgctggatttatatatagtagttatgtttctcagtagttctatgcagaaaatgcatcctctgagttgatactgggtttcgagtaacattcctccactttgtccttaactgaaatacttaacctgtcaaattaattctgaacttccccatagaatagatttttaaattgggagactatttcagtgatgtcttttataaagaggcacatcttttcctacctaaatagtgtatttcagatttgccccctctgtaaacattcatatttctttataaagcctcaacttctgttcagttttcatttcacattataaattacagattaaaccaaagcttccctcctttatgggtgcaaaattgatggtataagtaactgttctctcaaatggctaattatatttctagttgcctacttgaaggtctaattagccaattgcatatgcttttgtgggggcaaggagataattggcatcctcaagcaggtaattagaaaagcaattattagtgcccacggctaattacaagaatgaaaattgtccccaccaaaatggtaccagtgtctactgggcagaaaaccagtccctggaaagtgacaggaaacttaatccatttggcagtgttagaatggcaggcagtaaaacaaatcatcaactagacctacataatctataagcaacctcctgtgagagggctgtcagaagcctttctaactgtggcaaagggctgcagttggggcagttgccctattgccaataataacctgcacatgaacttgtatccctgtcaggagcactgtgatcttcaaagttctttcattcctagaaataacgtattatgaaatccattctcgagtggcgattttttatgatgttgtgttatcacacacgttataaaataaaggattctgtggggaaagccacttgtgtttagttgcttttcaactgcatctgaccagttctttaagtaacagaacttcagttaaatgtttcagtgaattcgtcttttgcagaaagcttcctgtggttagcaggttttggtgttgaagtccctgcaggttttatgcccaattaagcctctgattgggctctttgttctttattacccaagtatttatcccatgtaaatgagaaagggtagaaataggcaaatttgttttatctgacagcaagtcaacaatttagctctcaagtaacaagaaaataaaacttgttgagaaagttggtactgtatctgaaaaatttaagtctgctgtcaagaaaaatgaaaaagcctgaatcgctgcatctcctgacacatttcaaaatggggatacatagcacaaattatagtgtgcttgatggtgctgttgataatagcaccctgcgctcctcccagggcaccgagcactactgctgaaagggctcaactgcgggggttgtgcgcagatagttgcctgggagagctaaggactgttaggtcagagtttccaagaatagagaaaatacgccagaagaattaatgatttaactgggaaaatgcctttgtcattttttcctattttaaaatttctttgccctactctgtattttcccatcattcctcctgcctagtcttagtcatttactttaatcaggaccccctgcttcctacgccagggcaaaatgtctagaactatgggaaaattttgcctcgaagtaaaagtcaaaacaaatgcaaatctgctattagagttgagcagtttaaatgctccagtacaattgaggattaaattctggaaaagggtatccaacataaatacacaaccaagaggttattttttttaattagccatgattgaaggatagtgaagaagaagattaaaggcattaattatagaagagacaaagaataagcagacttttcttaaaatgtagtataaaacagttttgttagccagagaataaagatatttgtattccattaaatattctatgcttttatttttttcagacacattttcttgtacatttgtgtatttcatgtgtttcccaaatcaattttgagatcatagaatgcatggtctgtcattgtctctccagagcaggacaatctgacaagtggtcacccagcctctacccagtggtggcccccaaagcagccttgttagtttaaaaagaaaaaaaaaaaaaaactcttattatttgaaagagccttctttccttgaattgacttgcttattctaacttccacccacagtttctgttccccagaactgccacagggaggttctgaccctgaataaatggcaacctctcagatatcaaaaggctcacgtactaaatctttcctccaaatccccaaggcctctacggcctttctgttacgattgaattttagctgatttaatatctgttcctaaacagtgaccaaacaataattcagttaagcttatatccaaccagaggatcattatgtaaatttgagtgagggtagagagagtgaaggaaaatgaaatattctgcctcatttacctttagaaacttgtaacttgacttaaaaaaaaaaaaaaacttttaaactgaatatattggtgtcagagagatctagaccagtatgtttttaaaaattccatgcctaaggtaatatttcatctgcttttctagctttattctcttttttctatcttctactacttttttaataagcttaaagtagaaagaattaaaaggcacctattttctttactcagtttcttacacatacttcaagcttcacatagatgttcgttagcattaaaaatgttcgggggtttttaaatgaacacattttctcttactctgccatctgccaaaccagtgcagttcctatatgatttatgtgagataacccagaagagtcagagacataaataaaaactaaaaatccatcagtggtaattagaatctgtctaatgacaatggtgatgtttggaagaatatattatacatgttcctgtctcaggactttttaatatccttctcttttttgctgaaaatcttttctcccccaggtccacatagcttacttccttacctgcttcaagtctttactcaaatgtcaccttttcagtgaggccttgcagagccagaccctataaaattgtgcttcccccttcctcatgccaacatacttctaaccaccaacatttcctgccttatttttctccataacatccatcataatcttacctatgctttttctcattattatttgtgaaatatatcatgtgtacaggagagtgtacaaaatacatatgcacagtttagaacaaacacctgggtaagcaaacacctgtctaatcaccacccaggttaagaaataagaagctccctgggtgttcggaaaggtaaccactgtttcaacttttatgatagtcattcccatatgttttcttattattttatcaattatgtatatttgtgaataataatacagactttagtcatttattctagttaaaacaacagactaagatatctggcactctttgtatatagatgagttcctagacctattccagaatactccaaaacttattctcagcccaagcaacttgactcttccttcaccagctctcttaactctgtctatttcacccccaaccttccatctctttccaacctttcttccctagtttggcataccactactagatgtttagattcttctccaattctcttaacaggacagtcttcacttttgatatgagtcagaatcaactgaccaaggtaatcaaattttaatgaaaataggtaatttctttcattcctgaaacaaatttaaatagttatagagtttctgctatttgttacctattctagtaacagaaaacctcatgcttatctggacagccaaactttttgttctctggtacaatcctcagagtgactttgctttgcttacagttatcccatgtacaatttccatttagatttattccaaagatttcagcaagcatactgcttcacagatgatctcactttgttttgataatgtgctcaatcatttcatatacaatcaaaatgagtaatcagaggttatgcaaatgaaactttatcatcattgggactgctgcctatttgcaagtatccttcatcctcatctagttgaagttagctattattctattctacagaattttcagtggaacaatgtccacctttcttttgtacgctacagagtccagagaactgtactcattttctttttatgttgttagaactagatgtatcattcagctataatctgagttctacaatagctgtaatcactgtgtcactggcccctgaaatgaattcttagattgggcaatcactacactatcaacatatattgggtgtagcatctaaatcttctgttgagaatattgccgttttacttatctaaaacagtatgcagtaagtgtagcagtatatatctaaattaacttcttttgtagcattttatcagtgttctgccttttctctacattggctgcattttaccagaaacaaaagttgtggagcagtaaattatccatagatagtctagaagctcttttgataaaggatattcaaaatgttatatgaaaaaaatataagtttttctttagttttttcatttattagcttcagcatttttcatttatttcttcattcaaagaacaggtttttaactgatagctaaaattattatatcctctgctcaatacggttaagttcaaataggcaaaaatatacacagaactctacttctaaaaatataactgaaatatctattttcagtttgaaaaaaaaatcattctttctagagggtacctagcttcagtggcagactgatccagttctttgagagacatgttattgccagatatttagaataagtagtatttggaagaatacaaatatacaaatgattttttccatataagtagtaaaactttaaggagatgctttaaagaagaggcttaaacattttttcatcactaccacaaaataataatttcaccatttttaagggttcggcactgaactgattatgaaaagaaagtcttgttgcaagacttcaatgaaaataaaatatagtatttttaataattgtatggttagtcattatctgtgccctactgatttttggtcataaggttatatttgaagaaatgtcttcttttatatattcaacttcaactcaatcatgtaataaacttatctggcatgtgaagaattttatgtagtctctcatcatagaaaatgatggtaggttgcccatctggcaaaggttgtaagttcagatatgctgatgattattatctgtgttaaagcagcctcaacactttccaaaatatattcatataatagtagctcattatctatattaaaccacaataaagttaatattaataccatggattttataaaataactttgaacgaagctgaaagcttcatttagtttaataataacgatgcttgaggaccactttggttttaataaaaacatggaaagtagcagatgagaaagaaccataaagatgccagtcgaatagctgtaataccaattagttggcaattgattcattcatcaaatatttattgactacccactatatttatgtaccatcacaccttggaccaatagaaactgaattaagttttaaaactacgatgaataagggtgcaaatgaggaatgactgattgataatcccaatgagtgtgggatttttctttgtggtgggtgatgaaaatgttctataattacatgacaacaatggttgcacaattctgtgattatactaaaaatcaatgaactatgtgcatccactctaaacatgttgattttatggtatgtgaattaaatctcagtacagctacttagaaaaacaaagctttattgatggaagacaacaatgtcataatgatattgatcataaagttattggctctcagccagtgttgaacaagtagacaagtgtgcatcaaacggtttatgagacaatcctaaagaagtcggactatttggatttgggattaacatttgctctactttgcatgcacaagaaaactcaggccttgtgacacagtatgcatgcctgtttttaaacaatcacaaatttacaaaaaagtatttacaagtatatataaagaatttttttcctcataccatttcagagtaatttgccacctgacacccttttatctcctaatactttgatgtatatctcctaaaaaaggaacattttccacataaccacaatgtagccatcaaaatggagaaattaacactgatgtacgactaccacctaatcctgactccattcaagttacagcaatttttccatttacagcaaaattatagcaaaagaatctagtttagaatcatgcgttgcatttagtttcctcagtatacaacagtttcacagtctttccttgactttcatgggcttgataattttgaataattattttataatggattttagaatgtccctcaatttggatttgttcagtgtttcctcatgattacatccaggtaatgtaatctttagtggtgatattcacttcagcaaaagtgattctatattcttttcattgcatcctattgggatgtgcacaatgtcatcttgtgcattgctgatgatgtttgctttaatcatttgcataaggtagtgttttcttcaatataaaattattattttcctttgtacaattaataagttctttatgggaaacactattaaactatgtaaacctcccattccttatcaaactttcaatttaatatttccttatttatatgacaccttcctattttattcactgaataataatctgttactatcattattttgatgctcaaattgtcccagatctgagaggcccctttaagatggcttctgtgtccttttgaaaagtctctatattctttgagcatttctttactttctggcacaagatattccagtctcatcttgtactttctatgcctcagtgatttctccagaaagtcctggtttcttttagtggaaaatggtatttagaagccacaatctgacattaggtgtgctcattgctattgaggtattgctgcttccaggcctctctgtagacagagctggaaaacatagctatgtatatatacatttacatgtatatttatttctctgtctatatactgaacaccatgagtttatataaatggctaaaattctgatccagaatccaaggttcatttatctgttcccatatttataactcctttacctaattaggtgatgaacccggtttccattatccttaatgtattgagtcaaaaataaagcctccttttatgtgaccagtctcctggtctcagctttcctcccatccccagtgcagattccagtctcccatgtattagtccgttctcacactgctataaagacatacctgagactgcgtaatttataaagaaaagaagtttaattggctcatggttctgtgtgctatacaggcttctgcttctggggagacctcaggaaacttacaatcatggtggaaggctaaggggaagcaagtgcatcattacatggctggcaggagagggagagagacagcaaaagaggaggtgctaaatgctttgaaacaaccagatctcttgcaaactctatcatgagacagcactagagggatggtgcgaagtgctaaaccactggaaaccacccccatgatccaatcacctcccaccaggccccaccttcaacactcgggatcacaattcaacgtgagatttgggtggggacacagagccaaaccatatcatcccccattcaatctccaaaacccatgctgggctggcttctgccccacacggatccctccttatcctgctaatgcccttgtgctgagtgccagatcactcccacatctagcttccctcctcactctgcctgggcacctgaactccaaatccctgtgcagagttgtcccctgaatgcacacacatctcacctcactcaggctttggatccccacatgggccacaacatgctgcactctgctggctctcagacacttcatgccaggctgcctctctgtggagatgccgtcatcaccctgcttgggacagctttaaaacaggcaactgccatatgcggttgccttttccaccccactcatgttctgatgccacgtctgccctccttcacatgtacctcctcaccccaatggggctctgatgcgtgttctggcacaccatggtttccccttcccacctaatctggacacctaccttgctctgctgcccctaatggctttaggactaaattgttgaaacaggtaagcaaaaggaagcaaaagggaaggggaaggggaaaagctcatgcaatattttaacttaacacatctttctcacccactggactgaagttcatggccgaaggaaccacattttttccatctttttattctcagttcttaacaaagtatctgattcatagaggtaggtagcagtgcaataaatgcttgttaaattaacctcattcaagtggaaagctgagaacttaagcaattccagtctttggctcttatcagtgatctcagtcaaaccctttgagcattattttcgaaaggaaagtaaatcataagcagtttggccagttgtcctccaaagaggatctttctgaaaaaatgtaacaaaatgaagccttttcatgggggctaacccttctatatacaatttgctaacaatataaattaaatctattgatttattttgaaatcataaacttaaaaagagcaatgttcattagatgtagagcttttattcttaattagtatcaaaaatcattgatcagaattatgccttctttcttccattttcataatataggcaagtgaattagtttccatatagtttcaaccttatagctcctccaagaaatgtaataaacaaaaagataattaaatgatatttggactgaagcattacataggaataacaaacataaaggctttattctaaaatatagggaccttgacttttagttcctgttaatggcaggaacaagcttttatttgtgtcttttctgggaagtttgttcatttattcaaaatgtagttattagacaactcaggccagcaacataatttgtggggcccagtacaaaatgaaaatgcagggcctcttgttcaaaaagtaggaaaaataggcctttaaaagtcctaaaatatgacaccttttcctttcttccgtggtctctctcctggcctttcgaatagtgttttttaatttgcaatttaattttacactcaggcactgggatactcaccaagcaggtatcaacttttataggcacctgaaggctcacctggggcagaaggaagggctggggtgcaggcatccacagcccaccaactgcaaggcttcttctgccaatttttggactgacactggggatattagaatgaacaaaacagacaaaaagtccctgcatcatggaatgtacatgtcagcagaagactcagttaaaaaaaaaattgtatgtgtgcacgtgtgtgtagtatctgttaggtagtgataaaccctttgacaatcaataaacaaagcaggaaagtggggtttggagtactcagtgtagtggatagaaatgggctccaatttgaagtaggttaggaaagccttcactaagaagatgacattcaagcaaagatctgggagaagtacaggagccagccatagggctatctgggctgagatgttgcaggcagtggcaggagcaaatgcaaattcttctcagtcaatgttgcaaatacttcagtgagacagtctaattttctcagagacctttttttttctttttttgagacggagtctcgctctgttgcccaggctgcagtgcagtggcacgatctccgctcactgcaagctctgcctcccgggttcacgccattctcctgcctcagcctcctgagtagctgggtctacaggcacctgccaccacgcccggctaattttttgtatttttcgtagagacggggtttcaccgtgttagccaggatggtctcgatctcctgaccttgtgatccgcccacctcggcctccccaagtgctgggattacaggcaggagccaccgcgcccagcctctcagagacttctttttactccacaccccacctacctttccccacatcactaatcttgtttctggaatttgttccaccttctcttttccaaatttagttagcctaggtgagattcctgctctctcacctgttacaggaggcttctaacttcctgcctcaaagctctctgctccccataccactgcctgttgccctcagcactgctggagctcaagtctcaaacataactgactgtgtgttcttactcagaagacccattgtgtggctttcatgcaccataccaaaatgcagaagtatgggaccctatgttatgttcagaaatgccataaaatgatctgccccatatgctgactaaactggttttgtcctgttacagaccatcacctgctcatctacacctccatgcctttgctcatcctggaggatatttgttcagtctcagaacttgagggctaacttttcattccaatttcaactccaatggagttcttcttgaaatgtttcttgatctctccaattagaataaactacttacttggtttcagttttacttaaatatctctctgtccaccaagtaatgaggttgctttttttttcttttttttcttttttcttttttttttttttgagtcggagcctcgctctgttgaccaagctggagtgcagtggcgcgatctcagctcaccacaacctccgcttcctgggctcaagtgattctcctgcctcagcctccccagtagctgggacgacaggcacgtgccaccatgcctggctaattttttaatttttagcagagatgggatttcactatgttggccgggctggtcttgaactcctgacctcgtgttccgcccacctcagccttccaaagtactgggattacaggcgtgagacaccagtaataagctttctttacgtcggagatcctgtcttatttatctttacatttataatacctgtctctttgctttgcacacaatatggacttaatacatgcttgttgaatttaacgttattaatgcaactcatattattaattgtaatggtagtaaattctacaataacacacctggcaataatgcaaattagaatagcttgaattgaaacatggaatgattggaaagcagctttttctcctctacctgattccttttctcaggaaggagaagggaacatagaggcctctccctcatggggatgctggacagggaaaaatcagacaatcctatttcaggaaacagagaggtgggggttagttcccagtattctcccagcccattctctctggatcaggccaacaaaacattcaccaattaacgaagagattcctggaatcacagttgctctcccagaagtcccagccaggccccagaattctgcccatcaatttttatgttagagcagtcaccactaggtggtgccgaacttcagcccagggtaggtgaaatttgcatcaaatagactcagaacttccagatgtccagttgcacaggctcaccttggccatttagctaatctcataataacacaaccctacattttacacagctgaatttctggggcactacttattgcattatggcagttttgttgtatcattttctaaaaatctttcaatatcagatactctgccagccactttacaggctttatctctaatgctcacagtaacctgtatggtaatgggtactgatacttttcttcttttagtaaagaatctgagctgggcatggtggctcgcacctataatcccagcactttgggaggccgaggcgggtggatcacccgaggtcaggagttcaagaccagcctgaccaacatggagaaaccctgtctctactaaaaatacaaaattagctggacgtggtggtgcgtgcctgtaatcccatctactcaggaagctgaggcaggagaatcgcttgaaccccacgagatggaggttgaagttgccaagatggctccattgcactccagactgggcaacaagagcaaaactccatctcaaaaaaaaaaaaaagaagaagaatctgatgctaagaaaagaaatgtctcttgcccaagagctgtgccttgtacagctaagtgacaggtgacagacctaagaattacattcaagcctgtctcactctaatgccatacttgtcatatttctgctatacttcaatttaatgatcaaagaaaggaaggaaagagacagtggagaagaaaagtagggaaagaaacagaaagagaaggggagaaagatatgtttgacagaaaagtaaatgaagtatgttaccatctgtttttttcaaccccagaggtctgattcccccgcaggaaagagttgcttctagcctgtcctttatctctgcacctgccctgcttatctcctgcaccagaggctcctaccatgaccattaatggactgagtttttgtgtccctacgaaatgcatagcttgaagccctaacccccaatgtgatggtattaagaagtggggcttcaggaaggtaattaggtttagatgaggtcatgagggtgagttttctctctctctttctgtcatgtgaggacacagcaagaaggcagccatctgcaagccaggaggagagtcatcaccagaacctagccacacaggttccctgatctaggacttcccagcctccggaactacaagaaataaatgtctgttggttaagccaccccagtctatgacactgtgttgtagcagtcagagcaggtgaaaactgtaacttgttattctctaaggaaaatacaggtcttcttctcaggcctgtcttcagaaacaggttcacatccccatcttccagtcattgaactaaatggaaaagtttttgtcttcctagtcattgtctgcacctaaacacaggcttgcccatctgtagtcctagtctgttccttttctttggtgaggataacccttcctgtcttgctttaacaccctgtattttccgttcattagtgactcagacctctgataatggtatactagttaaccccctgtctcgtctgactttaaatgattgcctgttttgaccttgaggaaatatgagtccactaggaactacaatctttatggccacttgaaaatctttattccacttaaggtggaatagggtaccttgccacagaggaaacaagtaaggagagaaagagagtaaagatcagtgagaggaagagaaaactaaaactactagtataaaaagttctgaaatttcagcaaattattttgcttccaactgtacttaaccattctgccctttatttgcaataaaaatattggggtattattatctttgaaatgcagattatgtggttaaccattgttcactttctaaaccctgtaagtatttaacttgtggatggggaatattgtttgggactgtattggttgcaaaccaaaatgatctacactcacacagcttagtgtcaacattaacatgactttactttttagctgtctttgttaacatgactttactgtcctactgtcttcatcaacatgattttactattccaagaaactcttgccttggaagataaaaatagcaaatgattttcttgtccctttcagaaactttttgaaaattcatttaaaggaatattaaataattcaactttcacagttagcatcagatgaatgtttatgctccaaaattcattgtgaaaccttcagcttgtgtgtcttccaaacttaaattattatgtagtgtcttaaccaatgttaagacattagtgtcagcattactgacacacaatcaaatgctcccctatggaaaaacttgccttaaaaaaaaaagaaacacacacacacacacacacacacaaaacaaaaaaaaacagaatttctaccttccgccccccaccaccacacacacacacctaaattctcttaaatatcccgactttgccttcctcctcccagagactactaaggccatgtcaaggaagctgtctcccctatggtggtaaacaatgaactcagctctgtcatatgacaggctataaaaagctgattttgttgatattctgggaaagctaccattcagcaggcaagtgattgaagccatttcctctcaaacttatgaaagtaaactaaaggtctgattctgcccagggaggaagtttctccactctatcatatagaatccatatgtccatcatacttttatttgaaaagaagggatgctaactctcagaagcatgtcatagtaagcacagaagtggaaaaaaagaattgatcatttttgtgagggaaaacttaatgaaaaaattacaaaatcattataaatacaattcatttgaagttatgttttgagattacattattttctctctggcatttagacacctaaaattcactttaaaatatgttggtgaacaaatctcattctccagaagtacatttttaaaatggcaatatttcataataacagtataaaatgaaaataattgactatctcttgccttgtgggacttggcttttagtctaaatagatatgaaacaaaatgacattcatctatatgagacgtttgttaacttaaaagaaattaagtcagaagcctataaggctaatccataaatcagcaaatcagataaattagtaaaacttttccagaatattatccaggggctccttactcctttgcaatttgttacctgttttacatgtccttttaggaagggttcatttcccattgacaggcaaaaagaatatatgaaattagaattttcaacagcttgcaacatttgtgtcatttttgatttaacaattttagaagacttgttccaaaattacacctgaatttcattttctttgtagttttctaaaatgctgctactatcaggacataataaaagccacacagccagtactagaaatgctgtcatgtaaccactaagaccacactaaaaggcaaaatgctgcagctgaaagtatttttaatgacttgaaattgcttggaatgctttctagaagtaaaagggtgcagatttatttacctagtatacttacctaaattaatttggcaagattattttggttcaaatcctcattcaataaaatttatgttaatatttttaagtggtttttttcctgaaggatataatatattgcattaacacaaatttacaacagtcatgaaagtaaaaggtaaattaagccatttctgaaatatgaataaggactacatttttaaatagactacatttatgattttatgtgaccttgcagataaacatcactatgtaaactgttaatgagaacaaatagaatcacattctatttttagtttttcctgatgtatagtttccattagagatatggaggaaactttattcttgcataatttttgttttagaagtttgggtttttttgtgttttttttttaacattttaagcaaatgggctttttatatatctttttgattcggtacattccttactacagaatgaatcctagtgaaattctcactataggccatttttccatgtttttttcttttatggaaattttaaccatggttactaacatataaataaactcttttaactgcaaagtcagaatgggtatactttgttatgaacatattaacttattccagtttcatgtcttgtgtttttctgcactcattaacatctccttggtacttgggatcatggcctggccaatacgcataaagatgacgagatatctatggactacagtacatctgtttaataattagtaattgttatgcattgtaaatgaacgattttgactcataccactgacatttaattagtttttactatattccaggtacatatgagaatgtcacataattatcttctttaatttttacagtaactgttatcattacttcagaaaggaacaaaactccatttagagaggttaaatagaaggtccaaaacatgtagcaagtaaaaagtatccagaacttagatccaggtttgtatactactccctaattggggctcttaactactttgatgcattgccttttaaacttactttcttgattatctatttgactaacatctccccaggacacacaaaatacttgaattcatgctattatggcctgaatgtttgtgtccctttacagtgtatatgttgaaatcctaaccctcaatgtgatggcattaggaatcagggcctctgggaggtggttaggtcatgaggttggggccctcataaatggcattagtgcccttactaatagagacagagacctggctcctgctctttgctctttgccacgtgagggtacaatgagaagacagccatgtgcaaagtaggatgagtgcccttgcaagacactgaacctactggtgccttgatcttggtctcttcagcctctaaaactgtgaaaaataaacgtttgttgtttaagccgcccagtttatgctaaattgttatgatagcctgaactgacggagacacatgcgtaccacaaacaacaaaggctcaaggatccttaaaataaaaaccaagactttcagtgggttgtaacatcacgtagtggaggtaggtttcctctcctctatacctctcccaagtaggaaacatattaagatcacaggggagttaattggaactattatttcatatgtaaagaatgtattctttataacttcttgggaatatatcttaatttcttttaaagaagattagtctaagttatagtttagtctatagttttgtaggttagtctaacaacattttcgttaagtctaaagaataatttgcaaactatgtgtatgtgctacatttgtgtattgagtgggtgaagatcgagttcagcacagcatgcctcttaggtaaatatgtaaaattctaggagttatttttcaaggggtacaattctacacccaaacattcccctcctaattctacctcctaatcgtagaagaagcagccccttggttatttagcccaagaatccaatgtgacttatctgtaatcctattagtccattctattcccttgatattgggaagttttgcctgtcccaaaagaggccattcggaggttattcttggatgattcactcacttgtgaaagcaaattgtgttggcttcaagatgctgcatttttttgtaaacaatgccatgacttttacatttctttacatcttggagctacccacttctgcaggtccattctctctctgtcaccatttaaaattatgtaaggtaagttttcataaacccgtaaaataatggttacataaattggaacttcctaccactcatatcttagttgtattaaatcaaacatttactactatttccatctgtttcactccatgacagcatcacctacttgactctgttatactaagagttcagtgagaagagcatcagggagcttagttctatgtagtatcacagaaccaaaaagcaccttaaacttgtcagggttctgtttcttcagctgtagaagaaaccagggttagggttgggggttatggggaagataatacaagtacaggtaggcagcctgtgtgactaaaagttgtatctggtatgtttgtcacttagggacttttatggacctagattctaaaaatcatcccaataataaccttaaatcatgtcagaaaactctacaatggaatagatttttgcattcagaaattacgtgcattttccccagcatggtatccacttacctaacactttatgctacataaaacgataaattatctagtgtgatctaaagccatcagaaacatttaaaagttttatagtacagtattttaaagtttactaaccattatataaaattaataagatagtttatacagtctcttgctttattgattgtgggtaataacctgtagatgggaatatagtggaataatgtgcctaactgcctttaaaagaacttacttaaacttcagtaatttatttctgtgtttcttggattccttttacttctgaagtcttagtgaggaacggtcagatattgagttgctgtattcactaaatattttgtggagaatttctttaaggaaagatgtggattttaatgcataaattttttagacagactattgaagttgaaatttcatttcaagaggcagtcagctttgtttaactctatatttttagtatccaaagttactgagccagactttgctttaattaattactataggatgtgaggcagttccagtgctgctttttctattaacttgcaatttcctgtaggaaattaataaaatgaaagagggggtggccggcaagaataaatatatgctacagttgcaagtcactaaaattcatcagaataaattaaactgcacaggtttcctttttttataattctataaagcttctcaattcttaaggcaaatttgacaaagaaacagggccatctaaaaatgatcaactttcatataatatacattaattaattgattagaatatgaaatttgtcagatcagtgttgtttaatggttaagaaggtaaattctagaaacagactgcctgagtttaaaatctggctctgccattactagcatgagactttgaacaatttacttaacctgctgtacctctttatgtttaagatgcaaattataataacacttatagggttcgtatgaggattaaattagttaatatgcatagtacctggtatatacaaagtactacacaggcattaacagcaattagcatctgttttttcatcagtattaacatttaagaaaaatcatcttactttagctatccctttctgcaacctctggagtcaaatcttaaggtgacaaatttaagtttttaaaatatttgcaaattttgctttgtttttctgagtcctttttaagtgagttaccaggaactccaatgaatgcatgtcgttgtactcaggtacttttttttttttttttctttgagatggagtctcgctctgttgcccaggctggagtgcagtggtgtagtggcatgatctcagctcactgcaaactctgccttctgggttcaagtgattctcatacctcagcctcccgagtagctgggattacaagcgtgtgtcaccacacctggctaatttttgtaattgtagcagagacggatcttcatcatgttggccaggctgttctcaaactcctggcctcaagcagtccatctgcctcagcccctaaagtgctgggattataggtgtgagcaatttcacttggcctactcaatatacttttaagtgaatactatgggtaccaaattcaagtgtctgataattttaccccatgagtaaaaggatttctcttgctgagatttcagaaattgttgagaaaatatttggaagaatgttagcaattgaccaggatataaaaagaaacacagaaattactcgcatttagatctgcacctcaaccacattgaaagggtggcaggattttcagaatgtggttgccttttcattgtcatgcttatgttcattctacaatcaatatgtattgccactgaaataaagatataatacaagatagaattaaggcctactgctttgactctattgtttatctagttaatagcgttaacaaattttagttctagcttcctttgaactgcatgtaaatgctgcctagtcaatgacatacctgaaatagcttcttgttctttattatgtgtttatgtgctcatctgagcgtgtcttgttactaggactgccttataaaagtcggttttaatttcccgagttaattaaaggtttctcttacaattacagcctccctagttttcaggggtttgttctttttgtgtgtatgtgaagtggggaagaaggtagttggaagagtactaccttttatcattccatcttatatgatttatcttcgctgtgtgtattattcacctattatttttcattaagtaacaataagtgattgaaacaaatgttaataaaatgattaaaatatatttagtaacaaatttatctgtttttccccctttctagtactggtttaagtggactggagtgagaaagacattattcgaaagatgttgcaaatttatcgtgttttcatgttggaaatgacataaatgactttgtccaaatgatgtctttttcagtgtagaatacttaaaccagtgctaggaagaaagttttttattgtaagaaagtagatttctttttattataagtaaataaaatatcctgattatggatatttcataattcgttcattcatcagtttatggacttttggcttgtttctagtttggagctattatgaataaaagctgctatgagcatgtgtttataggtcttcttgtagacacatgatttcatttctcttacgtaaaagtccaggaatagtactgctagattgtatggctaggtatatgtgcaactttatgagaaactgccaaactgttctcaaaggggcggcaccgctatgcattcccactagcaatgtgcaaaattttcagttgctccacacaccattaattcttgaactagtcagcatttttaatgttagtcattctattgggtaccttatggtgatttgtttttccatttccctcatgacttccgaggttgagcatcttttcatttgcttattgaccactgatataactttggcgatgtgtctgttaattttaatgatgttcagtttattgactttttctccttttatgaatcatgctttgatgtcaaactgaataattttttgcctaactcaaggtaacaaggattttcttatgcttccttctaggagttttattgcttttattattatatttaggtctgtattgtattttggcacatgttttgtttgtttgtttttcttaatgttgtatgtgataagggctgaaggtttttttcataagaataccgaattgttccagcatttattttgccaccattggattaccttaaccactttgttgcaaatcaatcaactatatatgtatgattctatttgttgacttcattctgtttcattgataaataggtctatcctaacaccaatcccacaatgtcttggttattgtgactatattaggtcttaaagtagtgtgaagcctccaatttgtacttcttttccaaatttgttttggctattctagatcctctgcatttcccgtataaattttagaatcaactttttcaatttatcaaaaaaatcagattatgaatgagattgggttgaatctatggaccaatatagggggaattgatatctgaagtcttgtgtctcttctaagctacaagttaaataatattacctcttttatttaggttttctttaacttctgtcagtaatggatttttagtgaaatattttaataaatttgtacctaaatttttgatactactataaatggtagcttttttcattttgatttccaattgtttgttaccattgaatactgaaatgcaattaatttttgtggatttatatttttatcttgtgacattgcaacactcaagttattaattgtagtagcttttttgtagattccttagggtttcctatgaaacaatattgtcatcttcaaataaacacaattttagttcttcctttttcatctgtatgcctattatttcttttacttgccttgttgcactggctaggttgtctagtacactgtggaattgaaacgattcaaacaaatacccctacattatttcatatattagggggaaacattcagtcttttaccattaagtatgatgttaacttcaggttttgtaagatggtctttatcagagtttaggaaattttctattcttagtttgctgagaaattttttttaggaatggatattgacttttaacaatatttttcttattttttgagaaaatcttgtggattttacttagtatagtttgttattatggtaaattaaattgatttgtttttccaatgtcaaattgacattgcctttttaggattaagctcacttgtcatgacatatgttttttgtgcatggctagattcaatttgccaatttgtaaaaggatttttactgagatgttgataaagtatactagtcagtaatttttattacttgccatgtcttttgcaactttaatatcagaataatgctggtttcatgaaatgactggggacatgtttcctcctcatctgttttctggagagtttgcatagaattgatattatgtcgtcctcaaatgtatttgatagaaattgcccactgaagctgcctagtccttggggttttctgtggaatagttttaatgacaaattcttttatttttccataaaagaacttgatggtttttatttgacctactaaccttcggccagggtaattttgacagtgtctgtaagataataaagtggcaattatagtagtaagtttgatttaaaacacctttaacataaaaaagaatacttgttaattcttggaagtaaaaccacaagtgtttatacatgtgaatatatataatattctttaataaattctatatctttagtagatatatggctgttcaagttatatagttcttgagtgagttttggtatttttagattttccaggaatttattattttatctaagttgtcaaatttattggcagtctcttatcttctaaatattcccttattattttttaaaatgtctgtaggaactatagtgatgtcttctctttcattcttgatatatgttgtttctttttcttggtctgtctggctagagatttatcatatttattgatattgtctgagaaatagcttttgggctttatggattttttcctttgtttttctattttgcatgttattgatatttgtatctttattatttccttctctctctttaggtttaatttactattcgttagtgtcctaggagggaagcttggaacattgattagagacattttttctttcttagtataagcatttaatgctataaatttcccttcaagcatcctttagctgcattgcacaaattttgacttgttatattttcatttttattcaattcacaacttttttcaattttccttgtgactatttctttgatctttggcttatttagaagtgtgttgtttctaaatgtgtcacaattttccagatttttaaatttatttttagtttatttctattttggtcagagaatattactctatggtttttatcttttttaatttgttaaggtttgttttatggctgagagtatggtctgtatggtgaaggattcatttagatttgaattgaaggtgtattctgctcttgtatggagttcttgaattgtcagttagattagtttcattgataatgccattatgtgttccacatacttagttctatattcttactgattcttcctcagagaggagtgttaaaaatctccaactataattgtagtcttatttatttcttctgtatattctatcagtttttgcttcatgtattttgaagctctgttatctttaagcacatacacattcagctgtctactattagctagaagctgataggtcttcttgattaattgacttctttattattatataatgttatacattttcctggtactattccttgatctgaagtcgtctctttgtgcctttaatatagccactccagctttctttctttaattaaacatttttagatttcttttttattatacaggtaagaaacatttaattataaaaatatgtgaaaatttgaaaatactgatagtcaaaaataggaaggtaaaatcagctgtaagctcactacccaaaagtaatcactgttaacaactttgtgtatatacctatttttaaaagttttatttttatggtaaaatacacatgacataaaatttactatcttcattcttttttagtatacagttcagtggtattaaatacattcataatgttgcacatccatcactccagctttcttttgtgtttgcatgaaatttctctacctttttatttttaatctgtgttatatatttatatttaaaaataggtttcgtatgggcaactatagttggcttttacttttgtatccaaaatgacaatctctaccttttaattcatctatttagaccatttgcatttagtgtaattatcagtatggttgggataaaatctattatattattatttgtttacaaggttcttgtttggatcttgttgtcctatccctgtagtctcatacatatttcacacttcttttcttctactctacatgtagccttcataagcttattctaataccttcaaagggccaattttttataccccactgatatttttacaagctattctctgcctacttaagcagacggagttttgttcttgttgcccaagctggagtgcaatggcacgatctcggctcactgcagtctctgcctcctgggttcaagcaattctcctgcctcagcctcccaagcagctgggattacaggtgcacaccaccacacccagctaattttttgcatttttagtagaaacggggtttcaccatgctagccaggctgcctcaaactcctgacctctgttgatccacccacctcgacctcccaaagtgctgggattaggggcatgaaccaccgtgcctggcctttcccctttttctcaaccacacttaacaaattattgctcatccttcagatctcagtaaaattgtattcctctaagaagcttttcttatatttcaagtctagagtaggtgcctttccctactttcgcttcactgtccctagaattaatagaattaatatcaatattaattatttaatttaaactgtgaatggaagaaagtatgctagagagtgaatatggatgtcttctcttcctttataaaaggagaattccctagccagattgccatgacagcaatccattctttcacactgttagaatgtcattttgaagtgcctctgtggggttcttttgcccaccctgcctgggatcatctaaatgacgagttaataggtacagcacaacaacatggcacatgtatacatatgtaacaaacctgcacgttgtgcacatgtaacctaaaacttaaagtataataataattaaattaaattaaatttttaaaaaatgagagaggtccctgacatccctgcagggatatgggttattatgtatagtctgtccaactataatgttgcatttttgtttcattgtttcttagagattaataccccaaagaggggtctatttcctgtaatttctgtatttatcaagctgaaaaagcatgtccataagtttagaaaactgaagctgagatgatgaaaatactgtgctgttgtttttcactaatagttgcctgattatatcactgaaagaatatcaaaaactgattttatgctattgcagtaagatagctgctggttgtacttggtatccttatgaaacaacattcttttggcattagattatcactaacatttaaataaccttctctaaattaatttttaaaatttccacaacaaagtgcatcaccattaaaacatcacgttagtggcaattataaaatggtattaaataatagaatagatgcctgaataataatatgtagttttttaaaatccttaaaagataaactacagtaatgggtattgatgaaaaatgtggttggtctatttatagaaaagctaactatagcagacatttttaaataatattttttatttctcctttaattaagtttgttcagacattcatagatcatcttgtacctacaaaaagatattatttgacaaccaagtacactctgaaaagaagaactttataagttatcttttttaattttccttcattgacataatgacagtgaatctcattatgttggtgctaagaatctaccattgtgttttgttttatggaaagaaaatttaaattatgtcgtgtttaaaaaatgagtaaagtaggtcaacacccagctcactccctgacatcacataaatgtaagattaagtaagtgaatgacctaatgttcagccttctaaatattcctatatttcaatttagggagcaaatatgaaagtaaaattaatggatcagttcatacttttaaccttgagtcatgataataactgtattgaagaaaatatcatgatcttgatatggtaggcaatggcaagttacttgccccacaaaatatttttaagtaaaaaataatttcccaagagaattttcaagactcattattggctgaagatcagaatattccagtggttcctttaataataatacttttatatactcattttaatcaaactatagagttcaacttttgaaagcaaaagtttaaattttgaaaataaatttttgaaagtacaagaagatagttatatagacatatgtgatagtgagttaccagtcccacagagatccaagtattaaaatgagcgattgctcactggacaaggcagactaaatgtttttttcctaagggtttcttcttaacattcctgtctcaggaagggctttaattgacagggtaaggcagaaggacaaagaggaagaagcagcactggtttgatcattgacaaagcactttcattttatgcagcctatcttactgtccagcttggtcagaaaacacaaaaagttagtcatgagacctgagtttgagttccagctcttctacctacttggcataaaatctgtggcaagttaccaagtttctctgggccccagtggcttaatccgttaaaaagatgattgtaatgtctacaccacagaattactatgctacctaaattccataattatgtgaaatgaacattttcagatggcaaagaatattacatatcttagtttcaggtaacatacctgatcaagttagaagaaaatctgaggagcacatttccaagacaacccacctacagatttctgatatgaacagacagtggctattaaacaaataaacaaacaccacaaaattaatcctaggtgatggtagtatgaaatgcatagtttatttctatacttatttcaggcttaacttattctcacttctaactgaatataatagagtctcacaagctaagacctggggctgaggatctcctcccgtattgtgagaactctacattgtagaaaagtctagttttattatttgaaattaatagacctattctgttcatgtgttaatatttgaattatttaaagtacctaaaacgaagttgctattgaattttaccaccacagatcaacacatccactggtatgtggtgtgtgtgtatgtgtgtgtgtgtgtgtgtgtgtgtgtgtgtgtgtgtattgtaatatagaatatgctaaattcataagtttccacttgtgtttttttcagtacttttcttaaatcacaaattacacgaagcttaacaaacatccaaaaacactaacctaactggaaaatactctaccatctttaggtcaatgttagtggactgtcttcaagtggaggttgacttcagaatagaggctcttttcatttttaatctatcttttctccttggtcttttatcaggaatgatgtaacaaaagtatatgtatccgtgaatagaaatgtgtgcaaagaataagtggcagtagtgggagaagcctctagatctgtgtctatttagaaaggctggaaaataagaaaatagtagaaccctgaatatatgctatacattttatcttctcagtgatttcctgccttataattctttttaaaaatcacattatagcctcaaattgccaggtaagaggagaataagtaggaaaccaggctgatttcataaaccttcagtattgtcccacataagcatgcattttgggcctgattatgttctctgcaaacactgtccagaaacagattcagtgaattacagtcttaggactaaccaagacaattttgagcaaaaagaaacccctctctaatgtgacagtagaacataagaaacatcagtgttatcactgaaattcagcaagtgcagatgttaatcactgcacatctagctctacctgccaaattggtcagattctttgagtctgtggccacacaatgtgatctgccaactgcagtttgtcacagtctgccactttgttctgcaaaagaagactgcctacattgtatcactaagttcttttggctgttactccacgggaatgttgctaaacaatgagaaatccaatgaaacattccattggcttaagaatcagatattgtataagtcgttcattcattaattcaacaaatacatagtgagaagttactctgtgccagataccggggcactcataagaatttctatagatttaacatcgttagtaatgtatatatagctaacaagtaaggccatatattgtcattagccaatgtcttatcatcagggacagacacatacatatattacagaaggacgtgaagaagagtgagcgacctgtttagacacacttataaggacacacacagacacacacacacacacacacacacgtgaaggaagaaaacagccttacctgttaagtttcagtcctctactacgcactttaactattttcctattttttagcagaaccaccttataagatgttaaggtgtttcttcacgtaatgcctgtctctttcatctgtatcatatgccctcatcactgtgaggaatgggagaaagaaaattggtaactctgatccatactatgcctctgaaatattttagcaacagttggaatagaatcatgtctggagctatgtgtgcgttagaataggtatttaccaaaccttatttttctatttcatcaaatagaaattctgcttttttaacctaactgttcctcttcctactgcattgctggataatttgcaagaaaattgattccctaaacccaactctcaggctagattggaaataaagagcttatagacccttcagaatccccatgcctttagaatccccaaggcctccatctgcatgtttacttacacaaatttggccctagagccagtgaaacacagggacataaagacatcctcattaaaaccaagaatttaagctccatctcgtggtcggatttgaatgaccaagaacataggttttccttgattctttgaattgaggatcaatatgattatcctgtactatttaaaaatttttcggaaaaaaatcatgaaattatttatgaggtcataataaacatggattacattcccagcatgcatttcatgaggctaaattatctgaggagttctagcacctgaaagaccataatttatttaaccaatatttattaagcactaagtataaaatatggcactagggctcaggcaaaaatgaatgagacacagccttttatctgaaagtcatttacaatctaataaagccagatgcatacatatatgacagaaggacatgaaagaagagtgagccacctgtgtggacccactgagaaacacttaagggtgattatgttgaggtacaccttagcaatcttaattttccttcttctacctttttgtttcactagtaaaaataaatcacctcttatacaagaaggaaaagaaactgtttcatgcgctgaattaacacttagcattaaatgcctatgctaactggcccataaaaaagtagttttttttttttggtttgtttttaattgagagatattttaattgagcctatgacataggctactttcccaaatacaaaattttagcatatggctttgattttacgttgtgtttttttttttttttttctgttttaatgtttagtcacacaaacttgaagttatcgtggctccaacagaaaattctagatgtcattagccagtgttttatcatcagggagagactattttacaacaaaattccaaaacaaaacttttcctttattacacagtactcgttctccattccctcctcttttagctgctccattagtctgtgcaaattgcctttcattttattgctttccagggcttctaagtgcttgtttagaaacaaattttcttaagtccaagctaaagtccagggtttatttgattccgttttttttttttttttggacagtcagccaatgctttactcactagtttcagtttctgtgaataagtgccagaagcatggagctgctgagctttatgaaaaggtatagacttttattaccatgaagccacactgcaagcaagtcttgcctgttctgtccctaaactactttcaggttaaccaacagttggaactcatttggcttattgtattattcaggattttcaaatgatttgccattatattgatggcttaatgccctattcaaaaatgtttcatagttttattataaggattttaatctgtattctgctctcatgttagtctagcaatcagcagtcattaatatgatgcgactctattgtagttaaactgttgtcagagaaaaggttattttctagaaattatgttggctgtgcccttcctaacagttcttcacatctctaatatttgaaaagccagtgatatttattatgctattttccttctagtcacttagattacactttcctcacactaccaggaatctcctaattggcaaatccagaagaggctctccagtcctttccttacttcactggctgtagctttttgtactgccagttcctccttcactaagtcattcaaaaatacatattgagtcctacgcttgtcccagatgccatgctagtcactggcaagacaaggtgagcaagagaaccacggtcatcacccacacagagtctattgtccagtggcagattccaagaaaacctgcaattacagcccacaaaactctcttccctttcatgtcacaattgtgttcaatccagattttatctaccttatcagacgtctctatcacagtatcatttgctggctgcttgcccttgtgttaaggatgactgttgctcaggcatccctcctaggctctctttttaccccacctgttctctacagataatttcagctcctcttcagatttcaaccacactccatatgcctgtgatgccagttctctggatctgcaagcccatcagccaccagcttgctagacatctcccctttagtgtccctttggcatcttaaatgaagcatgttcaaaattgaactcattaactttaatatgtactctttatactgtttcccccctccagtaatacttgatttcttggttaattgcattactatctatctagaatattttcactactgaattctgtgaggatagagaacttttctgatcaggcctatatctctaggttttaagaaatttaggaattcaaaatatttgttaagtaaattaagaggttttcttgactcttcttcctcaccgctagcatgagttgttcaagtgatcccctagtcctgcaaattataccaccaaattctctcaccaaatccatcccttttttattatcattctgcctaattcaagccctttcttttatacttttaacatactgtttcttctctgtatcactgtttctatctctgtccctctcagtagcaccctgtactttatatgaaaattaagttttacttcataagtaaattcagtatagatgcaagtgcttgaaataggcagagtttttcatgttcttccaccccaagtcactggttcttgccactgaacactaaactaaacatgaaacattgccttatctcaaagcaggtctttttctcctcacctccttcattcacgtataaactagaattctatttccaagaaataagtcaaaaaaaaaaaaccctaacacctggctaaggtggaggaataggactaggtgggagaggtggcagtgaggttgtttgcttggagatgaaaccaggaaatgctctaacactgctgtgttactacagccccaaatccacatgtgaaaatggcctccaaaatacggctcaatattaggctgctctctttttatcatttatgtacatcctctttcaaagcatgagtaggacacagctttttctctgagcctcactctaaaaatcactgaggttttaacattgtcagaaatttcataatttattggaacatgatattcattttccccttcatcatttcattctgtcccacataagtaaatgtcatcttcatgcccatcaagttccctctactactgattagtaagtttctgttacaatagaatatattgattgtcttccctagttgtgcgtatctccagctttacacagtgtttatggcagggagccccattacctgtgtgctccagaactgtaatgcttcaagtaattccttcatcaggatacagaaaggagatggaaccatctttgggggaaattactaagtgctttttgcaacatatgtcaagactttggatattcgtgatttaaaaactgatctctgatagtttgttttttcctaatgaaggcaggtcggcctgaactatatcacatccagttactacagcctgtcagaggcaaagggctctggttccagtgttttctctatttagtccgtttttcatagtctctagagcaccccttcagatcctcatctgagaggcggtacaaagtcgtggtaaagagtgcatgctctgaagtcacactgacttggctctatcaaagactaactttgtcacttctgtctcacccctttgtgcctcaatttcctcattttataatgggtagatgatatggtttggctccgtgtccccacccaaatctcatcttgaattgtaatccccataatccccagtgtctagggcaggacctggtgggaggtgatgggatcgtggggatggtttcctccatgctgttctgatgatagtgggtgagttctcatgagatctcatggttttgtaaggggctctttcccctttgcttatgcactttctcaagcctgctgccatgtaatacatgcctttgcctctctctcaccttccaccatgattataaatttcctgaggcctccctcaccatgtagaactatgagtcaattaaacctctttcctttataaattatccagtctgaggtatatctttatagcagtgtgtgaacagactaatacaggaaataaaagcacctacctcataaatagttgcaaagattaaatatatgttattcaatctttcttagaaaagtagcttgtgtgaatttgatcctgtcattatgatgctagctggttattttgcccgttagttgatgcagtttcttcatactgtcaatggtctttacaatttggtatgtttttgcggtggttggtactggtttttcctttccatttttagtgcttccacataacaatattaaccttaagtgtaaacgggccaaatgcccccaattaaaagacacagactggcaagatggataaagagtcaagacccattggtatgctgtattcaggagacccatctcatgtgcaaagacacacataggctcaaaataaagggatggaggaagatttaccaagttggaaagcaaaaaaagcaagggttgcaatcctagcctctgataaaacatactttaaaccagcaaagatcaaaaaagacaaagaagggcattatatgatggtaaagggatcaatgcaacaagaagagctaactatcctaaatatatgtgcactgaatacaggagcacccagattcataaagcaaattcttagagacctacaaagagacttagactcccacacaataatagtgggacactttaacaccccactgtcaatgttagagcaacaagacagaaaattaacaaggatattcaggacttgaactcagctctggaccaagcggagataatagacatctacagaactctccaccccaaatcaacagaatatacaatctactcagcaccacatcacacttattctaaagttgaccacataattggaagtaaaacactcctcagcaaatgcaaaaaatggaaatcataacaaacagtctcttagaccacagtgcaatcaaataagaactcaggattaagaaactcactcaaaaccgcacaactacatagaaattgagcaacctgctctggaatgactactgggtaaataacaaaatgaaggcagaaataaataagttctttgaaaccaatgagaacaagaacacaacacaccagaatctctgggacacagctaaagcagtgtctagagggaaatttatagcactaaatgcccacaggagaaagcaggaaagatctaaaatcaacaccctaacatcacaagtaaaagaactggagaagcaagagcaaacaaattcaaaagctagaagaaggtaagaaataactaagatcagagcagaactgaaggagatagagagacgaaaaacccttcaaaaaaatcagtgaatccaggagctggttttttgaaaagattaacaaaatagataggccactagccagactaataaagaagaaaggagagaagaatcaaacagacacaataaaaaatgataaaggaaatatcaccactgatcgcacagaaatacaaactaccatcagagaatactataaacacctctatgcaaataaactagaaaatctagaagaaatggataaattcctggacacatacacccttccaagactaaaccagaaagaagtcgaatccctgaatagaccaataacaagttctgaaatcgaggcagtaactaatagcctaccaaccaaaaaaagcccaggaccagatgggttcacagccgaattctaccagaggtacaaaaaggagctggtaccattccttctgtaactattccaaacaacagaaaaagggggactcctccctaactcattttatgaggccagcattatcctgataccaaaacttggcagagacacaacaagaaaagaaaatttcagtctaatatccctgatgaacatcaatgcgaaaatcctccataaaatactggcaaaccgaatccagcagcacatcaaaaagcttattcaccacgatcaagtcagctttatccctgggctgcaagtctggttcaacatacgctaatcaataaaatccatcacataaacagaaccaatgacaaaaaccacatgattatctcaatagatgcaaaaaagacctttgacaaaattcaacatcccttcatgcttaaagctctcaataaactaggtattgatggaacatatctcaaaataataagagatatttatgacagacccacagccaataacatactgaatgggcaaaagctggaagcattccctttgaaaactggcacaagacaaggatgccttctctcatcactcctattcaacatagtattggaagttctggccagggcaatcaggcaagagaaagaaataaagggtattcaattcggaagagaggaagtcatattgtctgcgtttgcagatgacatgattgtatatttagaaaaccccattgtctcagcccaaaatcactttaagctgataagcaacttcagcaaagtctcaagatacaaaataaatgtacaaaactcacaagcattccatacaccaataatagacaaacagagaaccaaatcatgagtgaattcccattcacaattgctacaaagagaatgaaatacctaggcatacaacttacaaaggacgtgaaggacctcttcaaggagaacgacaaaccactgctcaaggaaataagagaggacacaaacaaatggaaaaacattccatgctcatggataggaagaatcaatattgtgaatatggccatactgcccaaagtaatttgtagattcaatgccatccccatcaagttgccattgactttcttcacagaattagaaaaagctgctttaaatttcatatggaaccaaaaaagatcccatatagccaagacaatcctagtcaaaaagaacaaagctggaggcatcacactacctgacttcaaactatactacaaggctacagtaaccaaaacagcatgatactggtaccaaaacagatatgtagaccaatggaacagaacagaggcctcagaaataatgccacacctctacaaccatctgatgtttgacaaacctgacaaaaacaagcaatggggaaaggattccctatttaataaatgttgttgagaaaactggctagccatgtgcagaaaactgaaactgaaccccttccttacaccttatacagaaattaactcaagatggattaaagacttaaacataagacctaaaaccatagaaaccctagaagaaaacctaggcaataccattcaggacataggcatgggcaaggacttcatgactaaaacaccaaaagcaatggcaacaaaaaccaaaactggaaaatgggatctaattaaactaaagagtttctgcacagcaaaggaaactatcatcagagtgaacaggcaacctacaaaaatgggagaaaatttttgcaatctatccatctgacaaaggatccagaatctacaaggaacttaaagaaacttacaagaaaaaaaaaccccatcaaaaagtgggcgaaggatatgaacagacacttctcaaaagaagacatttatcctgccaacaaacatatgaaaaaaagctcatcatctatggtgattagagaaatgcaaatcaaaaccacaatgagataccatctcacaccggttagaatggcagtcattaaaaagtcagatgctggagaggatgtggaaaataggagcgcttgtacactgttggtgggtgtgtaaattagttcagccattgtggaagacagtgtggtgattcctcaaggatctagaatcagcaatctcattactgggtatattcccaaaggagtttaaatcattctactataaagatacatgctcacatatgtttattgcagcactgttcacaatagcaaagacttggaaccaacacaaatgcccatcaatgataaactgtataaagaaaatgtggcacatatacaccatggaatactatgcagtcataaaaaaggatgagttcatgtcctttgcagggacatggatgaagctggaaaccatcattctcaacacaggaactaacacaggaactgaaacatcattctcaacatcaaactaacacaggaactgaaaaccaaacatcgcatgttctcactcatgagtgggagttgaacaatgagaacacaaggatgcagagaggggaacatctcacaccagggcctgtcgggggttgggggactaggggagagataacattaggagaaatacctaaagtagatgacgggttgatgggtacagcaaaccacatgacacgtatatacctatgaacaaacctgcacgttcttctgcacatgcatcccagaacttaatgtataataataaaaaaggacctagcgtatatagactttctatatttagacattattaacttggtacactcatgcttaaagttgccctgatctgccacccccacccccaacatggcatctcgttacctaaaatatgcttaaagttacaaatcctttgcctacaaatggcacacagaccctttgagatctgtccacactgtgcctctccatttgtatctctcaacttttcctgttaatcgtcagtgtgttttaaccatgtcaagctgcatgccagactctctctggacttcccaaacattaataaatactagtcctttgtgacccagctttctggccaaatgctgtcttctcctggaagattcctggctctagcagttagtcaacttcatatagttattcaagctgtgcaagcttgtatagcctatgtatcgttgcattgtgaccttttttttcccttagggtctttcccacttgaactattccacctgttaagctcagtgcctagcgcaatggtgcactgctgaatgaatgaatgctgtaaatagaaattagtattatatatgtagacatgggattttagcttttattaattaagcttttggtcatttagtgtcatacatcttgaagtttttgcaagggtgaactcacatgaaatatacacatatgataaaaactacctccttggagagctgtttcctggggaatctatagatggtcatgctagctatgactgttctctagtatatttttggaaatggatcaaacaatatactatcccatttttttttcaaatctgtttccctctgaatttctcttgggttgctggacactggcaccctctgtcacagctttcttgctcccacagttaggcaagcaggaaggagtggtacccagtggcttcccttcttcgctcccatagcttggcgggagggagtggcagccagtggcatcttctctcccattgttcagcaagcaagagggagggttacatcttttttactccagctgcctgcagctcggtgagctggagggagtggcacccagcagctttttcactcccatagtttggcgtatgggaaacaatgttacagcccttttactctcacctcctgcagctggtgagcaggggtgttagagctctttttgctcccacagttcagcaaattccgggttcttgtcccatgactaagaggaatgaagtcacggacaccggagagcgagtaaggcagaatagaattttattgagcaaaagaaaagctctcgacagtgagtgggcacctgaaaatgggtagccatctgtgaagctgagtccggggttttttatgcatttggaatgaggaagcgcaggctgtaggtaatcttagaaaaggcaacattcgattaaaaaatgataaaaaagcattattcagaaagaaccaattgaaaaagagtgggtaacaggaatagaagttctcactctagttcatggactctatctggaattggtagtttggttttcagacttcagaggatccttggcttgtaggtcaagtttcaccagggacccatccctgtctgcctagaaatctgtctcctgacacctccattcaagtgtcatacatcaaaaagctacatattatcaaaatgtgtttccccacagacagattcctttgcaaaactggatgggagtgaacatcatggctggccgtcttgtgctgtgtgacagaacattaacatgcccaaagccagaggtctagaagacagtgtccctgccacagagggagcctccaacgtctgaaagtccgacagcattgactttaactcattgctttataaaaactgtaaacaactaaacccatgaggcaagagccaaagtattacagctcagtcaggccacaccccctgcaaactgtttctggataaaacagtcataacattggcttgtgtgctgggatttcacagtttaaaatatgcatgattagtgcctatgattgatgtgttaactaatgaagcctataccagtttagcagataatgctggcaggacgtaaggtgtctcagacaatttcccatgtggtgttgcatcagtctaaatccctttgaggtcacaggcaggatattggtcgattttaatgttgacgattatccaaaagaatgaccacatcatgaacacattacataatgtggtgggggtttcagtcttcatatggacaaaagaattctaacatcctaatggatgtaccaaacttctggctgggatagatatgaaatttagagaagagatgagagctgccttgtcaacagattggctccacatgccacatgttggcataggtaagagatgacatatgaacaaaagcagttgtcgaatactgacacaagggagctttcctggactcagtgagcatgaaatagactagccttaagcagtggtcacaatgaaatcatggctaaagaatgtttccgtggggctgtctctgaaggcagtaccccagagctccttcttgctcagcacccaagacaagtggaccacagagaactgcagcagtccaaatggagccgagggcagatccattaacaaaggccccaactcacatggaatggaatgaatgcttcaagaaacaccaagcctgaagccgggcacgggggctcacgcctgtaatcccagcactttgggagaccgaggtgggcggatcacctgaggtctggagttcgataccagcctgaccaacatggagaaaccttgtctctactaaaaatacaaaattagccaggcgtggtggcgcatgcctgtaatcccagctactcaggaggctgaggcaggagaatcacttgaacctgggagccagaggttgcggtgagccgaaatcacaccactgcactccagcctgggcaacaagagcaaaactccgtctcaaaaaaaaagaaaagaaaagaaaagaaaagaaacaccaagcctgatgcaaggcttggaagagcagactgcctgcagctgttaaggctgtgtggaaaggcactgtggaaaatggaaatcaaggaaataaagcagagattcttcatggcttgtcagttattttactctaaaggatatttcaattgcaatgaaaggtttaaatagacaggtagctacagtacaatgtttgcttctcactctggtacacagcatggtggtagttgtctacctgtttttgttgttgttttctaattcctcaggatttaattaatgttttacattcagtattatttagacaagctcaaattataatcattatatttacctccctaaattttattactatttcagtggcctagggggagttgtttgcagatctaaccttcataatagtctattaaatggctgccaagtttcaccacctcgatctagtctgtgcgagtagtgaaataagtatgcatttatcagcctgtgcaggacaaatctaagagtctcctaataaatttaaaagagcattactaaattcctctttaaaaaatgtaatgtcccattattagccctctccaaattcccaatgtcattagaaacctcaaggtgtctacatgctgatagcatttttaggggagagggccttggattcaagataaagagtcctaacttctgcagatgggcattatttcacaatcaccctttttttcagttttcctatctgtagaatttccctccataaatatcacatgaagaccaaaagccataagtgaagatttataaaatatttttatcataagagtgatatgccacatagcatttgagggaaaaaaaaatgcactgaatgaccagacctacaggaagataatcctttatctctacagattatttctactttaggaaaagaaaagggaaatttatggcagataggagttgagagcagcagaagtgttaggaggaagaccagtagagcagaccagccatgactgggttggagtttttatagggaagagagcaaagagattttaagcgggtaagacacataggtagataaaaacaactttttaggaaggttaattctgtattacatgatcaagcttatgtcaatttccactttgcagtctcttcaggagatttcagcaggctttctttttaaattttctttttcaaaaaaaaaaaaaaaagtaaaatattccttatctgcaatgcgagctgagcagcacagtgctccttggtatttataactcatttcccttcctgagctagcatatacttttaagccaaaaaaagatatacccttttccaagaccttctctgtcttatgccaccaaggaattccacttcagtagttgcaaaatcaagggattttcttttcctttatggttttggagactccccaagagctaaagcagaaaaaaatcaacactagatggccctagaagatgtactcttcatggttttgtctcttgtctgactgcccggagaagagttccttaggcatttacaaacacagcaatgccaccttttagccccactctttagggattttacatgactaattttaattgcataaaaggaactcatctttatcttggtgtgtgcagtgcaaaacacttaatgtagggtctgactctattctacagtaagtgcagtaagtgttagctactattacctcatcagcagacctgcaacaagagagtcctttgttactacagaattctcctgccctaatactgccaaagtctgcagttctagctgcatatatgcagttcctggtgcattggcggatctcaataatatttggtttgtggatatacaagtgaacaaagggctttgggtttttgtttttgtttttgtttttagcagaaactaattcatctggctaaataacctaagaatatgtaggaaaaaaattacaaccagaataaattcttgtttgctctttataaatggatcattggcaacctttgaggtaagatttgatgcatctcttcagtagaaattcagcaagatcaacctcctcattatgtggagcagcacactgagtaataagaaatctggcatggctacagtatcttgcacataggccatgctcaataaacatttattgaatgactgtcttgttaccaagactttgtagcaataagctttaggggttttagcctgaccatctgcttggctgggatgagtcgtgatgatagttcacattgggtttgtgtttaccagttcctaaaattcaagtgtgttcagatgtagatcctctgttagaaaatatagcagtatctgaaaatgtcttgcttttcaaataaaaggtgcagaggtgtgagtgtttttgcactgttggtttcagatggaaccacaagcatttggcagcatattgaagaagctgtcacaatcgagcttttcctcttggggaacctcaaccaaagctcagcggtcatttcccatggaaaactatgtgcctttggccagttgtgctaagataacttattggcctctctgatgtcagctaatttctgtccatcagtcctcagtgcctgagtgactttcctccaattcatatgaaagtatgcagaaggaaagttttacagctttacaacacagagcaggccttgcctttttatcccttggctgtgagcaccagtccttagccacatacattctcttgtattctgctccctttcctgtcccacattcttcatagatttttccacgttttctggaaaaaaaaatcaagaaaagcaatttcctaagataaatgctcccacctgcccttgttcttccagaaacacggatgggctggttggttcgttggtatttcccggtttgcttcccttttccctaagtgcgtcactgactctttgctcccgggagagaatgagcatgtggaagccagaggaggcctgttcacgcccctctcccctcctagcacctcccggcctccttccttgtatgtgtttccctttaatctctcaatcttacatctttcatatttgcaagagtgtacagaactatttgaggagagagaactggagatctagaacttttttttaacagattttatttgtcatagttccttaataaagaggaatgagcatctcatagatgagtgcatatggatgagcatgatacagcccagagcccacctgagctcatgagaaaatccccccagtgaaaagcacgccggggtgagggtggagcggagcgtggaaagcaaaccaattggaaaggtgttccctgtattaccaagagcccaggagtcagtgtttagatgttcacttcttgcaccggctaacatgacatagctactttgtgtcctcaagcaagtctcttaactctcagaaccttagttttgtcatttgtaaagtttgggtagtaaaggctgctctcaccacctcacatagtagctgcaagagtcaagtgagtttttttttttcaagtgagatttttaaaaagctttgtcaattgttaggtgctttaaaaaagtcaacagagagtgttataactgaaagagatactttaaaattgctatagctacctgctattaactaaaggcattaagaaacttgaaaaccaacaccaagaaaaagagtataattaaattccccgacaaatagtaatttcatcttattcaaatagtcttcttctgaagtgatctcagaaaatatggagctatttacaggattaatatgtcctaacttcccttttatgaggtaaataaagggggaaaaagctaaggtcatagaaaatttgagggttattggttgccagaattggcaaaattaatttatatttctgctttgaaacctgtttagtttctgtagaaaggggaacttttcaaattaaaactgtagtctgggtcagaaagctatcaaatagccaaggtaaaatagggaggaatccaggattttcccaccattcactcgtgctgttgactcctgccttgtgggcctcatcttggtcaggagctgccactcaccttttctcacctgcagaggctccaccaacctaagtgggaagattggcttctgttaccaagaagcagagcataatgctaagggaaggatagaaaaccctttctgttgtgtttcttctatacttgctcatcatttgacattgtttttgcactcccttcattccttcaaatctcatagactttctggattctgagtctcagaccttgaactacaacgtatgcgtctgtctgtctcctgtggtatgtcattacttccagatgctagtatggaaagtggggaagaattaggcattggaattatgataagtctgagtccaagtctcgactcttccactctccttgcacaggcaaaggaaacattaggtattcaaaaatggccactattattatgtatgtcacttctaaacccacaactgatttatccattctctaaccctttacttttgctgtccttgcttgcttgcttcaaagccaccccttcttgatcctgcatctctgtctcaaccttttatctgatactcacacctgaatcccctgccccagctctgacaagatcatgaattagagtttcattgtagaaagatctatggtgaagagatgcaatgaagtatcaaggtaattcccttctaaatggaaaatgaccatcacaagtatttttatgtcccagtatttcattttagtgagatttttaaaaattccttcaggacatgtaagaggagaaaaaaaaagaaattcaaatagcaaactaagaatgtatggtgttcatttgtaataagcaggaaagttaaatatatttttaaggagataaaggagctaaatcataacatagctgccattcattgaatgcctactgtatgcaatacaatataccaggtgctttaaataagttattgagtttactcgttgcaaaaaccctatcagtaattagcactattattattctcttttataggtgaagaaatttgggcctagaaagattagtctagttacctaaagtcacgtgatctgtatgtggtagagccaagattcaaacttgattttacttttcacggcatagcgtgctcaatgtagaaccagcctgcaagagtttcctcaaaggctgtgtcacaccagggccacatataagctcctgggctattctatcataaatcagaagatacaggctaagttataagaataagttattattatagtaagagtgtatgctatgttaaacagaccattaaaatgataaaattaaataataatcactgacatttattgaacacttgccctacgccaggcagtactctaaatgctttgtaagtatcaatttagtttatccttacaacaatccagtgaagtacatattataattattgccattttacagatgaggaaattgagcacagagagttaagaaacatgcccaagtaagcggcagttaagaattaattctaggcaataatgtaccagagcccacatgtttaccctctatccaatacaaactgcctagttaatttaatcctgtgttctaattcttttgaattctaatataaagcacattatcttgtaaagctttagtttaaaggtctgccacataagcaacagggcctgctcttcaccatatgtgttcataatctggataattccctgatggggatcatttggagcaaacatttcttatggaatgattttctatgactgtgctatgctcaactgccggagcacttcactgctatacctcaatggaatgccagcgaccgactgtctttctatctacagttaatttggtggctaccgctatgctctcaggagccagttgtctatcatatccctgcataccccacacctttagtccactccaagaacttgctccccacagtaggcctgtgagtctgaggttatatactcttattctactggcatcccattagaaactactttctgcggctccaatattccttctttattttgtcacttgggatttcaatcagatattttaaagcttcctgtcctttgagccatattattttagattctctaatggtgggattatacctgtaattttttctgaactttttgaaacccacttccctaagtttagtatatatgtctgaatccataaggctcaacaactcttcttttctgacccaatcgcctacttctcccttgcctctcagactcttccaccttgtttgcaaagtttgtttgcctgtctctaggcaaacctctatattttattggaatgttccctttaccattttgctctggtaaggtaatatgatcagtttctacttgttttgaatagaatgagattgccaacagacaggcagctgttgtcggatttggaatctgtattagcaaagcatcttccttgtttgttctccaatgggatgtctacgtgtagaaccacagtgatgtcacctcacaccttcccctactaccttccaccatgtgttaatcttcaagataatgaattctcctctgctgtgtattttcttgccttagtgtgatagggaccaatatttatcttaaaaggattgatgtaaatcttccacccaaagggtttagtttgctttgttgcagtagtttttacaactaagatgacatattcatgttctggattcaaaaaccttttaatcttgctaatacttggaacatgtattagtacttagcagtgtccaccaactgctttttagttcaccttccacttctcaagggagtgctcagtaaatagtacatgctcaattaataatagttgacattattattattattagagaaaagacatataaagttgcagttttccaagagacaatatgacttagcaggcaaacagaggatattggcgtcttctctgccatcccttttgacaccttacagaaccttggtgagattaattaattactcatcttccactgtccctgaatgcaaaataagggtgaccttatttcagaggaaaggtgacctcttcctctgaaagcttcatgacttaacaaaaagtaagatacattgaatcatttgaatgccaactgtgaagaataaaatattgagtaatgcttactcagttctttaaactattgacctagccatggagttagcaccaagatcataatttctgcccttttttgaagataaaaatcaccatcagaattgccagccaaggtaggaaaattgaagaggaaggttacagtcctgaagagcaagcactcatatgggagaattgggaaaggcaataatatagcggcctcagaagcctggtgaggaacaaaagtataaatgcccaataaccttatctataccacaacatataaaattgggccttggcccagtcactcttagctaataaagaaatttatctttagaactgtgaatattatagtaggactgggatgtgctgcctgcattcccacttcgagactgagcctctcattttcacagctctgagcagagtccttctccagaaatcaccctctgctgagagaagctgcctctcacaatggccatgccccctcgctgaggacagcctccatccatggataggttcagagacttagcctcttgtctcaatgtgatacaactctaaagaaccacccactcaggcagaggctgccgcaccacaggtgaacttctccctctgccacattctgctctgtccccccacaccgatgttgttcctgtggctacttcccaatgaacctcctgcacacatgtctcagaatctcagaatctatttcctggggaatccaacgtataacgtatactacctttgcattctaaggagcaattacaactattttcaattttaagaacatcatcaatcatacaatgatcacagaattcccataactaagtgaatctccctcttgacctttgtgtgggctgcatttgccatgctatgtgatatgtagctagtttctcaagtgcaagtgacttgaatggcccccaaataggggaaatattctgaggtattgagactggccagttaccgtattatacttatgatcatttccaaaacaaaagaaaaagatggcaagtaatcaatactccttggccattctgttgaaggttggtttgtgactagggagactgtattagctcctgagggctaaattaccacaaacttggtggcttaaaaaaacagtctgggggctagaagtctggaatgaaggtgttggcagagttgattcctctgagaccctgagggagagtttttccgtgcacctcccctcgcttctggcgttgcctgcaaaccttggtgctccttggcttgtagatgcatcactgcagtctctgcctctgtcttcacatggtgaactcttcggtgactctcccgtgtggcatctccttgtatcaaaagtagggcaggcctaccctaatggagtatgacctctcacctaatcttaacaaattacattggcaaaggccctatttccaaaagaggtcacattctgaggttctggataaacatgaacttttagaagatgctattcaaccctctgcagagaacaactgaggaaacaaccaagatctgcttcccagttgatacctgtatttgtgctgtggatcttttaattaactgccttaaaagaaaacacagtgacccagatgtgtgcagtgggcgccacccaatgacagaaggctccttgaaggcttaatcaattagataattagtaggaccaacagggagttggtaaagcagcataagtaaaaccagggaaaggatcattacccagactctgaccattaatttttagtcatactgaaaaaaggagctttggggaaaagacagatttgaagagatattttattcactctcatatacttcattttctaaagcaacatgatgtggtagttgagttcacacagtaaaatattagataatttgaggaaaagacctaaaggaatgctacacaaatatatttagtttggccacataaggactccacgtatctcaggtcatgcacaggggtagcaagtcctgtcttgtgagttccataactttgattcctgcaggaagaccccagagacctgcaaaaagcatcctccgtctactaacatcctttctctcatttttccctcttacctgacttgattataaaattaggaaatttaaatttaggaaataatgaggagacagctagtaagcaaagaggcttcccaagccacacacacacacacacacacacacacacacacacacacacacacacacacacacacacaccagaacacccttaggaggcatttctaagcatatccatccataaaatatttttctgtttgctgtataagcagaaaggtttgcatagaatatgtcctttgtaatggcttttgcctctgagctttctaacactagcattgatcaattatcatcttctccacaatagactaatgtttgaacttggaactcagttctagaccagacactagaatactcgtgccatactttcggaccaagccagagagaatgacttcacccaggagagaaagataagaaaagatcttgatgtgtaagcctcctttatttacttgccatcaatcaccaaaacaaagtggaaggaagggaaagggaactattaacattgacccatataaaattgctgatattcaattggttttgacttttaaaaattgcatttgcaagtgattctacctaatataaaattgtatttaaacaactactttttgccagtcactatgctaagtgccttattcttatattattctttataatcctcaatgtaaactttcaagattggcattataatctctattttctgtatggaaaagctgtggcacacaaaagttcaataatttattcaaaatcccataatatttgaacccacacccacttcatgtccagtaaagtcatttgggtctgctgaagtatttctagactttatagtaagattattttcaaactctattgtcaaaattcttgaaattgcaaaggctactccgtctacaaacttcaagggacgtaagaggatggttacagactgtcaagaggatgtctgtggtacatgggattggtaatgtagaaattaggcagtgctttgaatgttactgacaggtcacagcacactgacagcaacagggaagaagatattgtggaaaataagacaacctcttgagaaggtcatctcagtatttgtatcactgatggggtttacagaaaagcagtcactttatccactggcagctgcataagttttaggttgcatttatgtaaagaaacaaataagtaacaagcaagctggcattggtggtttctgggactgaggaagaggagggaaaagaaacccctagggctatagctgtaacatacttactcattcgcacatttgcagctctatgtgtctttagcattctgtgaaagctgatgttcataatgttgatcatggaacatcgagacaatactaaattatgtttaatatagacttgttgagaagcagagaaaaggatattcgttttaagcaatttcgcagtattttttttaataccctaaaacggcaaagttttagctcttgtagagttaatgttcacctttctgggaaaactctgtaatccagaatgacttattctctgagaaatccaggtagtttcatacatgcttttgtaccaagtcatattaaactctttcattcatagttttgtccatgcttttgtacttataataggttgcaactggtataataattacagtagaaagtcatttattatgtggatctattaacatctgattcctcattaagcattaagaatattgccaaatctgcacttttattctttctgctgacagttagttttcacagtgcttcttgatttacttttatgattgaagtttcaggaataaatgttttaatttaatgttccctcagtataacagatttgactaatagtttaataaagggacaccgcaagtttctaatagagagaggtttgcttgtgttcacgagggatgatgcgcacatcttgatgaaggctgcccatgacccactgtgtgctgcacgtgtccgtttccatccgagcatctcagcacagcatttgaagcaggtagtgagaatcccagtcatggccaggaaggatgtgaagggctaacgggggacctggatattttggagggcctcagtcttcctctcttgcctcttctcatccctctttacagaatatttcctaggctgtatccccaatgaacttctatcgatttccaatacaacccatatgtctttgcacctctgtgtgcatgcccttacttctgccagaaatcctccttcatcattctcctggtgaactcctagtcatcttctgcaaggtaaagtccttctccagaacttcacataccctctcctgcctgcctccctccgttactacccccaggactctatgcataactcttccagtgcattcagctccaaattagtcagagttgcatttagcttaaaaggatgcttcaccagagtgggtactgtgcctatgtagcactctgccaccaataattagcacatttaccttttaaaaagaattgatctatcagctgtattcttatggtggccttctacattaatgaatgacataatgtgttttagaatggactagcctgggaagtaataccaagatcttgatttttctaactttcccaatggtttacatctatctattctagattgagattttgtttataactttgagatttaccttgtgcacaatttggaaaagggaaaacaaacatccatttattcataaaatatttcttaaatgcctcagtcttaggtgccagggaaagtctgttctcggcagcatataatgcttacagtcaggtcagattccttgataacagcagggaacaaaaatgggaagaacaggcaggctttccggggcagtgttgatgtggtaagtatgggaagtttggcattgggattagatttttcctaccctgaaaaccatcaataaaaatctctcctcaaggctgaatttcttaattaattcatttcaagccattaacagagattttaaaaatatggtctatgtcctcagatatctttcttttgagttgagcatattcttcatacggaacaaagagcaattccaaagcaaagtgaaaactggacagaatggtgtaataacaatcactgacttactgagtacttactgtgtgctatacttcatgtatatatattactcctttaatcattataataacactgtgagtaaggtatttttagctctactttacagatgaagaacttgaggcacagggaggttaagtgctttaaccaaactcatgcttggatgagagcatggccttgaacccaggcagttgggtgctaaaggttgttctcataaccaccacgttacacttcctctcaatgcttaaaaaggaaaaattatttactcagaagtattgaaagagagtagagcaaagaggtcctggagtggcctagcatgacctggcatggcttcttgcaggtagagagatttaagccaatatagcaggaatggtagatgttggcaagaagtctacgtgaatggaggggcctgaaaaaaaaagcctaagtctgggcatgagcaagatgggaagtgactgatttggcaggcacagttgtctctcacacttaacagtacctttcaaggccagaaaggatgttcttaattttgaaactcatacatcaagtatagtggttaggttgctttttgcactgagctgtggagaaaagtacaggttgttacaaacctaattaagataattatttaatagaaatctattttaaagttttgaaaaatgctaacaggaatcaacttttaaggataatctattcagagtcacctcctattaacagtcatgttattaaccaactcagggcaaagcatgattatataatagctcaagaagaggtagtgttgtctcattttactttctgggacctaaacacctagggaaaaataggtgataaaactgaagctgtcacaatccagcctctttactcccaaagtcagtgccacacaattaaaataactacaaaactcagttaatctagatagtatactataaagataatccttaaatatgggtacatatgagtgtgtgtgtttgtgtacatgtgtgtgtttagttagaaactttgaacacagattgaacttgaaggcatttcagcaaggagagatatttggtaggatatgaaaatgaagtttacggttggaataccttcagaacctcaagtgcagcatcctgattctgtgaagattatgttttattcctttacctattcccacgtgtaatactttattctctttgaattggcttctaatgcaatttaaccctgtttttgagtgtccactagcttaatttcttttattaatatgaattcttctccttcctactgaataaacccagctaatgtgtttttttctcctttatcatttcatgcaaagcaaaaagtaaataaggaaagaatatgattttcgcttccatttttttccccaagcctaaacaatggaatcggagaatctgtttttgaaatctggaatcttagtatttgctgatcctatggaatcaggacacttgattagctgcgagccaagtcatcaggcccacttaatacaatactcagtaaattaattcaattttactgatgtgactaaaaactaaatttcatatcaatataaacacttattaagctgcaaataccacatcatgcaagctgttgaaaaagactcatttttatttatagatgaattctgataagaatagcattagaagtattttagtagggaaatgttagagtgattaatgtgtagttgtttgcatttttaatatttcactcatatatcagattaggatttgtgcatactgtcagaatttattctgttcttgtcaaaatacttattactgctgacaggtataacatatccacattaatccttaattccttgattcaattttctaattgcttttttggcatgcgatggtggccatttagtcttatgtgatgtattcatcatatggtataaaaatgttctttaaaaattagatgtgccatttaaagtaactgagcaggaagaaaaaaatactaaggattggaaattttaaatttcaccatacttagacaaactattagatactggtatgtcacagattctggaggttgtccataaatcatagtcacagaatgttaaagaggaaagggaccttaaaaatcatccaacctacctgttcattttccagttggggaaactgacttagtaacaagcccaggatcacacagctagctagtgggagagctggtctgagtacttatatgttctgatcactagtcagaaatggggtaggtatttgcatataattgttataactggtattctaaattgatttttactattaataggctgacagaatgagagactccttagcttcttaagctgtatgttttagtaatattgtatagtggctgaaaacctagattctagaatcagagttccagtcctggatctgcccctcactagctgtcttaccctgagaatacagtctgaccgctctgaatttcaattacttcatctgtaggaaatggaaaataacagtatcctgctaataggactgctgtttaggttacatacaataatgcatgtaaaaagcttagcatagcacttggcatctagtaagtactcagtaaatgttacatattattattattagtgttttactatccctttaatatccacaatttggagagaaacttggtcatgccttgtcgcttatttcaccatgtgacctctgtgacaacttcatttattcattcattaactctttcacttaccatgtgcaatgcactctagtagttgctataggtaagacaagaatctaacatgatatctgccttgcagaagcagggctatacaacatgtacatcaataagtataataaaacattgggagacataggtcccaaaaaggtggcacaagcaccgtgcttggacatttcaaagagaggaagtgagcataggggatatagggatgaataagaaaccggacctgttctcaaggagcttgatccagtgggaaatagacatttacccagctgttattcaaagtagaaaataaagagggtcacaaaagttaaagttaaagaactaaagagggagaaactaaatatctcagatcagagaaggctttatagatgaagtgacatttgagttggctttgagggacgcataagatcaggaacgttggagacctgtgggaaggatgccttagacagtaggaagattaagagtgaagaaggcacagatgattctgaaaaccctgggaacagttgttgaacagttattaatagcacttaatttgactaaaaaatagagcttgtgcagaataaaggatgtgattagatgagtatgtagggaatgtcattttggactcaagcctcttttgacccaagacatggtcagcacacgttttaagagttaatgtctttaaagaactttctagttagtacccactactttttattgtcttactctagaggataagtcagtcttcctacctattacaggcaatatagcataaagttaagcatacaagctcagaaaatggactgcattggtccaaattcctggttatgccacctattaggtctacaactttatttatgtcacttgaactcttagaccttcagtttcatcatctgtaaaatggaaacagtcagtgtctcatcgggtaggtattgacatcaggcatatagtaagtgcttaataaatgttagctattattactgtgttacccacctgtgccttgaagcgacttagtttacaagttctgctttggaactactgaaaaggtttttgagaaaggatgtaacatctttttaatcttgagtccttgaatgttctactaaaccccacttaaattgtagtgactcgtccaaggacatcagataattctgttaagccctcacctgctggaatatggtttctagtgatgggtctcagtgtgatttacagaagtgaatccctcactcgccattggagagggccagtggaagaacaagtagccagctttacccattgatgttttccaaacgtgcagtgattcatgtagcaggagtttcccaggattgatcctgagctcaaatgaacacctcattttcagaacaaattattaggagttttaagaactataccttgaaaatcttcatgattctagaagcttctctggtaacatttttttctgtttgtaatagctgaaaaatagaaagcatttaatatagaatttttgcccctaaaacagcaacttgaaaataagagtacaacagttttaaaaacactagactgaacaaaagcagtctttttaaaagtgctgtgggcctaatacacagggactgctaattacgtaactgtcagtgatgttttctggcagagcctaacaccagcttcttgcagtacaacgaatatgaaaatgcctagaagtaaatcacagttgctgagtgctgtgggcaaacaaacccaggccttatctctttgaaaggcagcaatggaaaatacatgataaattgcacagctcagtgaacatgttatgtcattgtgaaatgattttgattcatggttatgtagttatcacgaaacaactgccaaaccccagggtatcagaaacattatcatttgtggggttttgctattttctgttgtaaaattcaagtgctataaagagatgtttgggtttttttgtatataaaattctgtattgaaagtgatatttgccacatactctttggaaataatattttaaattatgtgaatttcttccagaagtatcaaagagctgtgctagtaactaatattttaaacagaatgaataattcatatttttgctaatatccttttatgaaaattattttacctaaaatagactaagttgtaagtcaatttgattttttaaaatagaagtataatctccttttatatagcttatcaatatacagaaatttctgaatgttttctatacaatagcagtagaactaagaatgaaagagtaattttttaaaggaagattttatagaagtagcttttatgcaggcataatttcctttccacgtttgagatattctactccactgtccttatttgttgctaagtctctgaagtttaaagtgttaattagaccatattccacctgaagtttagttattttttgttaatttttttctccgttgatgctgttgatgatttgatgttttgaaatattttctgcttgtgttaaaagtggcagaaagatagcctggcaaaaagatcaaattgatgtactactgaatcatttgtcgtttttctcaatctcctaaaccaagacccactgtttctcaacttttttgtataaacatacaattctactgttctaatttttgcagtcgagttttttttttaacatgcctttggatatgctgaatagtatcagttaatacactgagagtttaaaaagaaaaaacaaagaaaagcttgcccgttggtagaaatgattgattgtttcttaggtatggtttttccaatatatcactatcgtttaaaccttgagtttattttatgttctgttagtatattttaatcaattgacctttacatattgtttgcatttattaaattaaaataacttttagtagcctgtaaatatgatttgaaacatttcatagtatttttcttttagctttggaataagacaaacctattctctaaatatttacatcactggagaatatctatgtacttatgctgatttttacttaacattttcaaaaataagtctgttaaattaaatgtaagctttaaagtgtaaaaccatagatcatgtaacttgatacaagtattgcaacatggcttacagcattttcttggaacatttttatgccctttgcttccaccaccatcgccactttcacctttatattgaatgctcccaaaatgtatctatatgaggataattttaaaacatgagatttatgttgctataaaggagaaatcctttataaccacataaaaccattgtcaccagaaatttcagtccaagttttacaagaaagcaggcatattttatctttaatgcctcattaaactttctagaaacgacagtattctagaatattctaggtgaatgactgcatatgtctgtatttcttcttaaaagtttaaatatcatcagtgaaaaaaacctgaacaaatcatttgttctaataattaaagccgtggtacttattcttctatttaattttgcctttcctcagaaatgttgctttgatatatcaaccatgtctcttctatagctctttaaatgatggccaaaactaacattcctaggctaaactgatagcctcactattccaaagatcacattgtgtttaattccaaatttcatatgtggatttgtgtacacgtgtgtacttgtgcatatgtttatgtgtacatgtgtggaggtgcatgtttgcatatgcacacatgtcataagcctgcattgtgtgattaagaatgtgaactcaggaggcagcctgcctgagcttaaatgctagcccaactactgctaactagctatatgaatctgagcaagctttgttaacctcttgcttcagtgttctcatgttacagagttgttgtgggtttaaataagtcaatatatgtcatgcactttgaacacctaacccatagtaacaacttaataaaatactagctattactattattattattatatatttatttactctatgttatttctaaagttatctatacaagtgcattgatgggtgattagtaagtaggtatttcactaaaacaatattaaagatatgccaacctgatctcacatttacatgtggattcttaaaaaaagtcaaagacatagaaacagagaatagaacaatattcaccagggacagggagggggaggatatgaggagatgtaggtcaaagggtacaaacttgcacttatgtaggatgaataagtctatagatctaatgtaagcaggaggactgtagttaatactgttgtattgtatactgaaaatgtgctaagagagtgtattttaggtgctctttccacgaaaaaataggtagctgtatcaggtgatgaatatgttacttcgattgactgtagtaattatttcactatgtatatgtatatgtatctgtgtatgtatatgtatatgtatatcaaaacatcatgttgtacaccctatagacagtaaaaataagaaaattaagatatgccaacagaatattttgaattgtgatcacttaattagataaactatgctatgttatacatcattggtgagaggaaacaattgggaaaaaggaacaaaagttgcataactttgtggctcacaagctgctcgtcaaatatagtgaaatttgttgatttattcaagtgtaggccaagtgcacatccatagtgtgcaaggagctagtgttaaaataacacatggtgtgtcctgaacaactaggaatgtacagcacagctacctaaaggatagataaggtgaaaattaaaatagcaatgctatgtcaattttgcaaacttaaagtgggttttctttttcagggggcacccaagccaattgccattgaaccatgtgctgggaacagagctgctgttctgactgtgtttctttgtctaccacgaggatcatcaggtgcccctccccctgggcagtcaggtatgataaatgaggagccttcagcagttaagcaaaacttgtagactgaacagaagaaataaacaataccactaaatagcgcagtaaggacctttgcaaggttctaatttagagcatggtaaaattttatgagaatacaaacttttacccaactatctagatacctgcattgttataaaggtagatttcccagtgtttctccgaaaaacacatgttgaatatgtgtttatttgtgtattatacacacatgtatgtatgttcccattaattgctggaattacaatgagaaatctcattagaagggccaccatgttctagacccttccagccagcttcctttcttccagtatgtgtggcatgttggaaaccaaattataaatatgattagaaatttgctttgtgaatgtggaaccaaactagggaacgtgtatgtttggaacgttgagtggcatcagaggatgatagcttcacgcaaccatctcagtaggtttaagatatgccattgctttcagcaccagctggagttcatggaccagggaaaccctctgtcttaggtgggcacagccagcctttgttctgattctccttttcctgtaggaaaagcatgtttttgatttcaggataattatacctgtcctcttagagctctgctcattgcgatggtgttgtccacattctaagcatgctcaatgttgaatataaatcatacttaaattacagaccacacttttttctctctttttgcatatactattccatctttataattttgaatttttctgtctcctgattattttatctatccaaccactactggaatgaatgctttttgagggcaagggtgatttcaaatctgtttttctcttcaattccccttaagcataaaataaaatgccagcaagctggcaagttctcaataacagtaattgatgatgaaccggcctccttgcttattttatcttttcttacttccctacttggctttgaatttgctcctcactttcttgacttgtgtccaaccagacacaaaaaatggaaaatgtactactttatgccttgtaaacgttaggtattcatgtaacagaatttttcccatatatgggagcagagagtttccatcaccttcagattcatcattcatggtacctgatgatatcttattgcagaaatttctatccaaagttcatttatggatgtttattcaaagaaataaacattttctgcaccttttcatacattgagtgaatgtcttgttcttttcctttcagcacctccaaggtaaatgggatgcaataagtaaaatagtttggcactggtcagataagatggataattataggtacttgcacagctaatggaagtattgttttaaaactgggatgatttccaaaacaaacacttcactaatgaaaacaagtctgtgtgatatacaccaaggtttttctcgatccttcacgagatgggcagactgaaggcaactgccaattctctgtccctttaacctttgaagtcctttttgactgatatgaaagagacaagtagcagtgtgaaccattacctcagctgtgttttctaacaactgcattatgattactaatgttaatgttatcttagatatgcatagtactttactctttctaaaatgttttttctgtttttcacatgtgatcctcatgacagggttgtgagataggtattataaaactaacatcataaatgaggggagtgagacgtagaaagcactgtatatctacactcaaggaataattggggagaggggatactagagtatagagcaaaagaataaaaaatacttactgctagcattccaggtaattgttcctgatgatttgtagcagaaagcctctctaaaatcaacagcccatgtctttacaaaagcaagcatttggatgaatactgaaaatgtctacagggttgatagagctagacaaaagattgaaatagcttaccatactttttacagagcctgaggatgaaactatgatgagtatctgcgtacataattcagaatgagcttgttctttgttttctaaaaacaatctagtagatttttcaagctcttagaggagtaagacagtggttctactctttaaattgcagcattatctgttatctgcatcaatttggaagatgggtaagaggggtagatggactgatatgtcataaagcaagtaaagtaaaatgttaatggtaggatctaggtgctaggaatactgatattcattataaaattcttttaactttgatatatgtttaaatatttaataatgaaatgttgggaaacaataaaacaaaatgtcttgatttcactgcaagaaaaaaggcagtatctgtagagaaaaatttttccaatatcatcatctaggttttcccagaacaaggcaaatactgacaccaatatatgaactaagtgactatttttttcagtgctcgtccaaatatttagtgtatgcacagccaattaaaacttcacatatttgagaggaaatatatcccagtgattatttgggaaccatattggctcttgggaaccaaatgctgacactggttatctcattgctgaagtttggtttattctgtgtcttcacagaaagtccttatatatgcctgtgcttatcccagtgccctacacatagaaatcagttaataaattattttgataatgatgatgacaatgataggagacttgggaaatgtgacctttagcaaccacttgaatctgttagcttcagctaatttcagtaaaatgagcaacagagttcaaattcatttaccctttcccagattcctctcctagaagccctctatgttctcttgagcctcctccactatttgtgcagggtgacaggttgggggagttgaggaggaggtagaggtggagctttgttggcagactcctgaccccaaccccactgtgtgaaggacagggtgccaggggtcttctcttggctattgggctatttatttctccaaatgttagtgtatctgttcagttattaaattagcgttcattattaagagtcttcttatagattaaaagtcttatagtactttgcataatctcaaatttttttgtcaggctccttgtttgaaatgtagcttactaaaattttttttttatcaggctccttgtttgaaatgtaacttactaaatgtcagtgtcatgtgtactctccgttggcatgaataagagcatttaagaaggatgagcttgaggatctgcaaaggcagaagcatcctatgagcatggtggatttctctcacacagtgaatttcaaccctgaaaatgagtgacagaaatgcacaggagctagtttggccatctcttttcaggagcagctagtgattttttttttttaatttaaaaaatagcattatctttggacttgattttctttccaccagcaactgcttcagcaatatgtggcaagtaatgcttagacatggccattttagtttctttctgaaatgtgtgaactcccttccttatggatcttgtcttaaccagaggtcaaaagaaaaactgtgccaactcatcccttagattacccatgcactaatctctttttaatataataaatttaggtgcttgggagaaattctccctttagggggcttagaatagtaaggcaaaagatattaagtaggctttttggcattcctagagctgggctaattaggtttcctgcttccccgcccagtaaacctgctgcttcatttctgtattttctgtgagcagccactgcaatccgtgccagactcttcggttaaggtgggatttatgctgttgtttatgcatatgttcactgtgcagccactttgtcttctgacctcaaagtggttgaaagattgacatctccatgaaaacaggacacattaagtaactctcctacatgacacttaacaaccaagcatgtctccagtcaccccggacagcatggtccccaagcgttttagaggcacattaagatgaaatgtggacaaagtaaatagagctcttcagatgcataaattgaaaatgataatgattgctgtcactttgtgatggaagattatggatttcataatttgtggattcttcctaatgagaagcagattaacttttctcactgaatcaaaaatcccaatggcccaaatatccactgctgaaaagaagctatgtgctacaactggaagtagaattttgccatgatcctgcctcatatatgattgactataccattaccaaaagaatactgccagaaagtctaaggttttgaaattctgaagttttctacgttagccttagaagtttgggcagaatgattagattattttgaataatctagaaatattacataatgtttaaaatgatagtttactcatggtgtcatggatgtctttcttgtttataatgataacaataagataactttggtttaatttaatgaaaagaggaaagggaaagaggaccaggcattatattaagcgctttatgtattcattggtgtgaccctcttaatgattctgtggagatgattatcccacttttactatttagaaaaccaaaactctagagagattaaatgactttcccagggtaaatgcagctagtgagtgagtgagccagaattcaaacccagggccactggctcctcagccagtgtgactctccctcatcactgtgtccctgtggataaagatactggggcatagcccttattcctaaaaaagctttaaatccagagtcaaggaggaaggacctagagggtctctgctgagcagtgggcttattgtagtaaggacaattttatctttgccggtgacttcagaaatttggtaaaatgcaaatctgtgcatgccgtggcgcatctgctcatgaaactatgactcggtgtatgtaataggaagaagcccgtgaactcataggaaaagaaattaaacttgtatgtctgagctctggacttggaatcacaagccctaagatctagacctagctctgccactgactagcaatgtgaccatgggcaagtctttcagtctctgggtcttctattttcccatgtgaaaaatgatggggtcgggttagattcctaggatgcgtttcactctaaccccactgcacagtttaatactacaaattatgctaagtcatgacagtttggggtggggagagcaaataacttgcttctgagtggtaccttgatttatcttttcagttgctcagagccattgggaaacttaattttcatatgtattattagtgactaaaaataattagcattgctccttacatttaaaaaaatcttaaaactgtgttaatgaaatcttcctagcatgtttgaaagatgtagatggtttatagtgcccctattttagaattgagtaaaaggaatctaatactaccagtgagaggtacatttcccataatctcagagatggattggaaatggactccgggtctgctggctcacagtgtagtactttctcctctgaacacagttttttaaagcaaatttccagtttctagcagcctctgaaatttctattccttcacactttgtttttcttttataattctgccaccatatcttcacacttgtagaaacacatctgttgatataatcttagcactttctttgttagaggtggctagaataagaaatagaactactgaattatatcaaaacttcattataaaaatctggcatgttagttaccctttaacctcaaatacaaatattgtttataggcagcgtatgtgtcttcacaaagaagaaagaaaaagtggcattcatggtaaaataaactagaaaattaggcagagagcccaggaaacaacagagataagaacaaatatctgagattcttgttaataaatatgactccgtgtcaaaaaatatctgatattaaaagactttaaaatcaacagaagaaactattttaccttgtatccaaaatacagttattgtgaatccccacttgctacccttactcattcaagaaacgtgtaaaagtgtctattatatgacagcactggatatactatagtgaaccaaacagtgttcctgccctcatagaggttacagcctatgcagagataaacattcaacaaataatcatgcaaataaactcatacttacaagttgtgttaaagtgctatgaacaaagaatagagagatgaaataaaacagatggacaattgctaagtttaatatttgtctacagcagtaatcgagtgataaacatagtcattaaaatgccctttcctcaattctcgcatctctgtagtgtttgactgtcgattattcccccacttcacctccccaccttctggaaaccttcccctcctctgttgttttgtgccttgacccatcacaggtacccacttagaattcacttagtggcgatggctatagagcacctcctttctgtgcatcctcagcttcatctgccccttgcctacaggcattcccccaggtctgatccttagccagcttcttttacctctccactcacttagggaaaacttctctgcagctaactgccgatcctgtgggtcttcagccaacacctctcacctgctgagcagcagcatctcaacctggatttcctcccgttcagatgtaaagtgagccgtccttccccctttcctctgtcacttcccaccattccccagaccagctcttctctcctgacttgtctgtttttgtaaagtctgtttcagaatggctcaagtttgaaaccttcaaattagcctgtcttctctctctttgtgcccttttacatctcagtaatcgtgaagttctatagattttatccctggagcggacagagaagacatcttattttttccattcttattccctccatgctttgttctgggagtggttgcttctcacctgggttgctcccaaaggaaggcacagctctaatcatatcgcttcctcatacctttgcagacttttcattgcctgttgaaataggtccagacgtttactctggaatgaaaggtcctctctgacttctcctcaacttctcttccaggtttagcaccctcagagtcctaagcctacctgcacagcaccactggctacatgggggtccttggacaattattttaaactctcagacctttagtttcttcatgtataacattagaaaaatgactagataaaatatctttgtgattgctgctaggcctatcattccatacatatttttcttatgattctctgagtgtaggtgtggtctgtcatactgctgtttcttgtacccgaaatcccctgtgttaggctgcttattttcaaagcctggttcaaatgctatttcgtcttccttgagaccttttcagtcccttccatacaaatgtgacctcactgtcttgaaatcccacaccttctaacatatatccatgccttctaacatatatcagagttgctatgttcttttcttttttccccagtagtaagctctctgaaggcagtggcaatatcttatttcatctttgaatccctagctgctaacaagtttctggtacttaatagttgcttgataaatatttaattgatgaataaaattatctttaaattttggagactcttcaccaaaaaagatgtgcaaaagatgtatactccacaaatgtatactttacgatgtaaagtttcacttcaagcccataacctcgatagactggattttgtgtttttataattcatgtaggatggatcaagctacatatctcagggaccgaaatcaagcccaaaactgtactttcaatggattacatctatgaaaactaacttgtttagctttaagtttcaatgaacatgagaatattagtgaaagatgacacaaaacaataaagcaatttatatttccaatgtagcatgtctgaaacctatcatagagatcttctgttttcatgatttgaacactgatttattccttggatagtaatttttttaactattttatttaagtttgaaagagcccaactcaattctaccctttatgaccagaaaaataaattactttgaatcttatggaaatgtccacatattagttatactcaggacagataacctcacaaaagataactggcaaataaaaagcatcaattgttggtgtagtcattaaaacatactgtttggaagaccaggcacggtagctcatgcctgtaatcccagcactttgggaggccgaggcaggtggatcacctgaggtcagaattcaggactagcctggccaacatagtgaaatcccgtctctactaaaaatacaaaaattagccaggcgtggtggcagatgcccgtaatcccagctactggggaggctgaggcaggagaaacgcttgaacccagcaggcagaggttgcagtaaaccgagatcgtgccattgcactccagcctgggcaacaagagcgaagctccatctcaaaaaaaaaaaaaaaaaaaaaagccatacatactgttcgttgtgaatctattctttgcaccatgctgtcctttgagttactgtaaccctatagggcagcagtccccaaccttttggcaccagggacgggtttcgtggaagacaattttccacagacctgggggtcagtggcaggggtgatggttttgggattaaactgttgcactacaggtcatcaggcattagttacattctcacaaagagtttgcagcctagatccctcacatgcgcagttcacaatagggttcgtgctcctttgagaatctaatgcctccgctgatccgacaggaggcggagctcaggctgtgatgttcactcacacccacccattgcacaacttctgctgtgagtgctgtgaggcccggttctcaataggctacaggctggtacatgtatgcagcctggggttgggagcccttgctgtgaggtatatgcagttgacccttgaacaacatgggtttgaactgtgtgggctcatttatatgcagattttcttctgtctctgccaccctgagacaccaagaccagcctctccttttccttctcctcctccttctctgcttactcaaaaatgaagacaattaggataaaaatctttataatgatctatttccacttaatgaatagtaaatatattttctcttctttatgattttcttaataacattttcctttttctagcttactttattgtaataatacaatatataacatatacaacatacaaaatacgtgttaatcaactgtttagattattggcaaggcttctgataaaaaataggctattagtagttaagttctggaggagtgaaaagttatacagggactttaaactgcacagggggttggcactccaacccccattttattcaaaggtcaactgtgttatcacttttcttttatatatgagaaaaatgaaccatggatattaagtaacttgcctacagtcacatagtaaataattatggagtcagaatttaaaaccagaaaacttttacatcaaaatgctctttataaatgtttttgttttgttttgttttttcatttcttagctatgagtaaagaccattagctgtttgtgttttgaggacagcacaagctttttcttttactgaccagtgtcactgtaaaatgacatggtgatggtccttccatttcagacttttaaatatatctttccgtcacttttgtgagaaattgattaatatgtaaaggaaacaaaagaaaataaggatgagaagcttaaagaatagtgaaaatggctaattaaacatgctgcagaaaagagtcaactttaaaagttaattcaaatactttaaagactgaccaattagaaacaaactcacatgacaaatcaggattcatggaaatgaaaaatgagaccactagcactgaaacgtgaccaacacatttttcttttcttttttcttctttcccacctgccacctctttctggtatttctggaattcactgttaataattactgtgctcaaagagaaaaacaggaaaaaattaaaactcaacaagacaacttacaaaaccaaagaggaaaatcaaaatgtgttgcaatacccaagctgcctttgaagcaacaaaacaacaaagcaagaatgttgtgggtgtgaatacaatgttatgggtcaactattgtgaaagacagtatggtaattcctcaaagatttagaactggaaataccatttaacccagcaatcccattgctgagtgtttacgcaaaggaatataaataattctattataaagatacatgcacgcatatgttcattgcagcactgttcacaatagcaaagacaaagaccaaaatgcccatcaatgatagcctggataaagaaaatgtggtggtatatatacaccatggagtactatacagccataaaaaggaatgagatcatgtcctttgcagggacatggatgaagctgaaagccattatcctgagcaaactaacacaggaagagaaagccaaatactgcatgttcttatttctaactgggagctgaacaatgagaacacatggaaatagtgaggggaacaacatacactggagcctgtcgggggagagaggggttgtggagagagcattaggaaaaatagctaatgcatgctgggcttaaaacctaggtgatgggttgataggttcagcaaaccaccatggcacacgtttacctatgtaacaaacctgcacatctgcacatggacctcggaacttaaaataaaataaatgttaagggtaagtttgtgaggtcctccatttttttttatgatagctgacaccatggtttatataaaactgccaattggtaaaaaaaattacttttaattggttatgaattaaatagtcctactttacataggtttgggagaatttaacagaagtttgctgccttcattacctcgggctgctataataaaatattagagtctcggtgacttaaacaacaaacatttgtttctcacagttctggaggctgggaagtccaagatcaagatgcctggacaatttggtgtctggtaagggcccttttcctggtttgcagatgatcacctatagctgtatcctcacatggcagagaaaaagagctctgatttcttcttataagggcactaatctcatcctgaagctccactctcttgcccttatctaaacctaattagtcctccccaaaaaccccccacctccaaataccattatattagggattagtgcttcaatgtatgaatttggtagaaggtggggcacaaacattcaggccatagcaggcttcttctgtagttaaaaagaatggaagggttctgagtctcagaatgactagaaccaaggtgtctggatctctcaagcagggagcgagagatccagagaccttggttgtagtccctgctcatattacccctccctcatatttattgtaacatgttgcaaaacctaaccagaaaaagaaaataatataattcacctcttaccagcaggcagtactgcacaattctgccacacagagcccagaaaaggcaggcagaagggaactccctagatccagaaaggaaaattaagtgacttgagaaaatatgtaaaggctaagactgggtaagtggccctgcaaattccttctagtcacagaaacatttttctgggggtcacctcatagggccagtggtccgtcagcaaatccagaagtatgttcaagttttgatcaaaactccatgttatactgatagctggtttaatctcgggtcctcccacagactgtttaatggtgccatagtatctaccaaaggcatttttgagtatggatgtccccttactcttaatggaagtcctggtggaggagcaagtgccagcagtaaaaatgtaattctataaaaggtaaatgttgattacaattatattaactccttaagaccacagtgatctttctctaagagcttgtagggaaaaagttaatggccctctgaaaagagagtaattcatttccttttatccactttataatttgcaaatttgcaaatgagcatagcccatgcaagttgagcaggcttctctcactgatgggtagcatatccaaagctttcatgcaggtaaaagcactggaaaaaatatgagagagttcatcttcttccttaggagctgggactgaaactggtccacaggacttcagggaggtggtttgaggaatcctacatggtccctgggatcatcatttagaagctttgagggaataaagattcttgttctctgaacctgctgtctgatataatttgaattgaaccttgaagcccctaaaaatctggatgcagtgaccatacattcagttccatttattcaacaagccaggcaaggatcatcaaatcaataacatgactgtgccatctgccttccctttgctcaccatcacaatgaaaaatgactccttaagtgttctgcaaggcaattaactctgaaggcagagctgtaatggagagaggctgagttacatttgtattcagaactttactggtaaaatggaaaggaagctgttgtccatattaatagatacataaaatagatacataaaaaaaaatgtataaatgggataatttggtattactctatttatgcataatattatacaactgcagaaacacagagctaggaagggcactgaaatgacatatggctcctccaactgcatgcagccacagctggtgaccctgtccagaatcatcttggacagacagactgtttctaaagacattcccaaaagtcatgctgataacttccgggactaattcattctgttatttaacagtcttcactgcaatttgattccattttcttttgttctctttcttcttgttctcatctctctagaaatagagaacagctaattatgctccctataataatccatcatgtggtagaaggcagttttgaaatcaccacccagccttcagttcaggttcaatacagcactcccagtccttccatctgggcctttgaagagcctggctcctagcctgagtcatctggtgactctcagaatgctcttcaaccttcccaaatattattgattcaagagacatgaaatacaaagggactctgtatttctgtttgttctggtaccctctgcaggtaccattgcctctgcctagattgtcctacccatcagcccctctccgatatacacacctccccttttgcaccaagagaatttcgaattcaaaggtcacctctttcatgaaactagtccccatgtttacccatcctcagtcctctgctttgctttttcatttactattataaaatttttcttacgctgtctccgtcccacccaggcgagctaagggcagggatgtttcccttattatttctgtaggggctaaattgtgcctacaacatagtaaaagacaatttgcttaattatttcccccacttttcttacctgtgcatgttggtgctaatgtcccagagtccaactcttaagctagctgtaaattcacactttctactgccctttgtcatgtaccttgctataaattaattatagatgcttctcaggttttaaaaatgataaaccaccctaatctctggcctgaaatttggcttatgaaaactttattgaggttaaatcagttccttactactaactaggcctgttgtctcagccccatccttgtgacctatttgtctcaagtcttagtagtcatttcgcaatacatgattttttctatgtttaacaaatttgtttcggtcttttgttatttttttccagatataaaaatatcactttgatactctggtcattcataagatcattgtttgatcatttttaacaccattctttttccttttctcaaaaatgaggccaggagcagtagctcacacctgtaatctcagtgctttgagaggccaaggtatgaggatcgcttgaggccaggagtctgagacaaacccaggcaacatagtgagacccccatctctacaaaaattagaaaagaaaaaaaaataatgtttcatagattctttattctcagtgctttaagcaggatcagagcccttaccacttttcttgatgacctgggtatgactcaccagactctgcttctgctccttggaccatccatttatagtttctgctgactcttgctaggctacctggctcctgtatcctttgttgtggatttttagatcacagttgttctttaagactgaaatttttcaagcactttgaaagtctctttttaaagcattatttgttattagtattttctgttacatataaaaacaagccaaatttttaaacttattgcctactgcattacaggttatattctgtttccctttatgtttccagtggatcactttagtcctcgctttattgcttttcaccttccctgatgcttcagaatcatcatgttttgtcagcttcttaggtgacttatagtcttgtcacagcactcctaagttccattttagctctttgtgcagctcttgcctgtccacttgaacttcccctcagccaacttttttcatatgcattaaaagtatttctcagaaatgcaaattaaaacactactgaaatactatttcttacctcttatgttggtgaaatttaaaaagtgtggcaacctagtgctgggaagaatgcaagctggtacaacaaccgtgttggaggggaatttgacaagacctaacacagctacacttgtactcttttgacccagcagtcccacttctaggaatttaccctaaaatacacctccagcaatatgaaactacatatgcatgagttatttattttagtacttttttgtaatcacaaaatgttggaaataacctgaatgaccatacatagggaagcagtaaaatgaatttggtacatgcataaatggaatacactgtacctgtaagaaagaacaaggaagaccttgagaaactcatatgaaattatttccaaaatatattaagtgagaaaagtaaagtgcatacagatatctagagtgtctgtccctaaagtaagaaatagggactataaggaaatctacaaacgtctactcatttttgcaaaagatgtaaagaaagataagtcagaaaccaacaagactgtttacctacaggaaataaagcgaaatggggtataaaaatggagcaatgagagggggagttggagggacacttctctgagtacacttttgtatataactctgacccttagaaaaaacctgacctttcacctacccaatcagttaggatgtgggagaacccaaaatgaaatacgaactgtaaaaaatgaacctaaatgtattcaaatgaataaataactatgctgggggtatagggaagaaaagagcaacctaagtacctttagaaaatgattattttgactatatactgtaacaccaaaagcaaccaaaaatatatatatgaatgtactatagttgtatatttgtttcttctacaaacaggagcatggaccagcaattctgacactatttaatgtccatgctaggattgaacaaagtaaatattttctgggtaatgagagctagttttctcactgtcagagaaaaatgatacatatgaggaaagtgagaagactagaatgaaccctgtggcattgggttggaattagagggatcagtatgagtttattcactgtaggtggatgcacatagaaatatagatgtatgcacgtgtgttggtatacaattgtatgtttcttaatgctgcctgctgagaggtcctagaagcaatgatatctcagtagcaataaatgtacttagcactcatctcttggttttttaacaccattctccaataaaatgaacaaggacttttgggtatatggttgattccagggctaagaagggccaaccacaagataagcttggaatatctaatggttccagaaaataagtactcaaaaaattgtgaagacatgttaaaaggacttaggagccaacctgaaggagcagctaatggccaaagttggaacaactcgaacaaagtaaataagtatagtattggattattactcaataaatgtatgatccatgagtccacactgaaagattgaatagataaagaatagatagttcgagaccagcccggtcaatatgataaaaacctgtctccacaaaaaatacaaaaattagccagccatggtggcatgtgcctatagttccagctattcaagaggctgaggtgggaggatcgcttgatcccatgagattgaggctgcagtaagctgagattgcaccactgcactccagcctcggagcctgggtaacagagtgagacccagtgtcacaagaaaaaaaaaaaaaaagaagtgggagagaagagagcagtggtttcttatagtagaattctaattaatggatgtagaaataagggaaatagaaaaatcaccattagacaaataccacagtagtaattgttaaaggtaagaaccattgatgaaatctaaagttaataggacaaaacacattgtaaaacaacacatttgtatagtcagagtatcttcccacaagacatttattgattacaaaggggaaagcagtaaatttgtaataaagaaccctagcagacatgacttatccaaatgatcaaggtcaatatagctagtaattaaacatatagaaatcatatgcctgctgacatgttgcatggagaagagcaaaatatcacttctgtggtattcttcttaaatgtgtaacaccaatgtaatcacaagaaaagaggccgggcgcggtggctcacgcctgtaatcccagcactttgggaggccgaggtgggcggatcacaaggtcgggagatcgagaccatcccggctaacacgatgaaaccccgtctctatgaaaaatacaaaaaattagccaggcgtggtggcaggtgcctgtagtcccagctacttgggaggctgaggcaggagaatggcgtgaacccaggaggcggagcttgcagtgagccgagatggtgccattgcactccagcctgggcgacagagcgagactccgtctaaaaaaaaaaaaaaaagaaaagaccagacaaatccaaattgagggacagtttacaaaacaaaaccaccaaaactcttcaaaagtgccaaggtcataaaagacaaagaaagactgaggaaataatacattggagtctaataacatatacacgcaataaaatcctgcattaaatcctggaccaaaaataatatataactgagaaaactggtaaaattcaaatagggtttgttgattactcaataatagtatattaatgttgattttccagtgttaatcattgtactctggttatgtaaaatgttttcatttggggaagctgaatgaagagcaaatgagatctctgtactcatttgcagtgttcctgcatgtctaaatttatctcaaagtaaaaagctaatagaagtattttgtcaggactcttttataagttggtcatattccaaagttcaatctatagtttacaggctctattttgtcatagaaatcatatttatttcattatatggttcctgggccagcctcaaaagcttacttaacctacaatttttatatatgtatgtgtatctctatttattaagtagtctcactgtattcttgaacataacatagtatagccatgttcccattatagaaaaatacccctatcttacaggtaaagaaatgaggttacagaaaggtttctttacttgccccacattttttattttaagattttagagcaagcaagttgcagacctgattttagagccaggtctgtgtgacgccgtatgctgagtttccctgctgaggtatctgaggctttgtctgctaggccactcactcacacattagctgctgaaaaggggcaaatcttatggacacttctgtgctgtcctctggaatctttcccttgattctttttcttttcctggattgttgaacaaaatgttcatgtttattttgttcatgagaattgccttgtttttagaaatagtgacttttaaatagtttgtggattttttttctctaattctgcctatcattttaaaaccatgttttatagataaatcaaaaagtgtagaactcctaatgcagcatttggagcaaagttaataaaattttaaaacaagaggatatatatttactaaattacactgtgcttataatgtgctgccatatttttgttaaaattttttaatgctttagataattaagcatctcaagactataatattaggctaagaagctctttcccattaaaatattcataaattatgttgacacgaacatggtgttctgaacaattataaggagtggggctcctaatgcaaatgtcattcctattatgactttttctgaacttagaaaatacattcaagtagtctatggaactgtccaaaagatacacagaaaccaaaaccaaaacaaacaaaaaccaccatttatcaggtacttactgtgattcagtcactatcataaaagtattttcttatgttttctcatttaatcttgcagtaactctgtaaggtagatactactgtgtctatttgacaaattagcaaaatcaaagttcaaaaacctaccagtagttagagagttcataattgacaggaccaagatatgaacctagtttttgtgtctactctacagtttatgcctttaatccttgtacagtactctagtgtttcctgacaggaaagcattaaatacagcatagaaaactaagaaggaaaaatggcaccaacatgaaatatgttaagcttatatttaatctgctgttttatgggagttttttttaaaggagcgagaagaaaagctacaagggattttaaagagtaattcaaagatcaaacatgatttttatcttttgtcccagagcacttcagattcaaacccaaggcttcaccgctgctgatgcacatccgcctctgagtctcgtaattggtaaatttacatcatgtgtgtcaccagcagcttaagaagggaacagatgtcagttttaggaaatcctgtgaatttcaggcttgctcagactaattggtccaattgataaaatgctaatgagaaagtaaattcaaacctttaccataataagtctgaattctgaccagtaaagatgaatgtaactgcctttctgaaattcctatttttcacagagtaaaaaacatatttttttctttaaaaaaataaagccatatttgtcctttaagaaagtgttaatgttgagctggtaatgtaagaattacctagaaattttaattgaaaatattaactgttttatacaattaaattcattttttggatttctttttttagagcaatagaattccatgctgtcacttgttagatttaatgtcatcttgataacacatctaggaataccaagcaactaactgcttaagcattaacgttttttccatgtcatataataagaggaagtttccatttacttataccatctttaatagaaaagaatggtacaagtcaaggtcaaagtctccttactggaagcagcagcctggcaggctgcttaggggtcctcatatgctttttcctctcactgaagtagtcctctttcctctcttccaagttcagtgtcattagcataacaggatcagacaactagagttcatcttgttcagccctctgtcttgtgccgcttccatcttatattttttaacatagccacagattgggaacacacagtttctcacagtaataattccacatcttatttccttttagtgtttggaatgtggccaccctgtgaatttttttttttttttttaattttttgagacaaagtctcactctgtcgcccaggctggagtgcagtggcacgatcttggctcactgcaacctccacctcccggttcaagtgattctcctgcctcagcctttcaaatagctgggatcacaggcatgtgccaccactcccagctatttattttttaatttaatttaatttaatttttttgtattttagtagtgatggggttttgccatgttggtgaggctggtctcgaactcctggcctcaagctatccatctgcctcagcctcccaaagtgctgggattacaggcttaagccaccatgcccagcccatgatgtgacttttatacaaacatagagcttatacattgaattggttgctgcccttttcaagactgttaccttggaaggtcaaatgtatatattcgagtgatatgcatcttagtattttaggtaagagaagactctgggagttacaacttattctagctcctttgccttctctttcatcttcttccaaaatttcttacattaccatctattattgccatcttcatttattccctagcccattgtaatctgacttcagtactcacttctgtattaaaactctcaccaatgaggttacccgtgaccgccaagtctcttaatagggacaattgggtgcactctcattttctccaacccactcattaccctaagagttatcatctgcctccttaactaaactaagagcagcatggaggcgagggccatctttctttatcacagtatcctctatgtccagcacacacctgatatcacagaccgtcaatgcttcactgaatgaatgaatgaatgcatactctctgcctctcattttacacacagagacacagaagccctaaagaaggcatgcagttcgcccagggtcatacagctgattattaggagaaccagcatgtgacctcaggtctcctaactcccaggccaatgccaatgggtttcatataatactgatgtggctcaaaagaggtttcggctccttttaaattgttttcaaagcccacaatatattcttttgaatatatctggtggcaagtctttattctttttttttttttttttttttttttgagacggagtctcgctctgtcgcccaggctggagtgcagtggcgcgatctcggctcactgcaagctccgcctcccaggttcacgccattctcctgcctcagccgcccgagtagctgggagtacaggcgcccgccaccacgcccggctaattttttgtatttttagtagagacggggtttcaccatgttggccaggattgtcttgatctcctgacctcgtgatccgcccgcctcggcctcccaaagtgctgggattacaggcgtgagccaccgcagccggccaagtctttattcttttaattggtggcttttatttttggaattatcctaaagctaccaggacacacaacgtgtttcacaacctataaggcattacaaaatctgcaaaggggtattaaaagagctgtccagtctacttttagcctaaagaatttaaggcctcatagtgggagcatgattagccagagcaatttgcataaaaatatacaatgggaggctttgactctgttctcatctgtagtagccaggaatccccaacattagtgggaaagagctaggctccttgggcagtcagatatttgtctacatgtgtgtgcctgtgagtgcatgcctgcatgcacaggtgctgtggacaggggaggtggaagaggggccaggggtgttgggatattccttctgggaaaggaggactcatttctcttctactgttcatttccactcatctcccaccaccacacacaaacatatgctagtctcccccgtagctcatggctatttatgttttataggttgattttctgattataaaattaatgttttcattgtttaaaatttaggaaacagaaacaaaaatcttacaaccccgagataaccaataaaacacatattttattcaggactttagacatatttggatttctttttacataagcggcatcattttttaatgaagttctgtattctgcatttttgctgaatgttataaaatgagtatttctccatgtcattaaaaattattcagcaatataattttaatgactgcatattgctttttatggatgtatcataaacttcctaattattctcctcttcttgggtatttatgttgttcccagaccttttttttttttttttttttttttttttggtgttataaataacgccatgaaaaagatttctgggtaaaacttttgtccacatctctggttatttccttgggacacattacttgttctgaagctagtatgtatgaaccatacttaggtttatcaatacatattgctaaattgtttttcaggaaaattttaccaacttttctcagccaactgaggtattttgaatatcacaaaaaagtaaattatggtaaatggccatactctctccctaaggaaaatggcagtgggacatagcaaggcagtcagattttccaaatcaaggggttgatcacaattgactagctattggctcctgcctttggcaaaccagaagcctggcagaggcctaatagaggaagagtctagcagaaatcatctgaaattaagataaggccatccttttgcatatgaagggccaggtagcaaagtataccaatatgtagctagtgcttttggaatatgcagtttattatttgacacatacctgcatcctaaaagcatttgaggtaagcactggttatctgggacccaactgctcctgaaggactaacccctgaactccccagcctgcataactaagtaaccagattccaaagcagagattattatcctcatattcagtgtgacctaaccaatccatcttgacattatttctgataatatcgtgcatatctttatatatcaatcaaggttttatgaaacgcagtaaaacattaaaatggctaagagcatagactctggagccagactgtctgagatttaattcctagctctacaatttagtagctgtgtgatcttaggcaagttacttaatctatctgtgccttagttttctcatcataatttgaagataataatagttcttttctttatagttgtcatgaagagtaagtgagttaaaacatataaatttctaggaacaatatcaggcccatagtaaatgctatatacaaatttcctactattattatttcgagttgctaagaattaactttagcagaggaagtaacattagataacacaaatattttaaagcaattgcttgagttttgggaataaaaggaatgctttttttcaactaggatcccaataatatttcggttctgtccttgaaaagtttttcttttttttatcatgattgtactcagtaaacttttggatctctcagacatatttgaaagcagtgtcttatactggggacaaggaccattagcattaccacccatctgatactttcccctttacactaaggcattattcccataatcttacaaatttcccataatcttacaacccagatataacaatgacaatgacaacaaaaggcatatttccttttaggacttttttttttttgccatagcctttctcttagattcatctggataaatctcactgataggttgaggttatcagagtgtgtctagaatttgacagtaccggtcctagaaaggcctggtcagattctttgtgtgtgtgtatatatatatatatatatatatatgacttttgacaatgaaccatttgaaatctaattccactgcatgatccagatgaataaataagctaaatgaaaagcatccaaggaaaggaactactcaaagaagcaggaactgcttgagcagcagaaattgacatgaccatggacatgagggtctataaactctgggctatcatggataattgaaagtcataattttccaaagggcttaattgaatatttgaaaatttgtatgaaaataaactgagtcaactaaataataataaacacagctaaactaaacaatataaatcttcaaaagaagaaccctaattaaaaagatagattgcacttcctggactttgccattctggttgttttcaatattatgccactgggaaaatacaactgtttctaatcaaataatttaaactcccatgctggggcttaagtgtgtgttctcccatttttctcttgctacttgttttggggataaagcagctcaaattattcagacaccaatcagatttatcatcctgtgccttttgatgacatccatctgtttatctaagaagccattaaagacttattgagttacagtgctatggagaaaattgggttatcatctatggttaaatccaattcttgcatctgccatcttttcagcttatgtggtatattctgaaattaccgggacttgcagacctgcactacaagaatacatttgcttcctagcctttctatgtcatttctagagaatttctaatgtatgcacaatttgtggttcaggaatatgttgacagaaagatgtcagtgctttctgttgttaaaagttcaaaagcctaatagagactatgccagcttaaaagtcttattcagaagtgggtactgtccaattccaacgtttgtgtttagactagcctattcaaaggaaaatttgactctaggtcacaaaggtagaagtgtgttaatcagaagataaagataaattaatatcaagtcaaaattcaaacggacaaaaaaagtgagagctcatcacaaaaggtgttaaataaacaccagcaagtaaactgataagacacaaaggatccaatcttgctagggaatgactaggtagaagtccagtgcttatctcacaagtcaagcagcttaagcaaggctaaaagtcatgttttctgagctggtgaagaagcagtggactgtgtggagaaaactaattgaaataaagtgaatatttgcagtttccgggagatactgttatatcctgactgcaggagccccagagaaagagcaactgtaaatcaggcagatgcttcagtttgccaatttttctagcatttgtcagagaaataatgaggaacccatcaggaaaacatttccttgatttgtttatgtaaatcaggccagaattctgggaaacccaggttttctgggaatcttcaagaattacagcatagctgctcctcctgaaattctagctgaacacactatttattgagcatttaagaagatctttccgatcatatttcagtttcctttctttgttttcctcatagtaaggtaagtaccctgaaatgggagacgatagccgtgcgatagctgagcataatcagttgagatctacatgccagatatggctggtttcagaaagatattcatttgtctgtctacctgtttgcttcctgtgaccttcatataacttctacctgtactgtcagcagagatgctgtttttgtgtcactggtgatgccacagtgaaagaaaaatcttgccaaggcaaggatgacaaggaaccaggacctagaccctaaagtagcaaatattgtggggaagagtctcctgggagtactctttcacaacctactaaattcatccaaaagtaaattttagtaggattgaaaaatactcagcctcttgttcagagtgagaagctatatactgtatgattttaagagttatgcctttttgtctttaccaccctagtcaacgcacaaaatacttgctctaacttgctgaaattctatgattaacaattcatttatttgtcttaagctttgttaaccttttaacatataggtatatgtagattatctgaccctttctttaaggtagtttctggctgcagaaagggaggagtgaggaccctttgggccagaaggagaagacacctcgtttctccaaagcttttgtctgtgatttactgtattgattgactatttaggttagcattttgattttcagtcaaaacggcagagggaaatatattggccacttttcagtcatttattcaaagaccaatgagactgagacaatacctgtggactattctctaatattttattgagtgactttattaattttagtgtttagataggagaaatgatattgagaattctctaagaaggctttcaataattgcatcgatcagttaaaggtgttgatccagatgcaaataactgctggaatggctaatgacaaggttctggaaatgtactaggaattactcaagacagaaggtctgagaggatcaaaattggtatccagaaatggcaccaccactctcccctctttcactgtttccatcttcatgtctcctccacagctcttcatgcttgtcaacttggggaaagtcatggttgatgcccttctgacagcctgctggagaagatctgttgccttttctggcagtcagtgacgtcttctgccacaactgggctttactctatggctttcttagaaagcagcatccatagctggaggagccttgagctcactggactgagtcctttcagcttgaagctgacctccctgattgccctgcctctccattgcagtttccgttctcacactgaccaatactaattgaaggagatagcatcacctactggtaatcaggtccctgccttgtcttaggttgccatccaataacaacttgagaatttataaaatattgtttttctttacaggtgtttcttgagtttgtttctcaagtactaagcactatcagagaaagaaatcaatgttaattatacacaaactgtaggaatacaaaagaacatttagataatcacttctctgaaggaaactacaatctcttcaggcagataatagataatatgggtatcttccatttctacaaaagataaaaatgtaggtgagagagaaagagcacttactaaaagttaaatggagtcagcagaacctgagatttccaagtgatagaaacctggacaggcagcagaggtggagaagcacagtctaagtggagagtcacatgagcaaaggagactcagaaatcagagttctttggaagtgggaggttgctaagaaagatcgaaaatgccaggaaggcccttacttccaagatgagcttgaatttgatctggtaggaattgggaaaccattttggatttctgagcagggatccaagctttaaatgcacagttttgaggacatttacttttctggagtatacaaactcagctgttaaagagtgggatcagaagctaaagatcagctaggaaaaattacagtaatccaggcaggtgagggtctagattgcagcagaaaaagagagtctctgatgaattcaaaagttattggaaagtggaaattgataggacttggtgacaaattgaattaaattgactaatcatttattattttgtgcatctcagcattctacatctctaccagtgaactcattaaagagatttttatgttaatagcgaagtttttaatgtaagttgatttgagagatcttttctggttgaatacagttggcaggctgttggatttagtaggcaaggccacatttatctggcatcattaaaattaggtaacctaaataaataaaatatttagacaattgaagcttgctgtcattgcccaatttggggaggcagtccagagggactggccagatcagataccattctgtggataagttatcctgagggacaagtggagaaacaaattcaggggcactttttctaagaacgggaaggggactcccaaagaaattccccaaactaagacatcagtctctgagacaaaatagaacatgaaatgaggatagagattcaaggatctaagtagtccattcattaatgaaataatattacttatgtgcattgagtacctacttccgtgctgaaagctttgcataggtcatttgttttacttgtatgtattgagcacttactaggtgttggctgagcaaagaacctaacaggtatgttcccagcccttatagagcttatagtctggtgtgggagatagtcatcaaacaaataattatacaaatacatacttagttacaaattgtgatcattgcagtaaagggaaatatagagtggcatggaggtaaaacaagggttctccacttagatttcacagtcaaaaatggtgttcctgagtaaataatattctagcagaaactttgaaggatgactgggaattagccaggcaaagactaaaaggatgagtgtcaaggacactgaaaggcaaagtaggagatcaaatactgggaatcttgaagtcggaagtaggtatttggtttaagctttggagcaaggtgaaactggaacctggaatggctgtaattacaaattgtcctcagattacccagctcagaatctacagacacacgctaaatgaaaaaggcagcatatttaatggtcagaacatcacaacatacaatttgcagtcagatgaatgtggaccacttcttgggtgttttatcctgggaagacacttaccctttctcagctttaatttttcattctgtacaatggggctaatactacttatctcttggggattgtgaaaggctcaaatgagataatgtctgtaatatacttaattcagtacctgacagacaatatatgctcttccttcatgtcaccaagtcttttgttattctatttaattcatatttattttgataacaacatgaagatacccacatacctagcaaaatgtaggaactttataacaggcattttctttgctgctcagaagcttatctgagtcttttccacctattccctgatctgtaattgtgtttcatatttttgaggctctctgaagtgaaatctccagattgggaaagggttaagggattcatatgtaaatagacatagaattcagtgtgtgctcaattaagatttgatgaatgaatgattactgtataattatagagatctgacagtgataaccatagttaattcattgctaaggtcgtgtacattgaaaaataattttaaagcattttttagtaatttgtgtttttaagttgttagtaaactaaattgcaaccttttgttctctgaatattctcttaactataaatctaccatgttttaatcagagaaatgttgtgacagttccaggaaaggaaacattttttctgtttaaaacatttctagcatttcagccaaacaatttatctagaatggttttccctttaaaaggaatagtagacaattagaagcatagtacagtacattttctgccttatggttccaagccaaaaaccagagaacttttgtgctttataagcaattgtaaactaaaatgagtaactggtatatggtaatagactaggctttgagctgctattaccatagaatacttttccggctttcttagaagcacgagaacaaaattgggaagaaggcatttatctgattgaagctaggatgctacttgcattgtacttcactttaggtagaaaggcagtcattttatttgctgttaatgtgaaaagagatatcacttctctttagaatgtagccagcaaatcagtatctaaagcctatacacatggctagaaacaaagctacccatatagccttagacctccctgaacctgatcaggccccaggatactgttctgctcatcacagtgggaagctacaggtttgctcaaaccaagtccatctatgggagttactaaaacctctccttagcacttctccagaatatggaagtttgggaaagcccactccagggggtccctacatatacctacataaaagcttcatttatttgtataaacaggcagatcagaaataggttagtgacaataaatgggtaaagtacactgatgtttaaatatttcccttgcaataatacctggatgagattattttatttggactttgggaacaaaagcattgtttggcaatatttaaatcctagtaaatataaacagtaagcaaattttacaattaatttaaatagttcagccaaccacataactatataaatcctatgttagtttaatctctctagggacttggcaatatttttttcttgataggcagatttcacatatattttattcatttattcaaaaatattaactaagtccaagaaaattcctaagcaccgtgctaggcactaatgccaaacggccctgcactaaatggacacttagagtcttgtgtgggattcagacaggaagcaaatagtgtctcagtattctctctgcagtatccttccctcttaagacgactcccagatcagaggggagcagctcctgtagaagtggcccagggctaggagacctgccactccccttctccccactgccctctcagcgctcctctgtagggctctgcagatctagtttgaagattgctttacatatggttctgatgtgcagaaaaatggaagaatctttgctgaatctatttcatttggactaaatctgtttcagatcttactggccagcctcaccatactggccacacacatgcaagaaaaagccttcattccaaccaacctaaagccacactatttgctcattacaatgaaagacataatttacttattgcatggcttaggccagagagaatgccagtaggaagactcttctcccaggaaataaatagattataagaaacaataagaaataaatagatgtggacaagaagcctcaatatgcttacctgtctacacacacacacacgttattgaacctgatgaagggttctgaacttgcagaataccagataattgacatatcagtgcatctctagtctgggtagattaatctggggtacaagtatattttctctgttttttatgttgttgttgtttctacaagcagtttccttttgcatttcctctgtgcaaaacaaggacctggggatctgcttcatttataattagagcaagaaagtcctgcttgacattgtattggagccttacagtttcaagactctcggttgcataatgcatgtgttttgttaataccgttaataccatgtaatactagtgcccctgatactgtgtataaatgaggcatacaagtagctccttcgcccagcagcaacatggtctgtacttgtagaaaaatttacctcctgaccccctaaatattgattgtttgattggagaattgagagattccagtggtagggatcagaaaagatgaaaaagatgaaaatgtgtaggcataaaaatagtatgaggaagagaaaaattataatggcatcacatatatgttgcatattctatgccaggtagtgttaaaaaggtttatgtatgtgcattcacatactcatttaaatattacagcacccccccaggggatacacatacttactgaaattttagtctgtgtaacatagcaagatcctgtttctactaaaaattacatttaaaaaaatagctgggcatggtgatacatgcctgtagtcccagctactcaagaggctgaagttagagaattgcttgagcccaggacctccatgttgcagtgaaccatgatcgtgccactgcagtccagcctgggtgacgtgcaactctctatctcaaaaaaaaaagaaagaaagaaagaaattttatagattggggaaaccaaagtaaaatgccttggccaagatgacatggcaaacaagtgacagagtgaggatttgaacccagacagtccagctgtcaagtcaatgctcaaagcatgatgctatgtagccataggagagccctatatgcaggtagaggaaagatttctttataaaccaaaagatgggtgtagactcagtgagtctgtataacggggtaaagggagttgtgagaaagggaaccgagaattttgaaaggaatagagggctgaactgaagctgaactggggaagcccctgactgtggtaaataaacagaaaataaaaacaatagtagtcacttagctgctttaaatcccctttttagcaatagattgtaaatgataatcactgtgagttttttttaagggaatactagagattctggtccaactgtggttcgagtggctgcaaggaaagcattttcaaccagcagcggaggctgcagtcattcacgagcatcaggaaatcaggggagcctcggagaggctgtgggtgatggatgggaacaagttgaaagaatagtatgcagaagcctggggtcagggtggggcagtaaaagctgagctcaggagccaggaaattgttcagaagctagaaatcaaaagtcatcagatggtaaaagccaacacagcagagatgatgccaaaagcacctggaaacaaggcaaaaacagcttcagacaggagaaagcagcttatattgctggactaggaactgaaattatttcccaggataaagtcatcctgctggaggctttcagtagagtgcttcacctcaactggcagtggctgtcagccaaggagaaacagatgcaatctgtagctctaactgaaaagcctgctgtcgcaaggacccagagatctgagacagtggggtcaacctgagcctggccatgggagagggtgaactatggagaaaagtgaaggaatcccaggcttcggctagagaagacctgtgataaatagaaaggggccaggtacggtggctcacgcctgtaatcctaacacttggagaggccaaggcaggtggatcacctggggtcaggagttcgagaccagcctggccaacatggtgaaacccagtctctactaataaaaattttaaaaattagccaggagtgctgatgggtacctgtaatctcagctacttgggaggctgaggagaatcgcttgaacccagtgggcggaggttgcagtgagccaagatctcaccactgcactccagcctgggcaacagagtgagactccatctcaaagacaaaaacaaaaaagaaagggagtggtactgtggaactggaagggcctggaagaatttgatggatgttgtagaacatctaggccaattgtgtccctgtcatttacctaatcagtattggatttttcatcctgagtcttttgtgcatgtacgagtagttaaaccctttatgctcttaagtatttatcttgctgcaatgtatggtaatcaatgaggtttgaaaggactgctttagaagagaaagagaggaagcaggtaatcataagagttgttttccccttgagaaaccaaaaagaacaagctctgaatagaggtgtgaggccccttcccactttaacattctgtgagtgtctgaatgtcctaatccccccggggtgaaaatgactcagaggcaggtggtacctactgtatttttgtggagctgtcctggggcctgtgccctcaatgcgtggcctgtcttttctgggacttcaggctctctctatgaagggctttccctgttttatgctcagggcattgcctagctaacatgagcctatctctgggtatttccactgagggtaggctgcgtatccagctatacatgggagtaccgtagttccagggccaccactagctttcattgcctttgagcaaatgctgtcctgctccagagtttatggcttggcacagagtggaatctgcatttcagccggtgcccagcccttagccaggagtcttgtgcagtgatgaactcgcacagccatttgcagtttgcagcgcccctatggattgcttctgtttctgccggatggtgatgaaggagtgctccaacacatcaactctgtagcacaatagctttcacccacaaagctttgtttcctatattctctctggcttacctaaccaaaatattgaagtcatctttgactcctccctcaacctttacattcagttaaatactagtgttgatcccacctctgatttctcaaagactatttctgtagttcaaaaaccaaaagaactaacattgacagagccctgccatatgctgggtactttaggtctcttttactcattataggctatcttcttcttccattatgttcatttcgtaaatgtggaaagcgagacttggagagtttcactatcatggcctcaagctagtaagtgctgcctacccaggtctgtctgcttctaaattccaagctcacctgccctgcattacactgtgctcatcaatctgctccaggacctaccattaaatagctttgccaaccccacacttgccctccaccagcctatcttccacactggtgctggaggtaactcccctaaatgcataccacctatcctgtcacctgcagatttttgaggaccagccatttctgacaggtaaagttcacccttcccagcctgtcatatgcagtctttacttatttccccagccttggttcctaacactcatgccccatctccaacaccatcagactgagaccaacacgtccaggccctggggataaatggtaaagggaagatgttgcaggattggcactcagcattcaaaaacagttgttgtctctggggaagagccacaaaaggccttgaataaacactgagagctgagcaaataagcacatgcattagaatgcctgcagggtgcccacactagttaggggtgtggcgggctttgggagaaaggctggtggtcaggtctgccccactgagggctgctgggaagatattcaccgaactgcctaaataagtggccttaagacgcccctaacccaggttctgacacccacattgtacttcctagtcacactgagttagttgttctttcccataggtaccctgtattttcatacttcattcacatgtgctatttcgtacttcattcacatgtgctattttttcagcctgtaagacttgctgtcatctggaaaaattttccactctccagggtcacacattattgtcatcttctctatgaagccttccagactccttgtaggcagtgttacaactctcctttgtggttttatagaggaagggagaatgttttggtaaggaaggggtctgagttggagaatgagaagaggatgaggagtagaatggcgtctcttccccgcagagctcttaggtctttgctcattctggtgcagtggcattagccactttgtatggtgaatagttttgtaaaatagacagatgtctacaggtacttcacccttgccatatagcaagcttttagtgctccctgcctcccaatgggccgccagttatttatggaaggaataaaccagttacaatacatcatagctccggctgtttgaactttctggctctagccatccttgcccatgttctctgcccataaagcctttacagatgcctcaccactgtcatggtctatcaggggaacagatgccagtagctatccaagctgcgacctcttgataatcccaaactcctgttctctaaggcaccagcgctgggcagggctttgcgcagatggtaggagtgcatcttctggaccctggacaactctatacccatccaagaacaacatccatgcaagaaactctttacccctcctgcacatccagtctgcaagctccaatggagaataagttatatttcttcccccactatccttcccactccatctaagacctgtcctcaataaaactctcttctattaggaaaacaaagctcttgtgcatatgagtgaatgagctacagctgttgggagtgaggacaatcctatctttagataaacaccccacagaaatgggtggatatgtgtaccaaaggacttatacaggaatgttcacagcagcataatttttgtagctaaaaactggaaacaatctaaataaccatcaataacaacatggataaatgaagtgtagtatattcatacatgggtatggtataccgtaatggaataaactactgctacatgcagcaatgcagatggatcctgtgtgcataaggttgagctaaaacacccagccacaaaagggtgtgaactatatggtttcatatgaagttttttaaaaggacaactaattaatagtgctgggagtcaggaggagagttatatttcaggaggagagagcagaggggatcttctagagctttggtatagaaagaactgatttaggggtgaacgttctgcctaaggcctgggccttctgcctgggtaagaatctctgaccagttcagaaatggcctacattcatcagatgcagaggcagtcttttcaaactgtccattcagcctgcagtgggggcatttggaatggatatgaagaatgacattttgagtagcttggtgtccactctgctcatgggacagaacctaatgattgattcagtaagtaaaattccaggaaagaattgcgtgcatttagatatgggcttctgtggcaacaatgctagagctgaggaaaaatggaacaagctgtcataaacaggcaaaagaaaatagcagtttccatctggaccttacctttacatggctgttttagccgtgatcattccaaaatgaatttgaaatcacattttacctcatttctctttatatctggcccaatatttcttttggtaatccatggctatgaagcccttataaacagaatcctggcctattttcaaggatgggagatatgacacaccaattaactctaggaaggtttgaatttagggtggttttatttcaccatgcagaatgtttaagccatatctcaacatagccagctactgcaaattccaatcccagaatcacattgctcccatagtggatcatctggctgtcaggagattctcagcaaacaacaacaacaacaaaaagcattaggccgcttcttcctaattatgtctctctctaaatatctaattatcattgagaacaaattgcatgttacagagataatattatggggaatcgttaatctgttgggcttctgcttttgaattcctgagtcggtactgcagctgctgaagcaaaaaattctgccacctggacacttcattatgatttcatatttaaatgcaaaaaaactgccgaagagaggttctatttgatggacttggcttcttcaggcatttcgtacttagctacgcatcacatgtacaggtcttccaaatatcccaggtacctgggaatagtgaataattgagcatttacagggacagaattacaagggaacaatgggaatatagtaataccaataaggtgacagtggaattgacttctctaattatactttctttttatccatgcacaaaggtctgcagctttttgtaacattcctcagtaactgcataggacttccttaataaatgctgatccaaaaagtacacattcccaaagattacctgataattgcacctaccataatatgcttaaagctaattaacattcagacttcactttagagaatagaaattaccaggtacttatcccataattacatctttgtgcactcactattgtaatccctggcattagctatgtaattaaatgatgaacagtgactgtgtaagtagagagtacttatgtaaaatttgtgtcttatcaaaaataaataaataaacagattcaaagactcaggtctcatttgaaattccattgttctcagggagattgtatagcatgtcaagaattgataataatactgttagctccttgaaggtgggaagatgatagtactgccactctgtcaggaagatgcccactgtggttcatcttaccaccagggatgagcggcgccaagcaagtctcacggtttttttcttggcatgcctcaaataacaagtacttagacactgtcttactaaatctgacctgtctctaagctatgaaatccagtagttttttgtcagatgctttgtgcaagaattcttttaaaaaaataatgttttcatctgatcacaatgctaacatatattcatcgtggaaagtttgtaaaatattgaaaacccacagaagaaaatagaaatcacttataattccttatcaatgttaacttttttccgtatatgctttcagtctctcttgtagatgaatctcactgtatctacatatatatgtatacttcttgcgacctgcattttagaagcggtatattgtgaacattccaatgaagtattattgtcttttatcatatttctcatgactccattataatctgtaatattggtagtccctaaattatttaaccagttttgatggacgtttaggctagtttttcaacattaatttctatcattttactattcaccatgtgagggttctctaaaagaagttttaaatgttgtgttttcatgaaaacatgttaaaggtcattcattctaagttattaccttgtgacaatgtcagtgcctgcgtttgcatctgtattcacagtgtgctgtgctgcgtgtcactttcattgttgtgagctgatgagaaaggacagaggtctgcttaataagtaaatgatcatatagttggttccaccgagtgaaaccaaaggacctcatagtatgcaggacaaatggaagttcaaatagcaaaaagcagtggcaggattgagccatcacatggaggtagcagagatacatcaaactcaaaactaaaaaagaaaatagaaacccaagaagttgataccatattcacagcagacagcaatcaaggctctcataaaaatcattagtttcgagaccagcctgactaacatggagaaaccccgtctctactaaaaatacaaaattagccgggtgtggtggcgcatgcctgtaatcccagctactcgggaggcagaggcaggagaatcgcttgaacccgtgaggcggaggttgcagtgagccaagatcgcaccattgcactccagcctgggcaacaagagcgaaactgtctcaaaaacaaaaacaaaaacaagaacaaaaacattagtaactctaaattaatgttgttgttttgaatgtcatgtgatttgtaagtattgtatttaatttgtagatttgttttacatttgtttggattgtatagttgtataagaaccataatcctaaagagccactatgtaatttcatattttcatacatctaagtaacagtaaaattaatttaagtcaacagtgagagtctgtaagaagtttccatttttaaaacagatccatacattttctcaatttgggttacattgtcctcatagctacatcattatgcatatccttagaataaattatttcctcagggaaatttcttaaacataaaattattgtcaaatgttataaacattctaaggcttttgatgtttctgtcaaatttgagtacagactgttcaagttacttttctccctttagtttacccttcatttttaatactttctgcagtagtacattcgttctagtttgccaaatatttattgagtgctaaccatgtgcaggcatcatgtattggcattgactagtgaacatgttaaaaatgcatcatcatggaccccacaccagaccaactgaatcagaatctgcattttcaaaagatccctaggtgatacgattgcatattcaagtttgagatgcattgttctaagaactagacctggaggtcgactgtctctctgacacttcctcttgaccatctcgaaggtgccccaaacacaatatgtttgtcttagttttgggagctgctattacaaaatattacaaaatatcataaactgggtagcttataagcaacaaacatttattaccctcagttctgaagttaggaagtgcaagatcaaggcaccagcagatttgctgtctagtgaggggcagcttccttcctaggtggatgtcttctcactgtaacaacacacagtagaaggtgcaggacagctttctgggctctcttttataagggcactggtccattcatgagggctctgcccttgtgacctaatcatctcctaaaggcctcatctcctaataccatcacactggtgattaggtttcactacgtgaatttagggggcggggagaggcacaaacattcaggctgtaacaatgctcaacatagagctctttttttttttttcaccatgcctagttctttttccagttttcctcttctcagtgagtggcatcaccatccactctctcatgcaaaccagaaaccttcctctactttaccccccatatctaatttatcaccgagttcactatctctcacatccctcctattttttcactctctctccactgccaccctccttgtctaagctactcttgtgtgttgcctggatattttgcagtatcttctgaactggcccccctgcttccattcttatcccctctagtttattttccacagtaagttgtggaaaagagtaatcttttggataggcatattggaacttatcaccagcttgcttaaaacgtccaaaggaccttccattgctctcatgataaagacagaaatctgtaaggtggtcccacgagattgagtcttgcttgctctctagacttgttctgtgccgagttctctaaggtagcagtcctctctcactttgctttctccttacccttcagtttagctagtgaacttctattgttccttagattgtagctcaatcatttcttcctcagaaaaccttccctgacctccctaattagattctttcctcttgttctgtgatctcaaattacacaacttattcccctgcgtttttatcactgttgtaactcaacattcatttttgatgtctttgattaatatctggcaccccattagagtgcaagctccattagggcagagaccacatctgttttttcagggccagaagatgataggtgatgtcttacaggtccttaccgctctggctctcttcatgagtggttcttccagatggaatgcccttctcctccactgtcacttaaataaataatacctgtctttcaagattgaattaaaggaacaacccctcaatatgatcttcctggcggaagtcctcttcaaatcctcttataaggtacttattaccttctacaataattactatgcatttttctctctctgtattaatcaacgtaagtaaccattagttgctgcaaaagataaacagaagttgaatttcacccatacccagttcagcttgggctaactgaagcacttcttcatccagtgacttgacgatttaggcccccttcatcttatcaggccattttcctagcatgtggctcacaaggcagccacaaagcatggagaggcctcccagtctcttaaatgacaaggcacagaaatggcatgtcacttgtgctgacatttcgttggctggaactagtaatctgactcctcctaaatgaatggtgcagtggaatatagtcccctacatacccaggaggatgcatagagctagatatgagtgaaaactagtcatctctaccaagctgtagtaaactcttgaaagaggacaagatctaagcccaaatcactttcagaacactaaagtattcaacctctcccatatttgccaattaatacaagttgctgattcaatgaatggctgaggatttcagaagagggagacaaaagcagagagaagcagaaaggcagatacagagcagcactagaagacagcatctctctcttagtccattactatttgtttcagctacttacacacttttgggcagtgctaactaaattgataaacagcctgccccacccccacccccacctcccaaagtcagttttttggggtttttgtttgtttttgagacagagtcttgctctgtcacccaggctggagggcagtggtgctcactgcaacctcagcctcctaggttcaagcaattctcatgcctcagccacctgagtagctaggataacaggcatgcgccaccacgcaccacccgcagtcagtttttgttataatagcttggcttcctatatgtgatattattgaaaagtttcagaataacgcccatgtgctggacagtgtgcaaggtgttttacatagactgctatacagtcattctttcagcaattctgcagtacaggcattcttatcacagaactcacaattttctgccttagaatgtgcattgaactctgtctgcctctaaaacctgtgttcttaaccacgacaccacattgaagtttattaaacatccgaatatttatcaaccctgagaatgagcgcatataagtaatgtgattaatctacccattataatccctgtgacttagccttgggaaatagactctaaggaaacacttgtagaattttgccaagacagtagccaaattccaaggaatatatgtgtatttaattaagttacatattctaaagccagggtgatgagcaatttggataatgtttctggtgtgtgtgcattgggggagtggtggtttccagatgagacaacagccacaaagtaccttgtcatttcttccattgatatatatactcatatatgtttgcacagataagactagcttttggctttatgcttagttttatgtacagtacaaacattaaatcgtgaaggtgttcatcacaggaaaaccagagaagccctcgtaagccttataaatcattgtccttatacccagctcactgtgggtggtggaccgttagagcacatggggacagagtggcagtctgtgtgatgttaagaatgcaacctattaagcagagaatgagaagttgaaggattccatttttcaccagctctaacatggttaatctttaaagctatttattgaacacaaagacatttgactgagcactttgtagtatgcatctttctctaccactctcattcatcacctattttcaccgaatctttgttaagatttgcagtaatggtgctgtataaaagggcctttatgtgactcacagtccctataaaatatgattttttttcttcagatcatcttttgaaaattgctgctgcttgttatttcacatatttttttccaagtgcattaagtttacctgcaacgggaaaagattatttagagaaacgtacactttctatttcctttaatagcttgtgttatgatatgtttgatagttcatgaaggacactgtcagatttggagaatgagccaataaactttaggtcctaagaaatatagccccgtaatgatgcctactcatatgcagagatattttatcagcttaatggtaccttttagtgtctgacaccttcggtttacaggtttgctcgatggcctgtttgcttctgtgccaaattagtgttgagggaggtttctgatgagaagaatattcagtttggatattagagttatggccgtcaagttggaggcggtcagcctggtttaatctcagatggtaccttttactgcagatgccgactggggactcatgaaatgcccaagcaactcttgtttggctgtaagggtgcaaatcaaggtgtgtgggcaggggagagcatctcttgcctacagcattaacagacattttattttgtaaaatatgttctatcttccccaggttaaaaaaaaaatcatatgctcatcttattttaaacagattcttttagtggtaaatgaaagcttgtaacctgtaaggtagcatttatctttatattcaaagcttgggcagccatggaagaacattgggagtgaggacacttataaaaggaggagaatgtggggtcaggaagcagagaatgcaaagaatagtgttctggaagaaaaagggaggccaactgttatctctaaactgcctatgcctgtgaacttcatccaagaacagaacatccaaaaaccaggcttactagccttgtctttctttttggaaatacagagtttcgcaaataaataaggggatacttaattatctccaagcaaacatttcatgtgaacagtatagcaaattatattgtgcatatataatgccaatgtttggagcagatgaagatgactgagttgcaaggtggaatgatgatcgtgaatcttctgtcagttactcctctgtcctggatctagtcattatacatttatttttcaacgtcttctgttttaaaatgactcttctccaaatactagatcacttagttcctttttgtagataatttgtatccttgaaatggacaggtacttcaaatatcacaagaaagggtagctttagttttcttttgttttaccggttagattatctggctgaggttgatttaactcagtcaggtaagctagtaaaagtttgtctttccttaataagactgattttttttgttgcatttatccaacaatcttgtatattctaaattttgtgcagtttaaataggacattgttaattcagttcatcaattcattacaaatgtgcagtacggatgctcacacatttacttcctgaatggtagatgcagggtaagaaaagcaaaaccagcttcatgatatctgtgatcaagatacatattaaggtgaatacggacaagattctactgagtctgctgaaaccgtttcaaatattttggggttttgttgttgttgttatattactctgtttactctaaaatcaggcacttgaggctttttttctcgcctcagaaagatatttctgaaattcatgacattgtaatggtgatttttattaaagcaaaatttgatggcttttgtttatgagacctgccaaacagtgcaaacacaatcagttaactatttcctttggaaggagtatggtaaatttttgtgtaagagactgtttacccaataaggggggatttatagtttccaaaagtgtaatataaaaacaatcttcagtttccccatgttatatatacatctagtaatatactttctgtcctgtgtagctaccagcaattttaatatatatagttactcttaaaaacttttatatgatacaccacttttttgttaccttctaataagaatagtggattctaggctagcaatatttcatgctgatgatacatatcttgtaagactatgaactttttgaaagcaggcatagcaagcatataatttaaactctactgtatgcattagagattacagagggcctgagtttcctcaagccacccatcttattaagtcatagcactgcatactacataatggatttgaattccgattgaaatcattcatgatcagggaatatttactctagatatagaaaattcaggcagctgggaaaaaagaagggatcgagttgtttcacaagcctgcttatgcgcctgtgtttgtgattgtaactctaattatatttgtactgtattataatgaagtaatttaattaaatgttccataagttgataaaatatttgctcaaaagttgtttatattaaaattatattaatactttagagagactcaagacaagttgcttttaaaaattgctattgaattctttataaacatatatgtcatggaaacctagggaggagagaatttccataaacagactatgcttcattgtgtgccaatgcctcaataataggaggaaaataaagaatgtgtagaggccatgggcttggcatctcaggaaccactgctgacaatgcaggttcgagtttcatcatatagataacggcaaaagctggatttcaatatcttaggcatgaggttgagggaaatgggggcagaacatggagatcatgattgtgtggcatcattcagcagccaggtgaagtggagaggcgggagttatggagaagttgatagtctatcgctgggaaggactttaaaagagtatgtatgagagaaaaagactttaaaagagtaaggtgtttaatgagtatgatgcagaggaaagagcaaggtttcggatttgcaatctgtgtgccttttattaatgtatttaacctctgagcatctagctgctccttctataaaactgaaataatatatgactcaacagattttgggcgaataaagttatatgtagatgatatagcataattcgttctttttctttatatcttgccttcttctgttggaagactgtattctactgagcatgttgatgggttagcataagcactttgggtgcaggcctggggaaagctgaatagccctggattcagaaaacagagttccagccactcctgcagatgattcaggaggctgcggctgggcagcagaggtggcagtgggcagtgaagggctagcaaatgagacagatgcctggcatgaaacgcgactacttccataggacccccacgcaaacaataatttctgtcatatctgttgaactcacagatgtttggtgtggatatagtgtgaaccaaataaggacctttgtttcatgccagggtcagtagggcaaaggaaagtttctcagggaagacaaaattcaaaagaccatcacaacttgatattcaagaatggaccaaaaaaaaaaaatcttaggaaagactttgtacttctacaggatgaggaaagagacaaggggaatagatggaaatttcagtaagacttcagttggcaaggaagccctgagctgactcctgggccacatataaagccaggtgtcttcaacataactgacatggaatcagtgatgctaattagcataatattagatcaaagatgcaccaaagggcattgttgaaggtccactgtccacaaagtggttggaggaatgggactgagatgatggctgagtttcttttctttataggacatgcaattaatgactgcagccgaatttcggctcttgtgttccgtcttcctaattcctgagcattggtcatgaacttgctagccttgccacaatttatccagtaaacaatgttttactctcacctttacagaaatctaagagctttgaaattggctacatatagatgtaatgtatgtagggcagggagcacccaagagaatttttttttctctaagattacaagatatttaccagacctctgaaaaaaattgctggagttataaatgtgctgggaaccacctaaaaatcccaaggaatattagtttttgaaattggtgccaagatattgaccattgttgcattcttataaagatctagaatatgttcttatgaaagaaatttttatcataattgtttaagtcagcagcaaaatcgcggggtgtctgttatgctacccacaataatactcctggacagagagaatgacaatatcagttctttaaaaatccaacacaaatatctccttccttctgtttgtacaaaggcaaccataatggcttttgcttccggcagactgaagtaacatgtggggtctctgtagaaacacttggagtctacaaaatgagcttttagcttatcccctggtagttaattactatacctctaggtcaattagatggctctcaattgctcagttgtaactgtggtttcactcacaagctgtgtgtggtaattctagtttacttgttttcttaagtaaaactcaaattgccgtgtgcatgagatccagaataatgatcaaaactgaagtatgctgaagtgggctatgtaattaaaacaatttcatcaaaagcttcgtattttaagttgccattatattggtaatgctctcttggttcctccaaagaccatttctaaaagtaaaaaataaaataaaaagagcattttaccttcataactagcactaataatcagatatttgcatgatctgaaatgaaacaagaggtacacagtccaaggtggtcgtgtgtattgaaggaacaacactgcactggtccaccggggatacagctgaataacctggaggtatttgttgtcattcagtattcccgggtgcagtgccttttcagctgccgcaaggttaggcatacaggagcgtgttgcacacggctgtgctcatcctgccgttctaatgtgaatgcattatttccagctttgtggaagctccagcacatttataatcactttctactcactcttgactatgactccttcatctgacaaaccctcagtgaaacatcttctgcctgtcactgtccccctccactcaggaaagccacagaccttgtttgtgcattcagcaaacacttactgaacatccactgaataccggacactgctgaattccagggatataaaagcgagtaagactcggacccggtggtcaaagatgctaatgtcttgtgaagaagacagacatttagacaagtaattacaataaagtgtaagaactcttactcaaagagggaacacctaattgtatccaagagtgatgtgcagaagaggaatcagggaggccttcccaacggagctgatgcttgaactgggtctagaaagatgcaaggaatttgccaagtggttcaaatgagaagtcaagatattagcagacaggggaaagaacatatatgaatgtggaaaggatggctttgtgtttactaattcgatctaccaggtggatgaggttgccataatccaagaaaaggaatataaaaggagagaaggggatgtgtacaaggagcccagttagcgtcttctgtgttattgtcactgtcattatcatcatcatcatcatcaaaccatgtttgtaaaattcttctaacacgttcagcagactgatttttttaaaaacccataaaaacatattgcccattctataaagattcagtagtatgctgtcttcctaatatgtattctgagattatggttctgcctgtactattaaattataaagtaagtaatgactcacaagttggaaagctgaaattgaccaataaccacaaaatgatttaaagatatcacttttttatatttcaaagaaatcagtaattcctgtgctaattaaactgtttcacagcataaagaaaaaactgaattttttccgaagcaagtgtaaatagttatccttttattatagaatgcaaaacctgacaaagatagcgcagtaaaaggatgccttgaaaaactgatgatgtaatttattcaagacaataaaggtataaaaagatctggtaaaagtctggaaaaaataacaatgaaaagtctaatggagtgtgaataattatcccagatattaaaacataaaactatagagattaaaacaatgtgggctttggcctcactacacaaattagttaaaaagaaaaagaatacagaaatagattcaaatatatgtggtaatttagtgccataataaagaatataaaataaatgaaggaaggatgacttttcaatagtagtatagggagagttggctggaagctgttcaaaaaatatgaattcaaccattcctctttatattaatttttaagttccagatagataaaatagtgtactataaaaaggcatacataaatacataagatcgaaatatgagtaaacatttttacaaacttgtaatagggaggacccacaaagaaaaagactaatcgctggtgactgcaacactgacacataaattctataaccaaacctcagtgaaagactaaatcaaactagcaaattatttatatcacttagaataagtatccctaacataaagagtcctgattaactaattttcttaatgtgctaataggaaactaggcaaaggaagtgaatgggcaattatacatacatacatacatacatacatcccaaagaaagaaataggaatggcctatatgaacatgaaaatatattcaatcttgctaataattaaggaaatgcaagttatgactatactgaattatcatttatgatttattagataaagatgaaacaaatcataatatcatctgttggcagtatctgaagaaatgggcatgctcatgcgttgttggagggagtggggcaatttttaatcaaaattggaaggtactttatctagcaacccctcttaggaattaaagatatttgaagaagtattcaagggtattgatttcagctttttcgatcctaatgaaaattgaaatattttaaatgttaatcggaaggagatacagttgatctatgcagacatacaaagcttaaatgcttagagggatcatggagctagttaaatgaaggagtggttcaggtggaagacaatagggagtgatgggatcatagagaatgggagagtgtcctcacaaagggacaggcactctcggctccagctatttgtcaccatcagggaatgctgagcccaggctgccagatttttgtggaagagaagttgaaaatcgaaatttgagaatgcagtccccggatttttaaactaaaatgtaaaagaaaacacagtgcggatcataaccaacactttcgccaactctggatgtcataaatttgtttcttctttgtttatctaataggtcataagtgatcattcatgttagtcgtaacttgcatttctttaaaattattagcaacattaaatatattctcgtataggtcatccttattttttttttttgagacagggtctcactctgttaccaggctggagtgcaatggtgtggtctcagctcactgcaacctcccgtcttcccgggttcaagcaattctcctgcctcagcctcccgagtagctgggactataggcatgcaccaccacgcccagctaatttttgtatttttagcagagacggggttcaccatgttggccaggatggtctcaatctcttgacctcatgatctgcccaccttggcttcccaaagtgatgggattacaggcatgagccactatgcccggtccccttttatttctttgataggtaggtatgtatgtatgcatgtgaattgtctattcacttccttttcctagtttcctattgacaaatttactttaaaattaattaatcaaataccaaatttagctttcaaaatccagtttgcaccatgtgatttgtgcagtgaaagacttccaggccatcattgtggcaggctgttctgctgcccccacgtgggctgtcccatctccaagacaggattgtctaccccatgctctactgtgtgcctggcagtgctactgtgtgcctggcagtgctgctgtatgagcagtgcactggcccagcccgttaatgtggggccaagcatgtgtctccttttggccaaacacatacgagtggaggtgacacacaccttgtctaggagaccttaaggccataacaggtctccactccactgttccacactctgcatctgtcctaaacagggaccacctgaatcctggaatgagatggcacatgaagcagaaccgtaatgaatgacgaacccctgatatgttgtgtagttataagtcaccaaaactgttgggttcatttttgtagcaaagctgactaatttttaaaattgtttaaaatatggcagttttcactgacatgaaaagatctctacactatatggctgagtggaggaaaacagcagcaaaacagaatacataatatgaaactttttttgtttctttacttttttcttctccttttttttcttttttttttattatactttaagttctagggtacatgtgcacaatgtgcaggtttgttacacatgtatacatgtgccatgttggtgtgctgcacccattaactcgtcatttacattaggtatatctcctaatgctatccttcccccatcccccaccccacgacaggccctggtgtgtgatgttcccattcctgtgtccaggtgttctcattgttcaattcccatctatggtgttctcattgttcaattcccatctatgagtgagaacatgcggtgtttggttttttgtccttgcgatagtttgctgagaatgatggtttccagcttcatccatgtccctatttttttgttgttgttgttgtttttgagacggagtttcgctcttattgcccagactggaaggcaatggcatgatctcggctcaccgcaacctccacctcccaggttcaagcgattctcctgcctcagcctaccgagcagctgggattacaggcatgtgccaccacgccctgctaattttgtatttttagtagagatggggttcctccatgttggccaggctggtctcaaactcccaacctcaggtgatctgcccacctcagcctcccaaagtgccgggattacaggcctgaaccactgtgccaggcccattatatgaaatttttaagtaaaatgttgcatattaatatacctccatatagctatatgtatttttaaaaaagcctgttagatatgcagaattggtaatagtgattgtcttgagacgctggacttgggacagcttttactgtagtttttccactttcctgtattcttgatttcctgtaacaaatcatctttgtaaaaagaaattaatatttctacatgactgatggttaaaagaatctcaagagccatatagaacataaaatgattccaccagaataatttttcaccctcaaaaaagtaaatatcttcatctcataaaaacttgattatagagccaagactagccaaggcactcctgaaaatgaagatcaaagagaaaagatttgcttatcaggatttcaggaattattataaagctatactaattaagacaatatgctactggcataatacaagtatgtgaaccaattttaaaaagtggagagtctacacatatccagaaacttgattcatgacatagttggcattgtagacaagttggaaagaaacagagtttccaataaattgtgctggaaaactggttgtccatatttttttataaaaagataaattgggcccatacctcctattataactcaaaaattaatgcctcttggcttaaaattttaatatgaaaggtaatatcataaaacatttagaagacagtctacaaaagatcttaatgactttaaaggaagagaaagatttctttaatataaatctcaaacgatgaaaaaattaattcagctacattgaagttgagaacttctgttcatcaaaagatttcatttaaaaaaattagaagataagctacaaaacaggagataatatttttaaaacctgcaaaaggcaaaaaataatatgtagttatttttcagtgcttatgatgtgccagatgcttatactaaggctttacatgtattaatgcagctaatttcacaacaaccccatgagacaagtagtattgtcatccccattttgtagatagcactgaggcacaaagaagttagggaacttgctcatgcccacgtagttaggaagtagcagagctggaatttgaacccaggctgacttgctttgaagtctgttattttaatcactccaacatgacgttatactgcctcagctatattaaaggatgataattcaaaatatatgaagagcacctataatcaataataaaaaagactagcagtacagtgcaaaaagggcaaaagattaaagggtcattttacggaagaagaaaaataaatgatcagtaaatatgtgaatagtagtcaatttcactagtaatcagtgaaatgcaaattatagctactttacatccacctgattctacaatgtagaagagtccacatccttgccagcatgaaataatggtatagaggagttcatatccttgccagtgtgaaatagtggcacagatatggactcttctacactgctggagggagcatagattgacaaatatattaatgtcatcattctcttaagagttaattaattgatattttggtcctactatgtaaaaattttatggaaaaagtcatctctttaggtcacatttttctcccacatggacacatgagacagttctattaaaaatagaagcaaatatgtctcaattgataaaatatgtatatggagtttattaagtggtttgtaaaatataaaattcatctttaaaacttgaagggaagtatgagcctcactcaagtctattttgattaaaaagatagtacatatttgagtgaaaaaaattctttaacttattcttaagggcctatttaagacagatttttatcccaacttggaggcgttgacaaaccaaaatggtaactgttaattgatggcaggtttttaggcagtgggttttttgttttttgtttttgtttttgttgcacttaatatggtgccctttgtctcatttctcactgtcccttttatgcttttgtcttaaaatattaaatcagcaaggaaagtgtcagaagattacagtttagttcattgcaaaccacagcttatctttacactgacctgcagaacagtcttagtgatgttattagaaaaacaccagagaggaacagaactgagaagaaaaaaaaaaaaaaaaaaaaagctttgcttttctagaacagtttctaacagtgctaaaaaacatcatgttttgaactatcattttttgactcggtaatcatgatagcgagcaaatgccctctatcccctcagttcagtcctacagaattaagtcctggaaacagcggctgtccagtttgttaaagattgacctaggaaagatctcaatgctaccagcaccttatagggcgcaaaatgtaataatagggtaaattatgttttctttttcacatttgcacgctgagattgttttggagatcttttaacttagctcgttataatcaagttgtacagcctttgttttaataagattctaatcctgaggtctatccttcgcatcaatgactttacactgttaattgctttcttgtcctccattaaattgcggttgcagttgcttcatcttaaaaggcgccttgtgctttgtattctgccccatgctctgcagacacacttagtaacatcatcttcctaaagaacaaaattacctattatccctttaatcttgatgtacttttttatgtgtttggttcctagctagtgtccaaccaggaagctacatattatcttcttttaaaaaaaaatgtttttttaaaagccgcatagtgtggatggccaaaatttatttctcaatagaactcacatagtgcattcatttattttttataggactaattaaaaagacaaagggatctattctccccttgatacaccagagtgacttccattaacattaatggaagggaaatacttgcatggagatgagtggagacctcatattagaaagtgaaaacagcagagtctggagtgaatgtccccacgtttttgatgagagaagctacacaaaaagcaaatagctcaattcacaaatgtgttttccccctatgctttctgtttgtttgtatattgaggaaaatcagcgaatatttggaggcagttccttccttcagaaatcaattggatgtgaatttgtaattttaacacgaatgacacaacttacaggaggaactcagcaatgagaagcaacggggggatctgacaggtctttgctgcagtggagtcctgtgagacctgcttctggaggcagaggtgagagtagaaattggatacctgaagaactctgtacacagaaacttaattttcaaggaagcccagctgtccgtgtcaagctgatcttttgacacatctttccagaaatctatcaaaatctggagactgcttctgacttttcagtgtagcctctgaatctgtgatcctcttggcccccttgtataccttatgaaagttttaaattttaaatgtacataatctgacacacactggggaagtttctcttttatcatgtcattcttaggttaattaccagggaattaattatttaaagtgtgactagctctccatgctgtatattgttttaaaatattgatacattcattttgcatctggtgggtgctaagttcaaactgctttttaccctttgaaaatgtacttcaaaaatacaagcagtcttctgagtaacaaacctctccgtggtatcttgccactgccctccatttccctggcctggactttgctttagctgcttaaatcaggctcaggagcattatattttgcctccagtctctccctccccctgtctggttagcactatctctggaattttgttactattcatactgacctggaaaatgcttctaagatactttcttactttaattgcttcctttcttaactatgacaaactccctgcttcagaaccttacctggaactttctttggagctaaaagagattcaaatcctttagccagagttctttgttcagcttaaagtgtgactttccctgtcttatatttatcacctttaataccttctcctgtcttgggatccaattcagccttcatctgctctcgtcagaatttcctaaagaatcatctatatttttcttctcacagtaaaaccacattttcctccatacttcctatgttgtgaagtggtttgcaaaatgtatccagaggaacttgggctggaggagaaggagaaggcagtggcaaggagatcccataagcatttcattttaactttgcattttaaaaatcctttcattcccctaagattttttagtgcgttagttcaggacctctgagaagctgacaccaagacgaggtgaaatgtgcaagagctttactgggggacatgcctatgaagggtacagggaggaagcatgagtaagtaaggacggcctcagaccaagaggtaagtctggcacctgtgggaggcagtgtggggaaggctaaaggaaggaacaatgattgggtagcatggtgcagttctaagaaagttttgaaaagaccaatggaaagtcctcaagccaatcacctgccagcaaagtttcacatcaggcaggaatggaccctgtaccactactcccaccaggctcagcattggttggctgggaccatcctggaagaatttggcagcaccgcacatggtgctggatccagaggggtggcatttggggttttgagtcaactgtgctcccctccacaggaaatctgactagcacctttttaggccaccactctcagctgtttgttttcctcctgcagtgtggctgttgccctcagaagagatcagcaacctgtcaagacagtcttactcctactggccattctcccagggccaactaatgctgctttggcagtcaccatgggatcactatagacagtgtggatttccccctcacaagctctgagattaatgacacctgtacatccatgaaattagctccaagactatactgtagccaaggctcaaaatctatttcctattccccatttcaaattatatatagtcatgtttctaaaagacagcataacaggttgtagagatcaaacaacctgattaagatatttaatcgactgtcaacataaagatgccctaagtttgaatacaaactccctaccattttcaaattcctggagagaaatttaagtccaaatattcaatcactttacaaattaaagtccaaagaacataaagtctgcaatcagattctcttatcctagtgagctaaattttaaaaatatatatccacagtttattctctccaatttttgatattgctcagtgccaggtactggggttattgatacataagacgagttaggattgcttgaacagcttcagcctggagtttctatcactcggatggatgtagtcccttcagtgcttcataaattacagctgaagtctgaaagagttcaaaataaatccttaaaaatctcaagattattattggcctggcacttacccaaacgagaaagtgagctagtccccagctactaaagtaattagtctagtgcccagggttactaaaactgtagcagagattgagtgctaagtgagtaaaggagagtagttggagaaaatattggttttagtctttttttcctttgaagacagggtcctactctgtcacccaggatagagtacagtggtgcaatcatggctcactgcaacctcaacctgccaggctcaagcgatcctcgtacctcagcctcccgagtagctgggaccatatgcctataccaccacacccagctaattttttttttttttttaagttttgtagaggcagggtcttcctatgttgcccaggttggtcttgaactcctgggctcaagtgatccacccacctcggcctcccaaagtactgggactacaggcgtgagccactgtgcctggctggttttagtcttccaacaattccagtcaggctatatctgatgcccagaatctatgacctgtgaatataaattcaacggaaagaaatctttccataagaggttaactagaccctatacatttgtatttatgggaaaaagtcatccgtgtaaatggtcaactccagtaaatgttcttgaaaatggtctactccagtaaatgttcttaacctggttattcccctttcaaagcactcatctggaggccaagaatcacatctgtcatgagcaccatggaatccctggcatccagccccatgcctaacataaaggagggacttgataaataattgtttttatgaaaagaacttaagagaagttaattcctcctcatgtcattcaagcttctatatcagcttagttgaagaatagcctggtttatagggtgaactgttaaaactcttttaaaatttacaactgtgcaatgcagggttttcttaatactatgtaacaataacaaaaaaataaatcaagctctgagactagcataactgtgactaacttccataagctttgatttccaaattctatgttaatcactatacccacattattctcattgattgactttacaacaagtaaatatttactgttatgactgtgttttaaaaattataattataacttatatttaccctaataaaataatacatttaacatgcatgattttgttttaaagctaggtttctgctaataaagtttgaaaactactggcttggcgaaagtaaaattggctttgagggtgagaatttgatctggattcagatttctctctgccttaacatattttagactcaggtaactattttgtaaaatgggaatgattatatatacctcaaaatttgtttcaggattgagaaagttcagtaagaaaatcttaaaaggccctggcacagagcaggctctgtgtcttgttttcctcctctcttaacaaatgcctttattcaaaacaatcacagtagattatacaggcctacagacaaaataggcatttagtaaatctgctgattaatttcatttttcaatatttgaagatattttcattaaacaattttaactgtaagtgggttaaacagttttcattattagaattgactactttcttcaaagttttcgtattactttattcatacctgggttccagtacatgcctccccctagaatttcagcacctagagtacaggattatatcctagacttcatctttacagtgaaggccatataattgaacttcgtaaattttgaacaaatactttttttaaaaaaaaatcagaaacctatatataaaactacttatgtaccagcgctttgtaaatattaattcacttaatctttataatcccctgaggttggtacaggttatccgaaatgcttcaatgagcatttcctttaaatatgatgtttgagtgtcaactcagtgctgaaagagttttagattttgaagcattttggattttgaattttcagattagggatgctcaacctgtactgttattatccccatttcctagatgaggaatttgaggtctagaaagtccaagtgacctggccacagttacacgtcttctaagtggtagagtccagcttggagctcatcattgctttgctttaatgtccattctcttgatccttgtaccattctgcctcccattaatgacaatgcttatcatcatcaaaaaggaagctgcggtagcaagctgatgagattggtaataatttagctccagaatttttgtattacagtttctatggtaaccttaactcttccctttcggtatgtgctcattcatacagttgagctcagttagttgcaggtgctattttgctatttcgtctcacaggactactttatccatcaagcactatgagcaaaaggccatgggccttatgaacatgtttgagaatgaaaacaaagtttttactccaaaataagaaagctgcaaaattaaaattaagaaatcccttaatttaatagctacaacatgtaatataatgcccacattattgttaaatgtagttttcatacacatttcaatacacttgcagtctgtaggtttaattgctcacttcattagaattcccaagtaagcaggatcattgcagaataatcataaccagtcatacattatataagatacttatagcaaatattttaaaataaaattataaaaaaattttaaaatattttataataaaatgttatatttaatgtgagtaccttttactctgacatgacatgtagaggatctgatgaaggtcttaaaggccttgttaggacttacttcattttaatccttgacaaactaaccagcaagctgcctacctacttctctgtacacactagctatactgaataaggcaaagaagaaagcatacaccgtcttattgatgagttttataagtaatccactttttaaaagtaatagctatttttcctatccattaccatgcaaattcctgaattatttctaattctcatttttctgatttggtcattttgagatctacttcctacaagaaacagcagagaacagaaaatgtagattccgtgaacacataagacctctcagaacccttcggctgcttgcttgattttgaatattccatgactccttctctgcatggagtacaattctgagcttttaggaggccctagcaaattaccacgacctaggcagctttaaacataacacaaatgtattaccttacagttctggaggtcggaagtctaaaatggatctgcaaagcttcatttttttttctgggggctctgggaaagaatctgtttccttgcctttttccagcttttcgaggctgcctgcattccttagttcatgcccaccttcctgcatcttcaaaactagcaggatctggttggtggatttctcaccctgcacccctctgacctcctcttctgcctccctcttcccctttgaagaatgcttatgatgacattggtcccacccaggttgtccaggataatctctccatctgaaggtccttcgtttaatcacttctgtaaagtccctgttgccatgtagaattccaaggcttagtacatgtgcatccttgaggggccattattttgcctgccacagaggcacaaggcaaaatctagaagaacagatttctcagggcacctaagctgctgcccagcacacactgttagttattctcagaggtatattcggttcatctcactctgctcctgctactggttccctaatgcaccttacattctgcttctaaagttgctgctgcctctcttcctactcattacttttttcttaaacctaataacatggaatatatgattcactacctccctttgattctgttggtaataatgccctgtgcagtagacccttggtgggcagagcagtgtatgtaggcacatgtgcacgtcatgcctgcacacccccatcatttttatttcccatctttacctctgggttttcactactgtttattcagaaaatatacatatattctttagagaattgccacatgcaaggaattcattcaagactttgtgtgaaataataatgtacacagctgtagtgaacttgttttctctctccccctaggcgcaatccccctccccttcctcttcatgcccagtcagttaaaggtaccagaagcaacagtggcgtagacttgtcagactcagacctgccacttagcagctgtgatatcctcctccgcatattccttaatctctgtatgcgtcagtttctttatagattaaatgcaaatagtggcagcttttccacttcagactgcgctcaggaatcagtatttcatttgatttttaaactgccatcaaggctaagacaaagcccttatgagataaaggccaaactcctcaggatagctctacagggctcttccaaatcagatcccatcctgaccttccagcttcaccttccattgcttctactgcatctcaccctccccaaaccagatctgcttgccaggcgccagacatactgaagacaggacatgacttcaggttagcttcatggttttttttcttttttccactttgataatgttaaaaaaaaaaaaaaaaaaaaaaaagacgaagtgaggtgggaggacaaatgccagccagtgttagagagagattttctagaactcccaaggagaattatcatgccttgagaaaggggaggacatatactgaatatgtttaaatttagattaaatgtatgtttccttttacaacatacagttaatcagagataactttgtagcgatcagtgattcctagccagaaggctaggaatttggcattattaaatcttatcttccctaaataaagtaaatgggatacccacaaataactgagtcctcattttactcaatgggcattagaagtaactaaataaattgaaagttggctgttactgaggatgttgcaacctgatttggggaggagtggaggaggagaagaccatgagaactctcacctctggacagggcttggcactccggaagagttccactttttatgcacctgatcccttagcaccactaggtggtaagaaagcaactgaaaccaacctgagaagggccattgacattacatcctccccaagtcacctccatatggaggaagaatgactagacccacaggagtgaaagccacaaggtcagaggaaaggggctgctgctaccacattctcagctgcactcttggtcttgataccctttacatagacctcttttacttcttaaatgctgtgtcaagggcactcaatttgactattctgagtggatgaatttttaataagtggtgtttgtcaacacctgtctccccatcggggagaagccttctgggacccaggccatgccctgtcaccctgtcacacctcctgaccactatacatgctgctccagtaactgagccaccccccaccctccttacatgctcatcaggcagtccgtgctcagcagcccatctgtgaagcatttcctagccggctgccacacccaacacaagcaaggaaaggccattcattaatattttatgctaacctttaatgcactatacaggatatatatgtgtgtagaacagaattttcctacagacttctcatgaaaacatttcactcactgggctgggctggtcaccatagaaatcaagttaaatgactacagtgcctgcctgttagaggcatttgaatgtacaccatagcagggacaggggcacacaaagaaatgagagtaaccctctgagaaaaatcctaacttctcatcccgcctgccaatatttttttcctataagatagtaaataactacagcaaaacttctactaaaatgcatgactgacatttcgttttttgctttctagtttgcaagttgttttcatgttcgttatctcagtggatcttggcaacaacccagtgtaaaactcgttgtatttttcattatttatttatttatttattttggaaacagagtctcactttgtcgcccaggctggagtgcaatagtgcgatcttagctccctgcaacctccgcctcccaggttctaacgattctcatggctcagcctttgctgggactacaggcaggcaccaccgtgctcagctaattttttgtatttatagtagatagagggctctgccatgttgcccaggctgttctcaaactcctgagctcaggcaatccaactgcctcagcctcccaaagtgctaggattacagacatgagccaccacgcccggcctaaaacctattttatttatttatttatttattttcaagatggagtttcactcttgttgcccaggctggagggcaatggtgcaatcttggctcactgcaacctccacctcctgtgttcaagcgattctcctgcctcagcctcccgagcagctgggattacaggtgcccaccaccatgcccagctaattttttgtatttttagtaaagataggatttcaccatgttggacaggctggtcccgaactcctcaggtggtccacccacctcagcttcccaaagtgctgggattaaagccgtgagccaccgtgcctggctaaaacccattttatagatcatgaaattgaggcccgatttcatcagttgaggcaattgacttatctaaagttacagagccggtgggcgtggcagtcaggagagaagagtgtggtcatccatctattcatcctccaccaagcccttagcaggcagctgccatgggaagagcacaaggaagagcacaagggagatgctgataaatgaactccactttctcccctcaagccgctgctgccttgcttttcccatgcaccatcccgtgtttctccccgttcctccttgtttcatctgcctattatttcagtaactcattctgtgctcaaaggaagcccccgtatggtgtgcttcctttatgtactatgtttctcaccactacaccatgcgctaacacaagactattcaatgattgaatctcaggcttgtgacttaaacagtttcccacacattgggacatcgggaagcatttggggggaagaactacaggagacagggcagcctagttctagaagtcatcatcaataatgaagatacaacaaggccaccaaagcaagggggaaatccagggaaattttacaaacaaatgataaaccattgattgttgattataggaaaagctcacagaaatcaattaaggaaattaacatatccatacaatgaagggacaaaatatacaaaggagcacttgataaacaaactaatgactaataaaaatgactgtagtctaactagtagtcaataaagtagatattaaaacaataatcttcacctgtcaaattagtgaaatacatatatatatatatatttgtgtgtgtgtgtgtgtgtgtgtgcatatgatgaaacaggcacattttaaaaatactgctggtggaagaacagtgtgataggtctttcagtaaaagtaactggagctatgtatcaagagcttcaaaagagttcatattcaggttcagtaatttcatttttaggaatctaccttaaggaaataattagaaatttggtcaaatactcaaaacagaaatgctcaacacaacatgatttataaaagtagaaaattgacagcttagatgaatggtaaaaaaaaaaaattccatgaattatcacaaagctctgtgctgtatcataataatgcaaagaatatttaaggatgtcacaaaatgtcaaccacaattaattctcctgaaatcttggaagaatgtcatcactcttcatatggtagaaatggtgggtgacaaggggcttcctccacacaaggcagggagggagcatggggctgaggaccagacctggctgccaccacttactaaccgtgtggccatggcaaagttgctagactgcccagagctcccaattccccacagtgtcccttacacctaccttagcagacaaattgtgagataatgtgtatgaaaacgttgatgtggtaaagaagctagggcagctgctgctggtagcatagaatgcaggcactggagagaaaaaactattagtgggatggataacaggctgcaaaagtactttatgaactaaattgcagtatgtgtctaaagtaatattttaactgattacaaattttcattctttttcacatacagaacattcatatccccagctgccctcagtatcttaaacattccaattgcctaattattcagatgtcctccaccaacacagtcctgagtcctttgatcatccccatccacaccagcccccaaaggtggctccaaaaatcacccagacccctgcagggtagccctatgtcaaaggactagctctagggccagaagacctgattcaaagcccagttttgtcacatgccagttgcaaaccccaagccaaagtgcttaactactgtaaagccacagtttcctcaactataaaatggggatagcagcttctacctcatagggatggtgagcttttatttggattatttcatttaatcatctgtgcaatacctggcagagaggaaacagtacatggtaggttttattactactactgcctctaactcatagatggctttcagcttccagttacacaatgctgttcctcccagcactgctcacatgttctagttaaggacaatagaagcagcctccagagtgtaggacaatgtcagcctgtgcagaaagcatagatggagtcacaatgcgtggcccacagcctttggggctatccagactgctcatggatgcccccaaactgtgactggggacatctcaacctaccctgatgtaggttttgggaataggtacaaattgaacatgtggttagcatttgtaacacttcatgaagatattgggaggggtgggtgatatgacctagccctgtgtccccacccaaatttcatcttgaattgtaacacaaattctaatccccacgttttgggggagggacctcatgggaggtgattagatcatggggtagttcccccatgctgttctcatgatagtaagtgagttctcaggagatctgatggttttataaggggttttccctgcttcacttggcacttctctctcctgccaccatgtgaagaagaacgtgtttgcttccccttccaccatgattgtaagtttcttgaagcctccccagccatgtagaactgtgagtcaattaaacctcttttctttgtaatttacccaatctcagatatttcttcatagtggtgtgaaaatgacctaatacaggtggtatatcagggaagacaaaagtcactggggaaggataggatagagaggaagaaatctggtgttgtctattacacctgtggaaatgataggattctgaggtcatgttgaccaaagagcagggatttgggggtatggaataggccaccaattgagtcaaggcagatggagactggtttatgccacatgcgtacccagcttgagtggtcctgccctgagcagtgagcaagtgaccagcaaggacttccaggtgcctggtgtatttctgctggtgaggcagtcccagacctttccttcctgtcacttcattgcctttcagcttatctggacacctacttggtacttccccatgctgaaggctacatcatagtcatcactgtttcttacggttgactggtggagacctttccattttatgtttcttttcccgattgttcaactgttaggaagtgagataagggaaatgagtatgggctttgcagtcagaagaggattcacacttctactgtgccccttcctagttctgtgtccttggcaaagttgtttaatttctctaagcctccatttctaaactatttgtaacaaaaatataaaaatatgacatcacactccactgttgtaaaaatttattgagaaagaaaagtatttggaaaaaaactagaatacaatatatggttagtaagtgatactgtttttctctttggacaaaaaacatttaagagaattactgaaatattattcttgtggcattacgaatatctagtcaaatatgtttgtaaatgtcttgatgatcaaaaatatttgacagttatggctgggtgcggtggctcacacctgtaatcccagcactttgggaggccgaggcaggcggatcacgaagtcaggagatgaagatcatcctggcgaacactgtgaaagcccgtctctactaaaaatacaaaaaaattagccaggcgtggtggcgggcgcctgtagtcccagctactcgggaggctgaggcaggagaatggcatgaacctggggggcggagcttgcagtgagcggagatcgcgccactgcactccagcctaggcaacagagcgagactccatctcaaaaaaaaaaaaaattttttttgacagttacaatgaagccaagtgctaaggatataatgattaaataagacaaagttcttgtcagttggaactttgattctagttgggaaagacatcagataattaacatacataggtatatataaatatatgtattggtatatatatagataagatgcataaactaatgtatgtatagaaaaataatatatccatatgtgcttagctgtgcacttttaaatgaacatcttgccttttgattgattatcttagctggtgataaggacatgtgaatgaaatcccagactccaaagtatcaggttctaaagagattagagtgaggaggtagattttgagctaagaaggatcatgcgttaatgtctaagaatatgcatgctataaattgtgacacctctgaaagtgaagtcagctggctttcctaggccagcaaattgctggtgaccctggagaattgtataaggccacaatttaattgcacaggctttaagagatctgcactcctttatcccattaattcaacctgcaactttgttctctggtcccttttgaatattcagttctcattgatttcaatgggagttacagactcagagaaagggaagaattgggccagtgatctgttcaaagcaaagcatcatttaaagtatagttttaaagtatttgcaggcacataggtgagtcagctccttctcacgaatttgtctagaatgctttccagtttaaatggaccatcttaaagggcagtcaccttccctaaaattgcagcatcatactcatgcaccacatattggattgtgactgctgggaggcaatgactccatgttgtggtctcaactttactgcggaattgcttcagatttaagctatagcctaatcgtaattagcagcccaaagtaacattataaattcctacaatgcctattgggctctgtctgctgttccacacatcaagtcaagtcaatatagccttgccctcagagaccttttgtttgaaatagtctcggtctattggtcatgcaccaacacagaggcaaagaagcaaaatggctgtaaatacaacgcttaaagcaagtgaacttgcacagacagggaacatggtgctatgatttcagctctccctcgcctcatggactatataggttatagcacttggctgcacgataaatttctgtaaagcacatcctatttttgtactcatttccattgtgtaatcccacgtgcattagaattcatgaaagtcttatttgaatatttctttaggagagagatcccgacagtgtagactgccagacatccaactccccaactactctgtgtctgtccagacttctcagtgctgatacaagctgcagccttgggagctcagggccttctgtttactgggagctctttctctgaccaagagaaagttatctgtatcccactttgagatacccagaatccgtgcttccaacacctccctgttccttctgtctgggtatttatattgcttaggaggaccaggctcaggactggccccctgtcaggaactgcctctaggcgtggcgcaaaaaattaagttcccagttttcacttttgcaatacaagtgaagagagctgctatatacagccttacaggtcgtacagtccaaatcagaaatgtggcgacactgccaatgctgaaccttgtcagcgctttgagatggcgtctaactctgactgccactttagtggctgtgctaccttgggcactctctggatcctgactttctccctctctaaaacggggccggctgggagcggtggctcgcgcctgtaatcccagcgctttgggaggctgaggtggatcacgaggtcaggagatcgagaccatcctggctaacacagtgaaaccccgtctctgtgttgtaaaaatacaaaaaattagccgggcatggcggcgggcacctgtagttccagctactcgggaggctgaggcaggagaatggcgtgaacccaggaggcagagcttgcagtgagctgagatcgcaccgctgcactccagcctgggcaacagagcaagactctgtctcaaaaaaaaaaaaaaaagaaaaaaaaaacggggccatgatattcaccttttagagtgatcatgtggactacattagacaaagcgagcaaaacgtctgctcactatgtagtggtttttggttttttgtttgtgttgttttcaacgagagaggttatttaaatggataacatccttaccatggagtaaaagctcatatgtgattaatattttgaaggaaaaattcttgtttacttttctcagatattgaagatattcatgctaaccacattttgttcataataatgctccaaggaaaattttctgcagggcttgattcttactacagtatttcaggccggctcagcactccctcacctggtattttccatgtaaacaagtaacaaaataaataggggcaacaaaagtcactgctattgtaattattaacaagtattctttggttgattggcttttcttatgtaaaattctgtttctaataattgttaaaatagtaaataagaggtcccagaaataagatttgtatcatgtttaaactccatttcaaaatgtttattgccttgctgcaaaataaaaaaaaatctcagatttgtgtgatgtgtcctagcttacagcaatctattttttagtgtctttttttttttttttttttttaagaccaagtcttgctctgtagcccaggctggagtgtattacacgatctcagctcaccgcaacctccgcctcccaggttcaagaggttctcttgcctcagccccccgagtaactgggattacaagcgtgcaccactgtagctggctaattgttttgtatttgtagtagagacggggtttcaccatgttggccgggctggtcttgaactcctgaccaaaggtaatccgcccaccttggcctcgcaaagtcctaggattacaggcatgagccaccgcgtccggcctttttagcgtcttttctttgccttctaagtagttgtacagatctagaagtagtgctagctacattacttgtggaatataaggttaagaaattcccaggaaaagtttaaataatttcaaggcaattatttcagtaactttaaagaaataattagaatttttagaattcaccaataagtgtttatatagtagagatgtagtggggttagggatttgggaatggcaaaaggggataaaacacacagccagaacctcttcagtggtaactgctaaaacagcaataaacaacaaaaccaccagtggtcaaattgtgtagtatgggctttaggtgctaaagaagttcagaaggagagaaattttagtgtagtctttgataatcagagaagtttgctggtgaagctgggtcttgatctaggtctgaagggatgaacagaatttggataggcagaggtaataactgttccttagtgtttaataccgctgatctgcagtgggaatctgcaaattctttcacattataaggatgtaaaatatttccaaataactagcaaacctaagaacttgactgtgaatgcctaagatgattcagcaataaaacttctagacataaataaaacccatctcaaagccctgactcagcaataaaacttcgcagacataaccccataggaagaagaaataccaccactgaggtccacagttccagttgggaaccagcattgccctgagtttgtgcatcagatcttcaaaagataaggggtcaacagattgtgattatgcaaaagaggtgttccaattctactgattgtgattatgcaaaagaggtgttccaattctacttgggcacacaagtaagtaagttaacaagagaacctgaaagttagctaaattggaaagctggctgaaatgctaaataaaacatactcagtaagaaacggcgtgttcactcagcccggaggaagtgcagcagaatggagaatgttttctaatacagctctactcattataatctcagctcagagctcctcagtgataggtacagaaggcatattggaaacttcccacatgtctatttcctactaagtctatcatcaaaaactgcaaaatttaaaaatcacagtgaatgttgactggttttcttcagataaaatgatgatgaaggtattaacattctgtgctatagatgccatactgaatgtgtatatataattaatattatgtatacatatatgtatacatatgtacatatgcatacacatatatatatagtcttagtccatgggctgttacaacaaaaacatcattgggtggcttaaacagcaaacatttatttctcacaattctggaggctgaggcttcgaagatcaaggtgctagaagatttggtgactggtgagggccttcttgctgattcatggatactgtcttctcactgtgttctcacgtggtggaaaggagtgagaaagctctctagaatctcttttataagggcacaaatcctattcatgagggctccaccctcacgacctaatcaccgccaaaaggcaccacctactaatatcatcacattgtgggctaagatttcaacacgtggatttgggggagacatattcactcaataaccctgtaaattgaaatttatagttgttttaagagtctgctcacctgcctgtgtaccccagtatcctcttctcattgaagtccagtctcatccttcctaacaactcaaaatctagactcatggacagcattcttgtcacattattccccactactccatgcccatgttatgttagactcgtggttttgtaaacaaacacattttgaactctctttattttcaccttcacggatatccagcaggtcactctaaactctgccttaccagtttattctgatcttatcaggcacgtgaagttgtggtaaaatgtgttctgtcctcacctctgtcatcattgctgctactcatggaactcagaccaggaaagccagagctagtacaaacacctccaaagaagtagcaaatgactggttgtgggcaagagtaacatgaagactgtaattctgagacactcacccattccctgccagggaataatataattgtttacctgtgttatagacacccagaatctaagagaggcacaagaatccatctagccagatctggcatgagactcatttgctaaaggtccccagggggaatttgtataagaagaggagcccaaaagtgcatggaatagatttaagctgtcccttgaaatgaccttgcctggttaaccaaaatctggattcatttttactgtgtcttttacaacaatcaccttcacagcattagacggaaccattaatgaaagcaggagctcttctagtcagtacacataaaaagaagtcgtttaaacccagtattacgtagatattaacactaaaattgcaaaaaacagtttttaagagaaagaagaagttaagaagtatcaaaatatcagcacttatttctataactaatgtatatatagaagacatttaaatggaaattatctgtgaactaaaatgagaagttagaaatagtacaataacagaaatggttattgaaatcatctgaaatttccttcccttctacagtatcaaataatgatatgacagtctaagttgctcacagaataagatagcattaggaagattttagaagacatttttggagtttcacgaaaggaggtccctgaagaatagaagatggtttagataatgctattatttaatcaaaaatgtcaaataccagcaatcacaccacctgcttttgaaagtaaaggaagctagggactaaaaggggtggtttaaaaagagacagaggaagaataaatgacaaaaagagaaaaaaataattatagatagtctaaaggatatggatataggttgtatttaagcagtgtttttttgtctcagaagtttatatgtgaactaaaatgtattaaaggataaaaaagcaatatgtacaactttttgtatgtcagtcatgcctctataaagcagttttcttaaaaagataaagaagaaaactctaggaattagcaccttttttaaaggatgagaaaagagagtccagttacaataactgttaaggttcttaaattcttttacacctcttacccccatatttctggttttcactgtatgatagtttgataatacagcccaaatttaccttttagctgtagctcttcttctttgttagggcttgattcttaaggagattgctcaggtgttgagaacaagtagtagagacacctaagtatacccagtattaatcccagaagaaataccatgttagtcactttcacttcatgcagtagctaatctttttttaaaattgtgttagcgtaaagtgttggtgaacccactcatttttacatgggattatcccaatttacataacctttttgtaacaccacattttcaagtgttggaaaataaaaacagattaacttaatattgtgactaatcgagagttaaccaaaaataattgtatttcaaacctatgactgaaaatgtttcttaaacattagtcagcttccctgccttagggattgttgactcacctccagttgtagggtgaaggatagctcagccattgagactgctgccagcctcgtcacccagggctgtaggtcaaggaggtgccagaccagggcctgaaactactctgaaccctgcccccacgttcactggttttcagcactaagatttgcttgaagtgaagaaattgtctagatgcgtatggacagtttgacattgtctgagtaagggaaaatatttttattttaatacttgtcttttaggaaaactatcatttgtcaacagggatctgtatgttttaataaagcagaggaagggtggtttgcatgtagtcacttagctaaaatttcatgtcatttaaattttctgatcatgagtaacccagaaaaattaaatatacttaagataaaataataaaatcctttcatatatataaataagcaaccaggatagttttcattctatctatctagctagctatttatttattatgttttaatttctttttttacagacaggtttttgctctgtcacccaggatagagtgcagtggtgcagtcataagctcactgcagcctcaaactctgggctcaagtgatcctctcaccttggactcccaaagtgttgggattacaggcatgaatcactgtactcagcctgggaagcgtgggatagttttcgttttcaaaagtcagttaagattatctttagcagaaatactccatcagtgctgacttttccaatctgacatatgtagtagcgtaagaacatgttttaaattttaaaaactaataagaaaataagtaaggcaagttcttcatataacaacaatgtatagaggaaagagcaatatgttaagaggagaagaaataaatttatttctatagaaacaaagacccagtgggatcaaaagaatttagaatttttaacacaaggaaaatacccatgcatggtgaggtagtagatggcttattctcttcctattcctaagatatcagtgttactttagcccaccgtaaaggaatatgaataatttccatgaatcaacgtaatgtatgcatctcaaaaagatttttaatttttaaaagattattctgtagtctcttacagtattttcttgtccaagccttagctgaaggattgcagtgtttctaatgatagtgaagtggctctaatgaggtggtctcctgatttaaattattgtatcaacatcttcatgtaacccagtaacaaaatatatgtacatacacatatatacacaaaacatgtatgtatatatgtatgtagtagatcaaaaattagaattctatttttcttaaattttactttaagttctgggacacaggtatagaatgtacaggtttattacatagatatacctgtgccatggtggtttgctgcacctattgacccatctctaagttccctcccttcgcgcccaacccctcacaacaggccctggtgtgtgttgttccccactttgtgtccatgtgttctcactgttcaactcccacttatgggtgggaacatgtgtcgtttggttttctgttcctgtgttagtttgctgaggatgatggcttccacctccatccatgtccctgcaaaggacatgatctcgtttttatggctgtgtagtattccatggtgtatatgtaccacattttctttatccggtctatcattaataggcatttgggttggttccatgactttgctgttgtaaatagtgccacaataaacatacatgtgcatgtgtctttatagtagaatgatatatattactttgggtatatacccagtaatgggattgttgggtcaaatggcatatctggttctagatccttgaggaatcgcctactgtcttccacaatggttgaactaatgtacattcccaccaacagtgtaaaagcgttcctgtttctccacagcctcaccagcatctattgtttcttgactttttaacaatcaccattctgactggtgtgaggtggtatctcattgtggttttgatttgcatttctttaatgatcagtgatgttgagcttttttcacatatttgttggctgtgcaaatgtcttcttttgagaagtgtttgttcatacactttgccacttttttatggggttgtttttttcttgtaaatttgcttaagttccttgtaaaatctggatattagacctttgtcagatgggtagattgcaaaacatttctcccattctgtaggttgactgttcaccctgatgatagtttcttttgctgtgcagaagctctttagtttaataagatcccatttgtcaattttggcttttgttacaattgcttttgacatttctgtcatgaagttttttcccatgcctatgacctgaatgttattgcctaggttttctagggtttttttaatggattggggttttacatttaactttttaatcattcttgaattaatttttgtataaggtgtaaggaaggggtcctgtttcagttttctgcatatggctaaccagtttttccagcaccatttattgaataggagagcctttccccattgcctgtttttgtcaggtttgtggcagatcagatggttgtagatgtgtggcgttatttctgaggtctctgttctgttctattggtctatatgtctattttggtaccagtaccatgctgttttgattactgtagccttgtaagatagtttgaagtcaggtagtctgatgcctccagcgttgttctttttgcttaggattgtcttggctctacagggtcttctttgattccatgtgaaatctaaagtagttttttctaattctgtgaaaatgtcaatggtagtttgatggaatagcgttggatctataaattactttgggcagtatggccattttcacgatattgattcttcctatccatgaacatggaatgtttttccatttgtttatgtcctctcttatttccttgagcagtggtttgtacttccccttgaagagatccctcacatcccttgttagctgtattcctaggtgtttgattctctttgtagcaattgtgaatgggagtacattcatgatttggccccctgcttgtctgttgttggtgtaaaggaatgcttgtgatttttgcacatttattttgtatgctgagactttgctgaagttgcttatcagtttaagacgttttggggctgagatgatggggctttctaaatataaaatcatgtcctctgcaaacagagacaattttacttcctctcttcctatttgaataccctttatttctttctcttgcctgattgccctggccagaacttccaatactatgttgcataagaatggtgagagagggcaaaatataaagaccaatgacactatgaagaaactgaatcaactagtgtgcaaaataaccagatagcatcaggatgacaggatcaggttcacacataacaatactaaccttaaatgtaaatgggctaaatgccccaattaaaagacacagactggtaaattggataaagagtcaagaaccatcagcgtgctgtattcaggagacccatctcatgtgcaaagacacacataggctcaaaataaagtcatgcaggaaaatttaccaagcacatggaaagaaagaaaaaaaaaagcaggggttgcaatcctagtatctgacgaaacagactttaaaccaacaatgatcaaaaaagacaaagaagggcattacataacggtagagggaacaattcaacaagaagagctaactattctaagtatacacgcacccaatacaggagcagccagattcataaaacaagctctcagaaacctataaagagacttagactcccacacaataatagtaggagattttaacacactttcaatattagacggatcaatgagacagaaaattagcaaggatattcaggacctgaattcagctctggatcatgtggacctaatagacatctacagaactctccaccccaaatcaacagaatatacattcttctcagtgccacatggcacttattctaaaattgaccacataattggaagtaaaacactcttcagaaaatgcaaaagaactaaaatcataacagtctctcagaccatagtgcaatcaaattagaactcaggattaagaaatccactcaaaactgcacaactacatggaaactaaacaacctgctcctgaatgactgctgggtaaataatgaaattaaggcagaaatcaagaagttctttgaaaccaatgagaacaaagagacatcataccagaatctctgagacacagctaaagtggtgttaacagagaaattcatagcactaaatgcccacatcagaaagctagaaagacctcaaatcggacaccctaatatcacaattaaaagagctagagaggcaagagcaaactaatccaaaagctagcaaaagacaagaaataactaagatcagagcagaattgaaggagatagagacacaaaaaaaaccctccaaaaaatcaatgaatctaggtgctggttttttgaaaaaattaacaaaatagatagaccataactaaaccaataaacaagaaaagagagaagaatctaatagacacaataaaaatgataaagggaatatcaccactgacctcacagacatacaaactaccatcagagaatactataaacacctctatgcaaataaactagaaaatctagaagaaatggataaattcctggacacatacaccttcccaagactaaaccaggaagaagttgaatccctgaatagaccaataacaagttctgaaattgaggcagtaattaatagcctaccaaccaaaaaaaagtctaggaccagaaggattcacagccaaattctaccagaggtacaaagagggtttcagaagataccattccttctgaaactattccaaacaatcgaaaaggagggactcttccctaactcattttatgaagccagcatcatcctgataccaaagtcagacagagacacaacaaaaaaagaaaaatttaggccaatatcactgatgaacatcgatgcaaaaatccttaataaaatactggcacaccaaatccagcagcacatcagaaaaggtatccaccacgatcaagtcagcttcatccctgggatgcaagctggttcaacatacacaaatcaataaatataatccatcacataaacagaactaaagacaaaaaccacatgattatctcaatagatgcagaaaaggcctttgataaaattcaacatcccttcatgttaaaagctctcaggtattgatggaacatatctcaaaatcatgagagctatttatgacaaatccacagccaatatcatattgaatgggcaaaacctggaagcattccctttgaaaactggtagaattctatttcattcaaaaatgattaataatgtttgaacatttgctaagaatactgtgattactgttgctttcagtaacttcctttgaattttcttcataataccaaaagattaaattttaaaaaaccattagaagagaacatgggagaatcttgctatgatctaagagtagggaagtcctttccaaacaccatataaacattaagatgatctttagcttcaactatatataaaagcaaaagtttgaagcttaataaataagcatgaaatgacaactagcaaataagagaaatatttgcaatacagtatattactgttaaatgcttctttatccaaaccttttcacagagatacaaacttgtaaatgtgtttgacaatattttattgacttgtcaagagaatcagtgcacagtgtaggtgttgggaatcgttttagtgctgttttcatgctatttgttaaaaaacctaaattttcatgttatgatttagcataatctctgagctcaaactgtgctctcaaaaccttagggacaggaagtagtatggttcaggaagaaccaaagtaatttcaaagccaaactagtcagtacttgaaaaagtctaatttttgtggtggtttccaatggagaaaatgaaaataatccctcttcagaatttggctctatggactgtttgggagactgaattgctcttttcccatttgttaaaccaggaaatttctaaggctccttccagctctccaattctctagtgctatgaatatcctcattattatcattacatctcattttgcttaaagaatgctaaatcagtagtctcgtatcttacatctatctttgtgagaaagagtaaagaaaactgagtttggtttctttatgattaatgcatttgtcaaatttgttccaagtagcaaattaatttattgtgttttttcatgaatgcaaattaaagctgtgcaaactattgtggtaaaacttagcagtccttttttataaattaaagctaactgatttaatgttaatgaaaggaactatattcaaacacagattttaataacttgggtggaaagaaaatcttagacttcataagcttttccttacataaaattcatgtaatttgaacagaaagtcattaaaatgtaattgtctatagtgaagcttgtattaattaccttgtatgaaaatctgaaaagttcctgaataaatgtctgtttctatgcattccctgaagagaagaattgtctattgattagttaattatctcaaaccaagggtcccaggttcagtttttggtgatcactttcttatctttttcctgtttgaatattctgatcaaaaccagaagtaaaacagattttttttaaatagagaagtattttgcttctgttcatattgataatacaaagagtaccagtatacatatgataaaatatttttcaacttcttggttcataggacttaatcagtgtttcatgtatctgtgtttgtgggtgtgaaaagcacctttattactgggaataagattttaagaatgattttagaaacatgtcctttaaatttgattctctcatacttttaagattatttaaattcacttcaatgtgattgtccaaaacaaagttattttcaaactcactgaatccttatgttcttctttagtgttcactattcacaaagcccattttgaatactgatcctgaaaaacatgagagaatcaaaatctgtgttttcttttgatttttgcatcataattgcatttttactcatttcaacaaggggaaatttcaactttttatattgactaaataaacaaagtgtaggggctaatttatgtttttaaaaaggaaaaatttatagatgctatgtttgattacacttatttcttaactggtatttaggaatttgtgtaataataaacacttctcatttttaacatcaaaatttgcaaggttcatcaaattctgaaggtaatgcctgattggagttaatgttcacttaattctgggtctaatcatttcagctgaaaaagagaaaactaaagcataaatcctttgactcatcctatcttatatttatgtcatattaaaagtcataaaaatggacaaaacaataaaatttaaactgaaacatatccaaaatgtttttggcttatctacctacaaaccagagacatgccaggtatgaaggaacccaaggctggagtaggtcagagggtccaatgagtttatccatcctccagacatggtcactttcagattgtactttaagaaaaaataacttcacggaggaccattataatttttgtgatgaacatgtgtaatatttttgcacccactttttagtttttatcttggctgccttaacatcttctttcaaaatgtcagcagtgattaggctacattatgggataattagtatgaacttttatctcaaagctaattttgactaatactagaacaaaacatatgtcaatatgttaaagatgggaagttgaacagattgctttcctatataaacatgtttttttctaagttcaccttactttttaaatactaatccaatctaaatgtttgaggaaggttaagcaacctgtgaaagaagcaccatttgaaatttgatggtgcagttcctaaaatctttccaaagaatgtggtatagatgcttacatattaaaatattgaccttctaggaagtttaggaaatatttcctctgaacttgaactctggggctgtagctatggttgataagctacacccaattcacactttaatgccggtgctttgtattttaacattatcttaatgtgacattgtatgccttgtttatttcttctaagcaggccttttcccaaattacttaaaattaccaaacaatgtgtttttaaccacagtcattctagagatttatttggtttttttccttccccagaagttgcttctgtcatgtttgattgcacatctgaatacagaccatgctcagagttgtagtgtaaacctcttcaggtcggatcataagcctcagaacgtgtcatacatcccataaacttcagaactagccatacacaagcttcagaactagtcatacatcccatgaagggcatcataactgatactgatctgaacagttcagtccaacagccaggcaattcagccacctacaattcaactattggttttatttgaatgaaaatcaaatttggggtataattggcttagctaaaatattcaactgggtcaattttggtcacatgagtgattctgcacaaagatatagccacattttatctcaggcatctcactcaacatttttaaagataacattttttaaaatctcgtacaaagactgcagtaaatatacaactaagagtcatactggtggatggtaaacatctgggcatgagcattatgagttaatgtgtttttgtacactgactttccatctttgcagattattctaactctctagaaataatgggtagccctttggcactgaggctcactggctcagggtcagtatttttacttctccatcttctctcagttagcacttgaacaaacaaagaaaaacaactggtctgctatttccaactcctgaaagtgaaatagggaaatagggacaaaatataattaattaaaatatgcagttattcatacaggatttgcttttgttctgataattaggatcccaatttgtcaaatgctttaaaaacatagtcttacagccttttactaagggagcgggaaggggtgaatatccaggttgattataagccatatatttgtcttttcaagatttgcttttacattgctttagggaaaatgataaatatatttgcaaataaaaattgtaatctgtatttctccaattttagtaatcccaaattactaaactaagtaatttaatttaggatttcggattaagagactacgaaactaaatctgattaaattatactttttgaaacctgatagtaccgtacttctgctgcactgcactttcttagatttaatgcctctaaagtataatgatattataagtttcttttctttatttaaaaataaaatgattactctaattatgggaactcatgtaccattgggctgaaagtcagagacagctggatggtgaactggccccttgcccagacctcagaggaagattaatttgaaaactctttacagaacacagcccagagcctactgctcagaagatcttgctttaatcagccattgatcatcagagattccctttattgacctgaaagcaagtttttttcatcttcatgccagctaaggcacttactgaaagtaagtagacagcatccaaagtgaatatgcctaacgaagaaaacaaagttttccatctctccccgcaaatgacattctgtaatgacatgtgctaatagtttctatctccatccatcccttaacccatcacgttgccatcctgtgaggaacctgtggttaacaaggggccccttctgcagatacacacgtcaaatgatctaggaaacatgtcggcagggattgtggaaccggtctatgagaattctctttgtatctgaaaaataccatggagtggatgcagggcagtgtttacccccctggatataacatcagaaaattccagatcactctgaagtctgttctctctctgatttacctgcctgtggagtttgaaaggtccccactagtgctgactctttctgacacttctcaatctatagtagcttggaggccactttgattgctcccaaaggcaaaatggggcaccatgatacttttttcactcaaaagggccagcatttatgggatatactcagtcagattctcaaaattgcttcagagaatcctctgttagattaaaggaggtcatttaatcaaacgactttccaaaagtccctgttttgaattactggagagaatgtgtactatcagggtcctggatcacttagcaaacatcagaggaaaggtttcaagtctgttttgagaaatgtactgtccaactctactgctttttccttcagcaaaggagatttatcaaggataaatttggttacagacatacctgttttcgttaaaatgcctttggccattacattatctgtaataactttcagtaaggtctaagcaatttagaataatattaatagaaaaaaatcatgattctctacaccattttcccttccattttatctaaatggctagaagtgagtgtttgcataattttttctagtgtttttctcccattttgccatgatctagttttatatggaagtcataaatttgttctaccaatggagtttgttaaaacaatattttgactttgcagagatcattgtatattttctatttattttaatgccaaacttttaaaaatattgactgctaggaacttaagagagcagaaatatcactttgaaaaatacaaaaattcatttttttctagttgatagcttgtcttttaatattcattgtggtatatctgtgctatgtaatattataagccttgtatctgtctcctatactttcctataccctcacataaatactatggaaaattattatgtgcatcactacccaacactttagccttgacttaaaacggtaagataatttcttgtaaacaggtatctgagctttaaaaaacaaacaaaaacacattcctgttagctctaactttgctcagatcccttgagagagatcagaactcatatgaaaggtgaacagattcttccctttggcaagcaattccttcaggaactgagttatgcttatggtgggacttccaattagaaaagtaaattttaaaacaaacaaacaaccaggctgttcagagattgctagacacaagatcaagtcccagccaggtgtttgacattgcccagtctctttactcttgtaatgtgaaacttagagtcagcttcttcactagtgtttttggcatcatagaaaccacacacctaaccataaatacaaaccatagctggtactaccagtgcagttctcactcttgtagaagcatgtccagtccttctcaagtcatcaactaacaagaccaaatgcacatttctagcaagggagtccttgagcccatccagtcccctgacttcacagcgatgctgtggcagcccactctgctgccgcccacaagcacacatggaggggaagccagcagggatgtccaggtctttgcccatggcctgatgaagaaaggcagctgcagtcatgaattcatagaaccagaagtgacattagcagccacctactccaactgctttccaagagaaatttctcaagagacatgctgaatttcaagtcaagaacaacttggaagccacaaactcagctggcttacagttgccatggaattttgggacttttgctgcaaacagaaacaggatccacaggttataactagctactgaccagtgttacagagcctgtggacaatctcattcctggtttctcctacctctcttcattttcctgtgttccccaccatcagccctcctctgggtcttctccctttcttactctgttctttttaccagggaagcctcatccactctaatggcagagtgctagttttccaccgaagatttgcacacacaccccagccccagctgagtagtggagaggtgttgcccggcagctgtacttgctaatggcatgggaacaaagtgttttagagtggaggtaccttttccacctgctcatcttctgcctaccatctagatgccaatgctcaaggcaatggtggatgccctggattgaagatgacagaagtgtcatcggtctgaggccctaaataatgccatagaccagagctaagctgtgttcctctccatccccttccagacagcctgccaccaatcaggaacactttacatagtgagaaacaaacttcgattttgttaaacccttgagatttcaggctttaactattgcaacagctaacattccccacctatataattataaaatcttcagattccatctatgctaattactcccaattctgcatctctggcatagactttattcctgagtttcacaactgcatatccaagtagacaggtccactataatgacctgcaggtcaccaaattcactatgtctgaagccagacaaatgatccactgctttcccacacaccctggccattcctgttccatcatatgcttgtgaataccaattgtatgcacccaggtactcaagagtgccctattttatctcccatactactctctcctaaatatctatcctgtccatcccgtttatctctccttattgccacattcttatctggtttcaataatagtagcctcaccccctactccagtctgtcctccatgctacactagaggtgtctctttgaaataaaaatctgattatgcctctctactccttaaaatccttccatggctctttctgccttgcagattaaaaatcaaagtcctagtgtaacacctaaggccactttatggaccctttgctgctgacctcctgtattctctcttaccattctcccattgttccatttacaatgtatgtcctgaagtttctcaaatatcccttccctccatgctgctgattttgtagtttccagtatccagaacacaccacacccctcctgccagtgtacttcttcctcttcatcattcaaatctcagttcagagatcatctctcttgggaatcttcaacctccacattccccttagagatcacgcctctatctttcttttcctcatggcttctgcctgcttcatagagttggcatctgcacaattgttagcaaatctaggagctcttgaatctttgccctagtttgatgttctttgagaacagccagctacaacactgcctgcaacatgccctcaatacatgtttctcaatttaacctgtattgtcatccactcctaactgcatatcctgataaaatgatgcatatgtagagctgagggtaatgcctggcttattgtaagcattcagttgatgttaacagaatcaatcatagtttttttgtattattatcattattgcttttattactatcagcaattactcaatatttttgaccatagctgatttcacatctctactaagttttgtttttctttttcttctggttcacaatcatatgggagacatttgcaccaaagtagcggcttccttcttatggctgcaaatgagcggagtgaaggtcaagggatctggagtcgtgggttcaggtgccaccactgtcaccagctgtgtgggcataaactagtcatttaaccgctccgtgcctcattttggccatctgtgacatcaggacaaaaatagcttcctgacccacttcaacagaatagttttgagaaacaacctagataatgaatgtaaaagcattttgtaactctgaaaatgataaaagtcaattattagtagtatttccaatgacataggcaatattagtataaacaatgctttctctgttgaatattgtcattcctctattttgccattatcactttcggttatttttgcatttcctagtgagtggacaacacatgtaagtcatgtgtttcctcatgggcaaattctcaatttcatcatcccaggcatcacataaattctgctttgaggactgcacacagaatcccctcactgatgatgttgctctaaattgacattgtctgtttgtctttgaatctatctttctaataattgtttccttacacggcatttcaacccatggtagacatactgatttttgcatgaatgaatgcttttgcagatacaggcaaaatctttgcgtgcccagagttttgtctactatttcctatttgacttcaagcttctcacttgatgttaatgaggatgacggtgatgatgatgaagactgacatttttgaactcttatataccaggcgttttttaagccctttacatttaatcctcacgatgacttggtcaaaagaattcgtgtgctagatccactaaaacgtaaactccatgaggtacagaatctttcatatatcatcagttttgttcactgctaaatccttggggactaaagcagtgcctggcatatagtaggcgctcaagaaacacttgttgagtgaagttatttgcttctcaaatgattttttaattatcaaggctttggagttttctgagcatctatagtttgacggtgatttcttattggtagtaacagattattattgaaattattaactaaatttatataatacattatagtttataaaacactttcacatacataacctcacttaaggcagtcagtgacatttttccactagaaatactgaaatacaatgtctctaccaaatgaaaaataaaatacagccattattacaatactaccattgttccatttcttcaatgagcagtaagcatttaaattaagaatgactagggtttctaataaggattgtcaagtatcagaattgttgggggtttttttaattgaaagaagaaaatactagaaaatatttctccagttggcttagaaagaaggaatttccatttgagttccaaatttacttaacaatctggaaaggtagctgcaagtctgattctggtaagtgtttgtgtctccgaaatcagtggcaacaaaatattttaaataaaccaagtaaagtttttgagtatgtaattaaaaatagaactgatgagatcacttgccaagaaccgtgaggatttgcattaaaaacaatgatttgagacagtcatgatttattcagcacattctacccaatgagagaacaattcgtatgaaagtcagggagtgctcagctatgttatagaaagtgttgcgtgaggtgtctgtggtgctggagtaggataacattttctataacttgagcagtgtgtctctaaatgaaattgtaaaatattatgatatgttaaaggccaggcaaaattttataaccagaatacaatgatcatttgcactgaaacattggcatctgtagttgtcactggtttttagtaggtgaggggaaatatctcttcaaatgatcagacaagtatgactagtgcatttgtcattccagtgtcttcggcacttgaagtttttccatttttgttcaacaatgtaacctttggagttttgcctaataatgacttcacttgtgctggccttccaacagataaattaaaatggaaatgcatattttctaattatgcatcgagccttagttgcatattggcgagggtggccacaccgaatgttaaattaagtctgcacaatagttagagtctatgtaacatcaaagtttcccaaagtcactttcttaatcatgtgaaggatagccaagactttgatcagtagtatgtagctatatacgatcagaggaaaaacatttaaacatcccagcatggtatttccatttaaatctgattacagtgaaataaaactgtagccattaaaggtttaaaagaactacaaatacagcagtaaaagaagacagatagtaaatgaggtagtaaaacatttcggcagggcaaacagtttacagcactcattcagtcgtcctgaagcagactgtgcaattcactacagacctggcaccgttccctgaactccacttaaacctacaattaacctttcacacctaatgaagctgttttcctggaaaattaaaatatataatggtgcctgcttttacacagacttcagaggagagcatttcaaagtgaatgacttttctgaggcttttgttcaaatgtaaaatggaagtgctatgtttgtatataaagcgggaatgttctttccaaggcaatttcatttgatgtgcagtattttattactgtacttattaattgttctgcataattgtaaaaaacacacatcagtaattttatgattagattgttactgctgaagtctgctattaccatttcacttccattagggaaaactagagttttgctaacaataactaaattcctgatgtttctccttggtggttttcattgcaaatttagtggtttaaaaagacatgtttaccatttaattatttagctgttatttacattgctgtctcttcaggtcatgttttcacatgtttcaagagaaataaaattcttaaatttcaggaggcatatattgtttttttctaaggttgcaggtgaaggtctgattttggtgtatgttctacttatttacaaaatagctgtggggtactcccacattcatttcagcattattcacaatagtcaagatatagaagcagctatgtgtccatcaacggataaagggaaaaatcaataaagagaatgtggtctttataaacaatggaatattatacagccttaaaaagaaggaaattcagtcatttgcaacacatgaatggaactggagcatattatgttaagtgaaataagccaggcacagaaagacaaatactgtatgacttcacttatatgtagaatctaaaaaaggtgatctcagaaattgagagttgaaagctgattaccagaggctaggggaagggggagggatggggaaagggaaggttttgatctaagggtacaaagtttcagttagactggaggaataagttttaatgatctattgcactacatggtgaccacagttaataataatgtattatatatttcaaaacaactaaaagaatagatttttaacattctcaccacaaaaaaagatggtaagttggagaggtgatggatatgttaattagcttgattgactctttccacaatgtatacataggtcaaaacaccacattgtatctcataaatatccacagttatttgtcaattaaaaataagctttaaaaatagctgtggtaactcttggcctccagcccagggaccactgagtcgtgcccattttctgagggaatttcctatggtctcaaaggagcctgtttcctttagggcttgtcctgccctaggtgaaccagagcagccactgggcctgctctctgttagcaaggaccagtttgaaaacaccaagagaccatggaaaattgaacaggaaacagaggatggtatgttccttcctatgcggtttatacttcctatttaaataatctaaatgtcatagtgtctggtgtttaagaactaaaagtacaaaaaggtaaagcttataataactattgaaaccccagcatttttgttgaatctactggtatatttttatgtaaatcctgctagcctgcagcatctgtgcatcatctttacgtggtaaatgaaattcctttggaccatcagtctaaaataatgaattgttcccccagttaattgtattgctttgataacaaggaactatgctaggcctagagaacacaataagtgaatttcatcagatgatttgtgtgacgtcttgaaaaatgatcttctggagtgacctgattttaatggaactctagcggcgtgcagcatgggcccagcatccaactaggaggaagcacttcctcctatggcacaagaagtgcgggatcatccccagaagacctctcaccaggaaaaattctcaggaaagtcatgagaaagtgtgtgccaaaaatggcaacacaaagaacctatttctaggttgcttttcttttattgatacataccttttttaaaacccagaaaagatcgcaaacgacctttatgtctttgttgccagcgtgaaaataaaccaagaccaagcaaatgaaaataagcaaaagctatgtattctgagcttgctatagcaagggagtcagccactttcacttgtgttttggcggagactcaaggacaggcaggaatgggaaatctttatagtgaaaaaagggaagcttcaggtgtgccctgatgagaggccgttagcttgtgggagctgtagacagactaactagaagtggggcatcctatgtggttaggggtacatatttggtttcctctggctggaagtgaggacataaattagggaagctgtttattaatcaagtcctggccatttggggccagtcgtgacagggattacagtttaacttcatgggttattagtagagatagcagtctgacttcttacaagtctgacatagcaggctggcttcctgggctggttattgcagattatagctcggtttcctgagcacgttgccacaagttgtgggtcagaattctatttatacatggtctgggcattatctacatgttcagtatcttaccagaatataactgctacatttaggggacgggggaggtaatacagtctttttaaaaaagctattgacttggcttctcttttcatcagttaagaaaattagattccttacaataacaaagtgtgctgaaaggcaatgacagagattactctctctctctctctctctctctcttctctctctctctcttttagtgagtcttccatacacactatcgaattcaataagataggggctttgtctctttttttcattcttgtatctaggttctcttgtaggttgaaagagaacgtagcaacttctgatgtttttaaggttcaccttatatttaacatgaagaaatgcaaaagtagtaataacttgatatttaaggcacacacacatataaatgcagttattatgattattatcctgttcataattaaactacaaggtttataaagaagaataactcatgatgggccacaagccgtggggtccagtaaaggacctaagccaaatgaaacattgtttggcccatcaaatgggcagataagactttgggcaaatggccctgagtgttctctgtgagtgcaccacggcgaacacttaaatatctctgcctagagaagtgcaagcctttctacatacacattgccatttatgcagatctgaaaatgcagttgattgttacattttaataagaaatgacaaaaagctgtcaaattaaaaataagcatgatttgcaattttatttgtaaattaagaactgaaatatttatgattttcaactgaatgtgtttccaagtttcagaatcattagtaaacccaggacatgttgtcagagacattgcttcagttaggttctggacttcatgaaatacagcgatacagtggcagttttggattagcgtagaatttcctgttttggcaactcaagctgcttactcctctcccgatgctatatcttctgtaatgaaaacatttgcattcacatgtaaatggaaagtattattttttcagagcttctttggactacatcatgcagtagtttaatgaataacatgatttcatatttggatgttgtgatcattgaaattagtgtaagtggtctctgtccacattaaaggagacatgtattatttgtcatatttggctgtctctggattagttggtgccaggaataaaatagcaggaagttgtaaataatgacagaagtatgccagaagatcagtggaaacttacagtcagcttgaacttttagttagcaccaccaaaatctgcaattttaaaaataataacaaggtccttcagctccattaattaaacaaataatgaaataattatttactactgcagaataagtgtttaaaacatctatgttggactcttcagaagttcccacgtgctcttcaaaggtcaagaaaacagcttttatgtaaactttgaacttgtaataactctaaaacattcaggatgatatttaatatcctgaaagagcaaattacttaagagcaacccttaaaaggtaaatctgtaaatttatcagcttagccagagcttattataattttgtaatttctttccttgctaacaccataaatttctccttctccacaaatctcttctgttttcaaatgtatccaaggctcccttttcctttaaataatgcacttacataattccatgcatccacataaattccatctgaccctgctaattctgttatgtagataagcttccttatctcttcccattgctaaacatcttaaacatggaacttatgtctgctggccgtacttcctgtcactccattcgttgtttaactttcaggcttccatcctcagttagataccgaaatgactcaaagatcatcagaatcttcttggaggaagtctaatggcctttgccacaggccttaccctgctggcccatttgccactttttacagactccttgggcttggccctcccttgactcccgcaacactgcactaggctagtttgctttcctcttacagtgctcacatccctttactgtcatttctttctgtccataaatctctgaattcagttcctgccaggaaatatgtgaagcttacccagaattaactgacccacaggaataaaataatgatattctacgtaggataagatctgaaaatgatcttcctctaagagcaacatgtggagaagaggtcagctcaattcaaagtcaagtcttcaagaccttgtagaaaggaaaatgagccaaaagtccttttgtggccttttcttaagcaaggccaatctggcctcatggtttagtatggtgatttgatacatttggttttactcaagagttatatgggactcaacagatatgaaaatgactcatatgtagctatgataagccaaattatctggttgagccatggctcctataaatttaatgaaatctttactatccctgagcatcttaccaagtgttcctgtccatcattggacaaacaatgtaacaaagcagatcaacataattaaacaatatgcttcttaaattacctatgatagctacagctccgcatttgtggtcacattcggtcaataatactcaaggtccttttctagtacttaagacgcttgtcagctaaatgtcaagtggtctttcttccatgtccatttgtacatagcataactctatccatggagtgcttttgtaatttttaaaacagtttatgagaatgaaaagtcaagccatagactgggaaaaaaatatttacaaaacacatatctgataaagaactgatatccaaaatcttcaaagaactcttaaaactcaacagtaagacaacaaacaacccaattaaaaacaggcaaaatatctgaacagacacctcactaaagaaggtatacatgtggcaaagaagtatatcaagaggtgctcagcatcatatgtcattagagaattgcaaatttaaacaactgcaagatactgccacacacctattagaatggctaacacctaaaacactgacaacaacaaatgctggtgaggttgtgaagcaacaagaactctcattcattgctggtggaaatacaaaatggcacagccactgtgaaatacagtttggctttttttttttttaactaaactaaaacataagcttaccatattatccagcaatcaggctcctaggtacttatgaattgaaatgttatgttcacataaaaacctgcacacagatgtttttaacagctttattcacaattaccaaaaattggaagcaaggacaatcaagatgtccttcagtagtgaatgcgtaaacaaactatggcacatccgcacaatggaatataattcagcaataaaaggaaacgagttatcaagccaaaaagaaaaaaagagatggaggtacgttaaatacatatttctaagtgaaaggagaccgtctgaaaggctacgtactgtgtgattccaaccatacaacattctggaaaaggctgaactacagagacattaaagaaagatcagtggttgccagagacttggggaaagggggatagattggtgaagtgcgggggtattttagggcagtgaaactattttgtatgatactgtaatggtggataccctgcattatgcatttgtcaaaaccaatggaactatgcaacagaaaaagtaaaccctaatgtaaattatggacttcagttggtaattttatctcaatattggttcaatttttctgtaaatctaaaactgcttgaaatgtttttaaaaatcttaacatgactagttttgttcctaaaaaaaaaaaaaaaaaatagtaacatttaaaatttctagtacctccacagcaaactcgtgttcagacatggagaggaaggtttagggtcatatgcacaactaaatgtgatcatttgtcaaacactgatttgattgttccaagtcagagtcagttaactttcttagatctttcttcttcttccttggtgaagttcacatgcccaagtcaagaaacattttaggtaaagggcaaactacttgaaaacttccattaacagccaaacgtgtgatgactaaatgaaaagcaataaaaagcagggcccttcaccaccactgttgccatcccagaaatgtctaagcaagcatttaaatgcttttctctttccttccaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagacttgaaagaaagacattttttaatgcctgaatgatgagaattgtacagtttttgcctcataagcaaacttgaatcacctgtgtatgaacagggaatgaacacattgcaatggctttaaatgctcttttatctcgttgtaaaggtaaggcaagattttgatgtagtaggatgtaggtaatgtatttaaatatttcatatgaccatatcgtgtccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatggaaaagtctgtccagcgatcagttgttcccctccttccaaaaacagcctccaataccacaacctgaaaagagccgaaatggttattttacagcatacaagcttctgctccagtatgataatttttaattgcctaagaatcattggatcagacctaaatgatccatctgcatttttataagaatggatctttctttgcccttcctctcctagctgctagattttaactaccttttacaaatgttacaaaatgtattttagaggcgacatctctcaagatgacctgagttccttcctgccaactgttccacctagaatacaagtagagaagagcactggctggcaagcatcaacaggagtcttcttcccaacacgagcgcatccatgtcctgagaaaaagtctgtggtttagaaaatatgtccatggttgcccacagtcagcacactcttagtgactcaaaattctgaattatggcagaaaggaaaaataaaacatacttcacattagaacacagaatcatttacatcctaatactgaccacagttcactaaagctcagtagcattaacagatatagtttggaattgcagtttcctcacttcagggtgacaagatatgtataacagtgacagaaatctccaaagctgctgtatatgatatagctttgttaaatatgaaggtcctttaaatacaattgatgtttagtactatatatgtacttttcacattctttggatttctggaaggttatgacactttactgtttacagctaatgcatagttacttgcatgccatggttgtacagtagcagactatgaccctattgtgatattaagtgtttatttcataatgccatttatacatagctgaatttgatgaggattgaatgtcatatataagaggaatgatcatacaatatgtagttgcatcttatataagatttctaggttgcatctaaccatgactatgtcattattttgataattaggcatttatgaattatagtatatattcctcatgttggcatgataattttgctattttccatgcattaaaaataagacaaattcttagagtaattttagtaattttatctataatctgtggggtttttttggagggggaggccactggttgtttctacttccctgtgatattttctctctcattaaaggaatgagctaagtttgtaaatatctcctaaaaacaatcaagtaattttattagcttcttttggaccctctaaatattgacttctctcatgaaaaaataaattgatgaaactaatgattacaaagatataatcattttttaaaaagtgattgcccaatgtatttctctaacaattgtcacaagagaaagcataacaataaaaatacaaaaacatacagatttagatgtaaaatctatataagctatatttttagggaggctaagcagatagtattactgtggaagaattatcaagttttattcacctcaaatcccactgggttcttaaaacttgaaaattcaaattgtagagaattatgagacacaatgtgatgtttagttaaagtcatgctatacctttctgggccacatattgctaactctgtggctaattatgcaattaattctcaacgtatcaaagcttttcactggcagtaaattctttgccctcaggtgaagtggattgaaaagacatcaaggatcaaggataatcactttgaatctgttggtttttccccctacattccagacactttaaatttggatgctttcattttttttaaatcaaaccacacaaatatgcagatactttcccagaatttcgcagttaaatggctgatcctcttgaaaactaaccttaatggaattctaaacatttcagtttagaatgactttgaaaaattccttagatttttaggatgttttattctgccaagtatgaaaaaaaaatggttaaatacaatggagttttaaaaattaacctggggattctatttgaactagaaaattcctattggaaaagaatttgcacatacttacagattcagctaataaattttaagaggattaggattctcataattctttaaatgaaaatttgttttagtgatacacagagatgccgtatactatagtgttatgttcagtaggaaaacttcaaatagttcgtatttaaaaaggtaattgatccttgctgtacttcccaacatctcatcttcttttagctgcagtaagatagaggtgactgtatggctacagttcatggtataaggtcatttagggtgcacactggcacacaggctggaaaacgggcactggacccagctttcaggtgtgtggtgctgggtaagtttcacctttgaagcctcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgaataacttaagttcctgtatttctaagatatagggatttctacaaaacgactttgacatttagtcaataaagacttaaactcttcttaaatctatagttttaggagagtttttcttaaaattactgactgatgacattgagacaagagcatcaatgatcacctttcacgtacaaactaggcaagacagggtcagtgcttacattttgtggttatacatgatacatcttttctcagtgaacataaaactatgatttgaaaggtgtcttatatttaaaaaagattgtaaaatgaaaactgaccaaatgaactaattctacccacctatggtctttttaaatgtcgagtttcaaaacccatttgccgtatactagagtgagcttggaaacttacctgattacaggaattgcttgggttcaggcagattcccactttcacctctagagatttagattcagaaacactggggtaggccctggagagcagtactcttaacaagctcctcagtgcttcttaccattaggcaaattagggaaacactgcattgggtcaaagtgctgcctttaatcgaccattagagggagttctctaaataacaaagttattactctaattcaaaatgctttaaagaattttccaaggaatacaagccatctggttggtgttagttatagcagtgatttcattagagtgtacatttaacattttagttttatcaaaattttttgaaattaagaattagaaccagagctcctatcagtatatatgtacacaggtgtgcatgccagtgttcaaaagattgtgtaaaagttcaagcccgttttagaaagccaacattttatgttataatatgctgttaatcaggactttattaaataaaaacattggctcttccaa

SEQ ID NO: 1000 - DNA, 42972 bp, Homo sapiens
gcaggccgcggcgggcagagcggggggaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcggtaaggccgcgggctgcgggcgcacggcaggccggggatggcggcggcctacgctccccggcggcctcggggacaagccgggcggccttggcccggccctcggcggccctgtccccggttggggtgaggccccaggcgggcgccctgggcggccgccgggtcgtgggggcgcccggggcctcgggcctggctctgcgggggtcccgtcggtccctggctgccccaggccggcagtccctgccctcctccaggagccggggcgggggtgccggggaggacctggccgcccaacgccgctcggtggtcgcctcattcctctgatggggccgggggttcggggagcacctggcggggtcgcagagagctcccccgggctcccttaacgttaaccttctccggaaaaaaagtggtcagcgttgagcaagacaaaagaaacgagcaagcaccgcttgggcttggttctgttttgttttggttttcgggggtagaggtgggagaggcatggtctcgctgtggggcgtccctggcgagggagccgccgaccagcccccgggttgctggcttttgctttcttgggcctggaggccgaactcagctgaaccttatgtattgatctgaaataggagtttggagggtccagtcgagtttgctttcgacagcttccaagctcaccgagcccagagaccatctgtttcctttcttgtctagttctcttcctggacactcttcgtttatcctgcaattgtactctcctttgagggttttagacaccagcatagagacagtattcaagtatcctagtagactaataagtgaaaagaaactaaaaagaaaatgccttgtcactgttctagtaagaatgctagttgcttcacttgtttactttattctgggagaactgcccaaattgaaaaatgcattctgtgcagaaacaattactttgctaatttttaacatgacattctcttcctatgttcatattatgtgataggacactttaaaatgtacactttaaaaatgtcagatacaacaatgattttttatgggcaggcaaaaatggagtttttgccttcagtaataaaaacaaactttagtacaattgttatttaagtgatacatgagaagcgttaaaaaatttagctctagggcaagctcttgggaaaatgtatcaaacaggaaaaacagggtttcataaatgtagagcagtattacacggagggaaatgacagtggtagacttcaagacaacttttagtttttacttgcttatacacactctacttttgttgaaagaatttaactgcagtttattaaaacatttaaattttgttttctttaaaaataccaagaatcatttaattttatttatttatttatttatttattttttgagaccgaatctcattctgtcacccaggttggagtgcaggggtgtgatctcaggtcactgcaacctccgcctcccggattcaagcgattctcctgcctcagcctccctagtagctgggattacaggcacccgccaccacacacggctaatttttttttttttttttagtagagatggggtttcaccatgttagccaggctgctctcgaactcctgacctcaagtgatcgcccgccttggcctcccaaagtgctgggattacaggtgtgagccaccacacccggcccgaatcattttaaccttgaatatatgaaatacttgggaacacttaatgagatacttggtaatcaaaatttactatattgcagtcagctgtcttatccgtaggctctgcacctgtgatttaaccaaactcaagtaaaaaaatatttgagggggaaaaaaattctgcagagttccaaaaagcaaaacttgaatttgccatattcaagtactgccttgaatccatgtgaatgaagtgatgtgtaggcattgtattaggtattagaagcaatctagagatgatttaaagaatacaggtatgcataggttatatgaaaatatgccattttataacagggacttgaacatcctcagatcttaggggtaggaagagatgtcctggaactagtcccctacagataccaactatatttatatcctttacccatcaggctagtatttacagaaataagtacttagaaaaagaaagacggctttcctgctctcctagtaaaggctcatttttatccggaggcctgtgttttcttgtcctcgttatctttttataattgtatatattagcatctgccaaattatctggctcctgctctgtaatatccttagcctactttgctgaggttagtgagaaaaagttagagtggcttgtgttcacctagtcctgaaattaatgcattgcatttagaagtgtaatgttttcatttgcttagacctaatgttttcatttgtggcaccacccatcttatcttgataggaggttaaatctcatgaaaaatgtttgatgttctatactaacctttttttccccccttttaacattctctcttgggaatgaactcatgtgcaatgatgaataagccatccttgtgtatttggatagttttttcgtagcccaaggttagtttccagttattcagttctgtttattaatttgcttgatattttcctctatgaaccaatcttaccattcctcagttcatttcattagctcttctgtgtgttcctgttcatgtgtacgtccaattagcatttcctgatgcagtattccaattaacatagttatcaggattatacagagacagaaaatacctggatgctgacatgagcttttttcattattttgttggatcagtctgtggagtaatgcttttccaaccattttggtatgattactttccaggtttccttatttaattgataagccttcaaatgggtttttaatttttaattaactatttacttatttttcgagacagggtctctgtcacccaggctagagtgcagtgacatgatcatggctcactgcagcctcaacctccagggctcaaacgattctcctgcctcagcctcctgagtagctgagactataggccagcaccaccacactcaatttttaaaaaaattttttgtagacactgggcctcacaatgtagacactgtgcccaggttggtctcacatttttgggcttgagtgagcctcccacctccatctcctaaagtgccaggattatagggatggagccatcatacctggcccaaatagtttttttagtgttgactggatgtattcatttaagtgaggcttaaacatagagtttatcttactgtttaattaatggtttctcctcactccctggcaactacttataacgtgaaaaatatgactaagatattttccaaaattaatatttgaaaatgtgttgttaagctgatagactgcattttgagtatggaagataagttcacaccttcttgattaaaaacaagaactgtaatgtaactcctgcctccctttttagaaatgacagtcttctctcagtacagaaatgattggccagtaagagtcttatgaaatgaatctgttagccagttgccgcatgtcacaagtctgaattcaggcctttcttgtagttagttccggggttagattggattgttttaacacaacttcttcaaaagatagataaaacactttccatgtagtacaatttggtatttgttgagagcctagtcctcactagggaatgtgccaagggcatgttcctcttaaattccaaccagttccacccttgcgggcagatttattccagagaggataaaggacagtgtcagggaagagttttatcattttagctaattcctttaatggaagtcatctttcagaatgtaagtgcaatgttttcttttcaaattatagttaagagttcatgatgattgttgagactagcaattccttaaaaatctcctgtgccctggaaattcaaaccacaaatcaaatgtatctcatgttttctcaggcatattcttttccaacaagtgatctctaggttcagtccttcactcattcagcacatgtcttctgagtcaccacgaaagcctggctccaagtgagggaaacaaggtggacttggtgtgcttgtgtccttggtcacaatgcttacagtctcatatgggaaacaaaacaaatatacaagttagattacagaataaggaatgcctaagaatgtgttctagcccatagagccagacagaatcatgttccattcctgcctctgtcccttccttctacacttggacaagttacttgatatgtatacatttccatttcttcattataaagggaaataattaaacctatcatagaattgttgtgaagattaaaatgagataatgtacatgaagtgcttagtgcagtgcctggcacataaaaagtgctcagtaaaagtcaaccattattgtcatttggatgattggtttagccagtgaactctataggagaagggagcaagcatttaggattggagttgttatagaaggctctctggaaggaagtgagcaagactttagagaggcagagaagatggggaaggtcactaggaaagccaggggcagaaagaagcatttaaaaaatctgggagtggcatcaggcacagtggctcacacctgtaatgccagcactttgggaggccgaggcggacggatcacctgaggtcaggagttcgagaccagcctgaccaatatgatgaaaccccatctttactaaaaatacaaaaattagccagatgcggtagcatgcgcctgtaatcccagctacttgggaggctgagacaggagaatcgcttgaatccgggaggcagaggttgcaatgagccgagatcacgccattgcactccagccagggcaacaagagcaaaactctgtctcaaaaatcaaataaaatctgggagtggaatgttgatgatacatgagacacagtaaaagcagaggtggcttttagaacactagttttcatctgaattatccatctagatacttttgtgtgatgggtatattggacacagtcaagactcccagttgaaggcagtgtttccttgggtaagtcagttaaccaattttgagtcttcagagtttgagcaaaataggtttatcacaagagtttaagatcatacagtatgtgcaaaatttgcagtattacacctggcacataactactcattaaaaggcagtgacttctgtgttatttatgcatttatatatattatcaaatacttaactctgtgtcatgcctgagttggaaaccagagattgagtgatgaaaaagatgatacagttccagccctcatagagctgacaatctagtggaagagatgaataattaaacaatgacaaaagtgggatatgggataaaagagagcaagccagctggtaaagagtatcaaggcataggccgggcccggtggctcacgcctgtaatcccagcactttgggaggccaaggcgggcggatcatgaggtcaggagatcgagaccatcctggctaacacggtgaaaccctgtctctactaaaaatacaaaaaattagctgggcgtggtagcaggcgcctgtagtcccagctactcgggaggctgaggcaggagaatggtgtgaacccgggaggcggagcttgcagtgagccgagatcacgccactgcactccagcctgggtgacagagcgagactccatctcaaaaaaaaaaaaaaaaaaagagtatcaaggcatatatagggactccatcctaggcaggaagagcctggtcaagctttgcagagaaagcgaagtctagttaagggtttcatgtcaacttggggttgagatagtcattgcatgaattttttaaaatttaattctctgtgttgtaaaaaattaaattggaatctcttgatactgattcacacttttttttttttaactcagagcatcaatatttttatgcagtgataaaacaggtaatttgcatgttagaattagtaatgaaagtttaccagaaagttttacataaataaggacatttattcatgtttgaacaagattattactaatctaagttattagcaattgagaactgtttaactctctagttaaataggtttcttatttaaatctaactcctggagggaggtattcacaaagtaacaccattctgctttgaatttgactgtaacctacaacaagggtcctgacacaaatgcactaagacttctctgtctggtgaccagagaatacagtttcaattcccttgaaatacagttaaatcccactcctgaaataatctggaaaaaggatactgtaactcctcatatacccaggaggttgccttggaaaaatttaacaaatcatagcatttacacttaagaaattaggtacagttcctgaaacaacaaatttcatttgggtttgtcccactcgtgaatgcacttaactgtataaaggtagtctatagaagtcaggtccaaaaaaattaggaagaggttttattattttgagaacattctaaaaacaagtggctgattaaaacttttttttatctaaacattttaggaagatgatactgttttcccaagttaatactttgattcttaattttcttccttattttttccctcaatctcccgtaagtttttttctccccatgttctccttgaagttaaagtactcccaaagattttaactcctttcttgcagtcttttttatttttattttcttgaaaataaggtgaatattttattctcttaacacagtacgatttacagtggaagatactgataattgttgaaatattttcaggtctattttattccataaatacatttcatcttcttgattgaaacacttaaggtgtttatgaccaatatttctaatttggacaatagttcggaaattgtttcgacagggttgccagctctgaggtggatgctcaggacaccaagaaatcaaaatggtaccagtagaagtgcaagaataacatgacctcttttaggtcatctgtttagaggaagtctatgaaaatggactctggagaagtaaagaaacaaaagaatgggtactccataggcagggcagccccaagagctactagttggctatttttctagttattaattgatcatatgctaaacaagggatggcttattcatgaactttctggggaaaggggtgggccattctcggccttgagggttcctcccctttttagactatatagggatggcttattcatgaactttctggggaaaggggtgggccattctcagccttgagggttcctcccctttttagactatataaggatggcatctttcagacattgccatggcatttgaaggctgtcatggcactagtgggagtggctcttagcatgctaatgcattacaattagtgtataatgagcagtaaagataactggaggtcacttttgtgaccatcttggttttggtgagttttggccagcttctttaccgaatgctgtttatcagcagggtctttatgacctgtatcttgtgatatcggacctgtgacctccagtctcatcgtgtgactaagaatgcctaacctcctgggaatgcagcccagcaggtcttagcctcattttacccagctcctgttcaagatggagttgctgtggttcaaaggcctctgacaacactaggactaggggagctctcactctctttcactctttaaggaaaagaaatgtagaaagtgtatgcaaatctttttctatccatttaacacacacttgaaatacttgtaggtttgctataagatggctgaggggatataattttgggcataaaacttctgaagtaagttttagagctaaaatgttgagcatttttgactttgtggaatttaaattgttagtatcttgttcaagtagttattttgctaaaaatatgcactgcctaatccaagcttaaaaaagaaaagatttacatttgtatgtcactgaatgtagggtacagttttaatctgattacgaagttgactttggtatatgttttagtagtgatgatgtggaactaattacatagcagctttttactgttttgcatttcaaagtcctaggtacaaagattcctggctattagtaatttcatttactgatatgtcagtaatagaatattgtttcgttttcatttaatatacctctgaaacctacttttttttttttttttttttgagatagaatctcgttctgtcatccaggctggagtgcagtggcgcaatcttggctcactgaaacctccacctcccaggttcaagcgattctcctgtctcagcctccccagaagctgggactacaggcgcacggcaccacgcctggctaatttttgtatttttagtagagatggggtttcaccacgttgcccggctggtcttgaactcctgacctcaagtgattcacctacctcagcctcccagagtgctgggattaggggtgtgagccactgcccccagcctgaaacctacttttaaaaaagtgtcaggggaggaaaaaaaagcttgatactgtagtttaataataatgttgataaatatgtttttcctcttcttgataactcatttttactttcttggatttgacttattttgtttctctttaatatctgacatataaaaacaaagttcaccccttatttttatgctacctttgcattgtaatagataaatacagagttataagttatgggaaattttcaatgccattttcttaattgttgtggtcttttgtttgtgtagcttgcaccttctcttcctttacaagaagattttgtttatcactggaaggcaattacccattactacatagagacttcaggtaaggaacaatgctgatattaactgaaaatttgtgaaagttaaacagaaaatttgtgaaatactaaaatatttttaagtaagtctccaaagttattttatatttaagtttatagacaatcttatctttgtctttaagattcagtcactcatttaaaaatatacctgttgagcacctactactgtgtgtcaggcattgttgaggcactgggggatagaacagtcagtcaaacagacaacactgctgtcctcacagagtttatgtattgattgggaggaggcagacagtatatagacaaatatgtatagtgtgtcagatgataagcgtcaagggaaaatgaagcaggctaaagagtacgttggggtggtgggagtggacagttggctattttaggttagagaaaacctcattgcccaatatgacttgtgagctgaaatctaaaggataaaggaaccaagcctgctagatatctgggggaaggatgtctcgggaatgagacctaattcacaaaccctcaggccagagcatgtggcacgcttggcacatcccaggaactttaaggaagccagtgtggatagagcttgaacattcattctttcttggagcgtttgtgtatataaaggctacaattatggggaaaacacatttttaaaaagtaaattacaagtaagcttacaaatcgtcttttactagtgctaggctactcattttagaatatgaaatgagacataacatttcttgaattctttgtgctaaggactgagctttattatttcattgaattcatataacagtactcactagtgtttattagttccattttatagttgttggtgactgatgcttacatagtttgcaccagttcatccagctgaaagtgacagagccaagatttgaatccaagttgtctaactccagggcccatgcttttaacaactgtcccataccatatcaaacttgatacatatgtcctcctgaaaacaaaggtgacccttctctatccattgttttctccataaggcttagtgttatggttttctgtgttagtatacatacagacaaagcagcatatcagtacatagcataccagaattgtgttgttcaaactatagaagtacaaagtaaatgaaaatagagacataagtaaagaatttggcacttcctaatgtattttgtatttaaatgttctataaaacttcacatttttaagagtaatttaaccttagtataataaggatgggttgataaaaccatgggatgtttgagtctaactgtgatatgttaaaaaatatcactaaatttttattttattataagaaatcaataatatttaataaaaattctcctgagaagcaactttgaaaaacagattttggaaaacagctatacgttaatgagagatgtcagtaattttaatagagggttttccttttggcttctcattgtaatagaagaaaatgaattaaggacattaagtgacagatttcccaatcctacaaagtaacgtagtagcaatccaaaacagaatctgtcctcttcatatatcccaggttatttgccttcatgttcaaggccaacctatttctatttaaagagacttaaagttcagatcttctgaactggctaagtgaaaaaaaaatattttaattataaatacacatagaacatttttgatgtgacatgtatttttcctggtcatgttcccatttcccacataaatagctcttatttctgaattactgtggatagatgaatgttagcttatggaatatatttgagatttttttttttttttttttgagatggtgtccctctctgtcgcccaggctgacgttcagtggtgcgatctctgctcactgcagcctccacctcccaggttcaagagattctcctgcctcagcctcctgagtggctggaatcacaggcgcctgccaccacacacggctaatttttttgtatttttagtagagaggaggtttcactgtgttgaacaggctggtcttggattcctgacctcaggtgatccacctgcctcggcctcccaaagtgctggaattacaggtgtgagccaccgtgcctagccatatttcagaatattgattcagttttagggtaagaatatgacaaaatgcatcatctaaattctagcagagataatcatactgtgtttataaacctcacttaagtgtgtagttcagatttttctcagtttgaataggaaaagggaaatacagagtattttaggtgcaaatatgcagtttaaaaatgtttaaatatttgatgaatgttttttattgtttagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgatgtaagttcctgatccacaccatgttcttgggcattagtacatgcattaatgtcttacgaataaagaagctgccaaatacttgattataaaggtacatattgaacatggcaggattcaagttaagattgtagaaaaaagaaaattgtgtagcctatacaaatatgtccatagagatagaaagattccaaacactctagacaacaacttgtacttggctgcttagaattccaatgtaaacatttatgaaaataaactcaagtacgtgagctcagaataaaaaaaagagatagaaggaagtcagttaaaataggattgaaaaataggaattatttgtcatagtcctggaagagaatgtcactgatgattttgacactaactaaactgttaagtggagccaatttatattttttaggcctgatgaattttgaaaaatctttacaaagctgaaattgtgatatcaataatattttatattccaaaaccttcaaattacttatagagacaagttttccagccgtgtggccgagtaagggaacgggagagccttgggttcagattagggggccaggcttccagtcctgacatcattattcacacactgtgaccattgtaagtctctttggttaatcttcctcctctttaaaatccaggaagtgtttgctaaggggcctccccagccctaaaagtctatatagttctgtgaatttctatgatatatgtgaaaaaaattaggctaaaacaaaagaaacctgtagacacatttttatgacagagagatatgaatagtagcatgcaagatgatttccttttgtctgtctgtaatactctaatttacttttaagttaaattcactcaatttatgttttttaggcaacacacctgctctctaatattctgcaactcattctcctcctcctttttcctgtcctttggagagaaggattgttaataataaattgattaattgatttttgagcagaagttagtaattgtacgtctagtaaatttattttaatacaggtgattgtaaatataatttagtggtttatctaaataatgtaaagtatttgctagcttaaaaatattgtgcataagattatagtttatactatttccagataacatgtctatgatgatgctttggaaatacttattttgtaactgtatttgaaatgtgaagcagtataagcagcttaattaaggaagttaaccttgttaattcatactctcttaatctgcagtgtgagtgatcattgggtttacctacttttcagcaaatacttaaaacaactggcatgttacaaaaactaatttattaaacattctttgcctattataatcataatgtaaataatttgatttatattatgattataataggcaaagaatatttacagttgacccttgaacaacatgggtttgaactgtgtaggtccacatataggcagaatttttgcaaccaaacatggatgaaaaatatagtatttccaggatgcaaaacctgtctatgcaaagggctgaattttcacatatgtgggttccacagggctgactaccagaactgagtgagtgcagatttgggtataatcgtgtataccgaggcacagctctaatttaaaatgatgttaggataaaatcacaacagtttacaccataggtttccttttatttacatgtgtgttaggaggctttatttactcctacatatatatgatggaaagttgatgacatgtctgtcattagtgtaagtaacaagattttgcctttgttccagcggggtgttaactattacagtttcatgttaccccagcatttagaatataaacaggttgacattgactgcaccaagctctaatctcaacaacatattattaccgtgctgtttgtaactacatgagcctgtggtctcacatgctgtgttatggtctcagatatacaatattatttctagaatacctgtcattaatatttgattgaaaattttattctgacagttattaactggccagttgcattgtcttttcaaggtggaatacattcatatacattgtctctccaattttttaagcttttcagtaaatgtgtttgcattgtctgttgttttcctgttggcttccttttttcctatacccagtgtcctccgggaatgaaacagcaggttttggttttctatacgaaacttctgggaagaatccggcagccactacttccacacattaacgtgcacaggccagtgcaggtattttgttccccctacataaaatcattttgtttgatttcttttaatgttgaaataattttatattatttttctgagagtaaaaataatgaaattattccaaaattaacatgcaagttagcaaatacttgagctttctttatgcatcacatagcattaagtgtatttacagtgtacttacagtctttctgattctctttaaaattttatacatgaattttccttggattttacttccatgacatctgaaggagaatttattatataactcgttaattatttatggtaatgaacttgaaaattttaccactagtaagtttattttgatatagataattataaatatcattagtgttctgattaatgcaggatatttgcattatatgaaaaatttaaatatccttaaggtaaatgaatggttattttacaaatttgtaaaaagtagcctaagtttaaaaagttaaaaacaattgttttcacagaaattaattagactctgtggtgaagtcctagcaacaccaacagaaaatgaagagattcagtttctttgcattgtgtgtgcgaagctgaaacaggacccctacctggttaactttttcctagaggtatgatacactttttatcaactttcaaactgtagttatattaagatcattatgaaaattgaattatgtgaataatattagaaggagctctgttttgcaggttattagcttgttttacttcccagaattatttttcctttaatatcactattttattctcctgggagaaaagaatttcaaagaatgcagttgagccagatatatgaggtggtacagggactggacagatacaaagtcatggcttaaaagaggacagcttgaaggttgaatcagagatagacaagtcacagaagttgatatgctatcatattttcagccaagcttgccctagtatgtaacatgggaaatctggcctgggataaggatggcatgtgcagatttggacaagatggaaaaaagcacgagttatctctccatcctcatagcagttgggattgctgtagtattttgtactgttttgatagccatagtcaccaaatcatagtttatttaaatcaagtgatattttggattttactcctagatttaaagtaaaaaatatatttttgtactttttgccttcattcacttctttttttcagcagtgaagtcattttggaatattttagaaaaaatgattatgttgtttttgtccttgtttgtaatttatttttatttttatttttacttttttgaggcagggtcttgctttgtagcccaggctggagtatgggggcgtgaccattggtcactgcagccttaacctctctggttcaagtgatcctcttaccttagcctaccaagtagctgggactacaggtgtgcaccaccacacctggctaattttttaagtttttttgtagagacagtgtctccctgtgttgtccgggctggtctggaactcctgagctcaagtgatcctcctgcctcggcctcccaaagttctggtattataggtgtgagccaccacacctggccttcttttgttttttaaaaaatatttttctggccaggcgcgatggctcacacctgtaatcccagcattttgggaggctggtgcaggtggatcagttgaggtcaggagttcgagatcagcctgaccaacatcgtgaaaccccgtctctgctaaaaatacaaaccttagctgggtgtggtagtgcacgcctggaatcccacttatttgagaggctgaggcaggagaatcccttgaacccgggaggtggaggttgcagtgagccaagattgcaacactgcactccagcctgggcaacagtgtgagactccgtctcaaataatacaaaatacataaataaatttttctttttctttttttggattaagatataagttacatacaatagaattcactcgtttcagtctgcattctgtgagcttgatgaacacagttgtgttaccaccacaatcaagatgtgcaacagctctgtcacactaccccatgatcctctgtagtcatcccttctccacccctacgccctagcagtcactgatctattttccatcccaatagttttctctttcccaaaaagtcatagcaatgtaattagccttttgattctggcttttaaaattagcttattgcatttgagattcatccatgattttgttcctttatgttgttgagtactataccattgtatggatgtaccacagttgtttatccatacaccagtgagggacttctgggttgtttctagttttttacaattgttaatgaaaccactaagaacatcacacacagatttttgcgtggatttaggttttcatgtcacttggataaatacctagggtaggatcaccagatcatatggtaagtgtgtatttattttcataagaaaccgccaaactgtttcccaagtggctttgtcattttgcatcccatcaacagtgtacgtgagctcctgttgctccgtgttgtcgtcagcactggatgttgttaggtctttgtttgttttgttatttttaaatgttaaccactccaatagatgggtttgttttctattttacattactaagtaaattaggattctattctggactcttaactcgaattaggtaagcagttaagctgtaaaatttcatgaatttaaatttctaggtggtggtaaggactacgcatgcccttaacactcatcatgcgcatcgtgtgttgttcgtgatgtgcgttatattttgtatcatcttttgcaaatttgcttcaaaagggctggaacagtcttatgattttggatttctaaagatttataatgatattagaattttttttttagttgtttgtgtacttatgagaaatatctcagttttgctgagatttttcttctcaaggttcatttttgctaaagctttcttagataaccttagtgtacttggaatgcatgtatttttttccccaaacttaagcctggagaatttctttctcaaaaatttctgaaacttgttttctaagtgcatagcatagatcagaagcagacgaaatatgtaggcttatgtatgttcatggtgaggtacactgtatgtacctgtcttcggaaaaacatttacatttaaacctcactacagagaacacccctcagaattagtgacacatctgctttgtgcagtgtttttatgacatatttctccaaagcctgaggtggtaggtgtctgcatttttttaacgaataggactattcatatgtgtttaatgtcagttactacagtcccccagcactggttatttaagtgcattttattttctcctgctagtcagtatgttccttgaggacaaggattctgtctcattaatcttgggtccccacagcttctctagaatctagcataatgcataggaactgctcagttaacactaaatgaatgaatctttagggagacgcagcgttttgtttttgtttttcctttttttttgagatagtctgactgtgtcacccaggccgtagtgcagtggtgcaatctcggctcactgcagcctctgcctcccagttcaaacgattctcatgcttcagcctcccaagtagctgggattacaggtgcgcaccaccacgcccggctaatttttgtatttttagtagagatggggtttcaccatgttggccaggctggtctcaaactcccaacctcaggtgatccacccacctcagcctcccaaagtgccaggattataggcattagccaccatggccagccagaaatgcagttttattacttataagtatagataagaacaaaagtgctttgcagttctcaagcatgtattccctgaaatgtcatctttctctattcattactgtcagccaatatttgcatctactattggttaaatatatatggtagatgagttagaaacagtctttgccggccgggcgcggtggctcatgcctgtaatcccagcactttggtaggctgaggcgggcagatcataaggtcaggagatcaatcaagatcatcctggctaacacagtgaaaccccttctctactaaaaatacaaaaaatcagtcgggcttggtggcccatgcctatagtcccagctactcaggaggctgaggcaggagaattgcttgaacccaggaggcagaggtagcagtaagccaagatcacgccactgcacttcagcctgggcgacagagcgagactctgtctcaaaaaaaaaaaaaaaaaaaagaaaagaaacagtctttgtcctaaaggagtttacagtctggtgaagacagtaaatgaatgttcagatactgtaatctaaagtagagtaaggtgagaatcaaaggaaagatacaaagtaaattccttaagtacttacaggatggagagattcatcagctctaggtcatcaagaaagtcttcctggaagaggtcatctttgaaatgaggctgggcgcggtgattcacacctgtaatcctagcactttgggaggctgaggcaagcagattgcttgagcccaggagttcgagatcagcctgagcaacatagcaagacctcatctctataaaaaataaataaatacagacaaatgagccttgacatgtttagagtgggtgaacataaggaatgaagatgtaaaagtttgtggtgtgttcaggaaacagtataattaagatgtgtggcaagaagcacctgaacagatagactaagtattgtcaaaggctttgaatgacaaggtgaagagtttattcttacttgtagatactggggagccattaactatttttgagcagggatgttattatgtgatggtatctgtgccttaagttaaattggcagcagccttttatatggcagattctttgagaggagagataaaatcagggaaactaatttggaaactgatggagtaacccaggcaagaagtaacaaggactacgaccaagttggaagcagtgggttggaatgaaatgcgtaacttcagactagaggtaggctctatatggccttgtaactgctcagatgcagaagctgggaaaggatgatttgaatgctggaattcctgaaccaataaggctgctgctagtagaaaaacaggggccccaagggagctgattttgaggggaagatgataattttggttccggatgctttgagtcatcatgatttcctgatggagataattagcaggtattcggtattgcaaatctttgatttgggagggaagtttaagtttaagagatttagaagctatgtgtgtgactatgttgtgggtactgatgagatccctaaaacagaaggggaacagttttagtaggaaccaaagtgttaaagccacagttcctcatcacctaggaaatttttctaaaatgcacattccttggctccacctccagatattcaacaggtccggatgggacccaggaatctgcatttttatcaagccccacagaagaccaggataccaacaatcttgagtcttactttgagaaacattgattgaaggacagagtgctatactaacatccttcctcttgctgttcttatttgagacgcctctcccaacaatattactagtattttaaattgaatgaaatgttttactttcataaagagtatgatatgccattggttttttttttttttttttgaggtggagtcttgctctgttgcccaggctggagtgcagtggcatgatctcggctcactgcaacctctgcctcccagattcaagtgattattctgcctcagcctccctggtagctgggattgcaggcacatgccaccacgcccagctaatttttgtatttttagtagagacagggtttaccatgttggccaggctggtctcgaactcctgacctcaagtgatccgcctgcctcagcctctcaaagtgctgggatgtgagccactgcacccggccaatatgccattgattttgttggaaattggcaaattgtttggagtattcattgagtcccatagagttgtttgcttttaataaatatgttctgtgaactcaatttctcaagaagattggtctaacctatacttttaacagcaataaaagtgatttataattagtataatataactttggaagtagaaccctgaattcattcagcctttaatatgtttctatgatgataggccctgggagaagttagtttatggtgaattttaacctacttgtgtaatctgatttctgctcttatgttcaaatggaaagcaagatacttttgccttgaagctaacaatttgctaatttgcttcagttaagagtctttttgtgttttggtatgtggattgggggagggagcaccagcatttcaagcaaatcttatttctatcctaaagacactggtaaaaatgtcccctgagtagtttcttgggttctctttttttaaatttttttgagacagggtcttgctctgtgcccaggctggagtgcagtggcatgatcacagctcaccacagcttcaacctcccaggctcaagcaatattcctgcctcactcagcctcccaaggcctaggaccataggtgcaagccaccacacccagcttattttattttatttttttagtagagacatgatctcactatgttgccccatctagtctcgaattcctgggctcaagtgatcctcctgccccggcctcccaaagtgctggtattacaggcatgggtcactgtgcccagcttcttgcgttcttatagagtagaggtttaaggaaaaacttagaaaagatgcttatatatttgagagaatttgggggcttttgtggaaaccttcagtctaatgctggtaacttttgaactttaaaatatttttatttgtaagtttgtacttccttccctgcaaaccaccccccccaccctatgatcttataagaattaacattgagactatgtagttacagtagtccagtgatgagaaaaaagttaactgcaattgaaacctcctgaaacttttttcctcactaacattagttgttttaagcagtagtcaaattatcagtaatactgttcattgcttatggtcagtgtaaaacattttgtagttagtatgaggagtgtgataaactcctatgcaatggtaaaatcattctaaaacacagtttgttaaaagtcagaatattttcatgtgacataacatctattgctactttggctaggcatgtggaatgttatagaaaaatccattaaaatattatttttggcttaaaaagttattgatgtgaattttataaaacatatattccttttcagaataagatgaaatcattggcttccaaaggagtaccaaatgtaatttcagaagatacattaaaaggtcaggattccttgtcaacagatacaggacagtcccgtcaaccagaggaactatctggtgctactggaatggagcaaacagaattggaagatgagcctcctcatcagatggatcacctgtccacaagcttggataacctcagtgtcacctcactgccagaggcctcggttgtttgtccaaatcaggattacaatttagtgaattctttgttaaatcttactagaagtcctgtgagttatggtccttactttttcccccctaacattatttcaataatgtgtatttatttatttttttaattttaatttttaatttatttttttttttgagatggagtcttgctgtgttgtccaggctggagtacagtggtgcgatcttggctcactgcaacctccgcctctgggttcaagcgattctcctgcctcagcctccctagtagctgggattacaggtgcacgccaccacgccagctaatttttgtatttttagtagagatggggtttcaccatgttgaccaggctggtctcaaactcctgacctcagctgatccacccgccttggcctcccaaaatgctgggattacaggtgtgaagctccacagttggccaataatatgcatttaaaatagacaaaaatctatttttcttttagtgtgaaacattaaatccttttatgttgaatgttttcaaacaacctgatgtatatacaattcaagaattgaagggggatttttttttcctttaggatggcagaatagctgtgaaggcatgtgaaggcttgatgctgttagtaagtttgccagagcctgcggctgcaaagtgccttacacagagcacttgcttgtgtgaactactgacagacagacttgcctccctgtacaaggccctacctcagtcagtggatccgttagatattgaaaccgtggaagcaattaactgggggtaagcaccgttacttgtattttcccataaaggtgacttcttaacacctacattttaaaatccatttctattttgcaatggtagaagtctttgaaaaattgaacaccactagtgatcattaaatgggaatattttcttgaagcttgtattaatcagtggtaatgaattggtgtgggaacaatccagctgttacatagttaagatatttttattttgtccattttactgatcaatttttaagggcttacattaaaatcaataattttaactgattattaaaaacaaaaaaccctcaaagaaggaatctccttttaaaataatttccacagcctctagagcagtctaatctgtctcctggcctgtttgtacagaatctcttctacctcattctttcacctcttcttcctaccttttagactccccaacttgattatcatagggaaatatgattattgcagaacgtttataaattattaaaaagtataaagcagcataaacaagttgcccatagtcccaccacctgtaagcagcctaaggttttgacataatcaccttttattgtatttctctgtatttttaacgtgtctttcttttttccactctattttctgtcaacatctatagggcagacccacttgttaacattatgactgtattgcattttagggcaggaagagaagtagtccactcgctatttctgtttgtagatccccatttaccgttcttttcttccatcccagcagctgagaacctccatcttttcgttgatgttacttggtaacatttagggcaggagtatgaggagctatcccagtgttttttctcctgcagctccactgtttttttgtttgtttgttttttctttgagacggagtcttgctccgtcgcccaggctggagtgcagtgaagcaatcttggcttaccgcaacctccgtctcccaggttcaagtgattcccgtgcctcagcttcccaagtagctgggattacaggcatgagccaccatgcccagctaatttttttttttttttttgtatttttagtagagagagagagagagtttcatcatattggccaggctggtctcgaactcctgacctcaagtgatccacccacccacgcacgttggcctcccaaagtgctggtattacaggcatgagccaccacacctggcctcctgcagttccattctgctttaacctctcttctcctacttaatacgtgaaaattatttacagctcttatttaaaagattttctcttatctttggtttcttttacagaatcctcttctcactgtcctccagcatttcctgtgtgaatgtaccatactatctgagtgtgttcatgtgccttcatttttccatacattctgaatagggtccatgcttttggataactttggacttagcaattcttccttgtcttacagcttggactcatatagtcataaagaagatgcttcagcatttccaggaaaacgagccttaatttcatttctttcctggtttgattattgtgatcagctcattaaggaagcccaaaaggtttgtaattttttattgttttttgatcattttaagatataaatatctattaagtgaaattggaatccctaatttatatcccaaatacattttaattgtcttagaataccatggttagtaaaataagtaaacaaaaaagtgtatatgtgtttgtatgtgtgtattacaattccagaataaatcaaagttcaagttctgcccttttatatttccttaaatattatggtacagtactttacaaagtaacactgatttcccttcagtcctgctctttggtgagatgttaatactatatggacattggaataatttttcatcctattcctcttattcttggaaatttagaaaaaagtgtaaatgacccagtagccaacatctaatctagatttatatgccaccaataagagggtcattaggcaagttttgtctttccacattaattcagttgggagtccaaactgatttattgatgttacaaattagtctttcttttatattaaaaaaaaaaatgatgttcctactatattctagactgctgctgttgctcttgccaaagctgttcatgaaagatttttcattggtgttatggaacctcaattaatgcaaacgtgagtagcctgttttcttttgaaaaaaaccgcatcactgtgtcatgttatttttgcccactgactacctgttcattgtgctcagttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgaggtaagctacgtaatgatttagaattggacttagattctttgaaatacggttttaatgtattatacttcagatattttcaatacaacctcttttattggctttagaaattgaaagcatgactcacaagatggtaagaagagtaacttatgtaaagacatttttcagttagcttttatcaattttggtttcagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtgtaagtttccatccaactccgtgagttcagcatttcatgtagagatagaactttctctctcctcttatctacctcccttatcctcaaaagaaatacctcttacagtttaaaagttcttaaaagtaaaattagatgcattgatactaccatccttttacattacaaataatattgtgtattcattagacccaataacaaaatagtatagaatgttaatttgcctagaaaatatacataattccttaatcctttatattagcaaaattatgtaacattttctaagaacatagcagagaatcttttggtttagaaaatgtcataataaaatagtgctttttatgtgtcattaaatttaacttagagatctggaagaagatccattatttactgacatttcaccagaaaacactttgccaaaccaagagtggcttagttcttcacctcctgctactccagaccaccccaaaaatgatggaaaaactgaagttcataaaattgtaaataggtgagttgctatataaaatttgacttccatctctcttgttttttgtttttgtttattagtattattattttttgagatggagtcttgctctgttgcccacgctggagtgcagtggcacgatctctgctcactgcaacctccgcctcctgggtttaagcgattctcctgccccagcctcccaagtagctgggattacaggctcctgccacgtcacccagctaatttttgtattttcagtagagacagggtctcaccatgttggttaggctggtctcaaactcctgacctcaagtgatcggcccgcctcggcctcccaaagtgtataacatgtaagagctctgctcttaggtggttacagaaatctcttatgaacttgatcttctttaaagattatgtcagttttttggtcttgcttatgtaacaagtgccaggctgcgggcaacacttgatactaagagaaaagctctacttaatattaactgtggttaaatgaaccctcaaagttccctcccccaccttttttttttttttgagacagagtctcactgtgtcgcccaggctggagtgcagtggcatgatccctgctcactgcaacttccgtctcccgggttcaagcgattctcctgcctcaggctcctgagtagctgggattacagtcgcatggctactacgacttgacctcccagagtgctgggattacaggcatgagccaccatgctgagtcatcccatttttaaaaaatataaatggtttaattttaagtaattcccaattgtaacaacattgagaattgctggtttgataagatgtacttattaaacatgtgtgctaagtgttgggctattcctttttgttagttcgtggttttatgtttttttaaaagtgcccttttctgtggcaattttttttctctcttttgcttcccttgcagtgttgtcactgatatacctggttctggcaggtgattttagagaaaaattgcatgtggctcaagatgcaaaattagggtacataaaaatctcaagttcaattacttaaaaccagtttcctgagattaacaaatatcatggcagtctgtcattatacagcaatctgaagaggaaaaaaatgtctttcttaggcttacttctattttaagtggaattagtcatttttaaaacctttaaaataatgagaatatttaatcaatgaattgtaaaacttatcaggaattaacaacatataatttcatttctcgggtttccatttgtattaatacttagctgaacttacgatatcactagatgctttagtacttataaagttattattgaattatgagagtattgattatggtctttttcacttctactttttccttttttttttcatgcaaatggacatcttgcataattgtggccgttttcatttaagttttctctgtctggtaccggatgacgcaaaatcctcctaccatgttgagggcacaggatatgacacttacctccgagacgctcataggcaggtaggtgaagtcactaaatgttggaaatgaaatctaagaatagacacatgcacaccccttgtcacactgcccaccaccactgctccaaggaaatgacttcattcttattaaaaatgagacctgggccgggtgcagtgtctcacacctgtaatcccagcactttgggaggccgaagcggatggatcacttgaggtcaggagttcgagaccagcctggccaacatggtgaaaccccgtctctactaaaatacaaaaattagccaggcatggtgacaggcgcctgtagtcccagctactcaggaggctgaggcaggagaatcgcttgaacctgggaggtggaggttgcagtgagccaagatcgtgcctgggcaagagagcaagactccatctcaaaaaaaaaaaaaaaaaaaaaaaaaaagacctggtctctgctataactacttttgctttgtgcaagtgactttagtttgcacttcaccgattgtgtgtctccatctcaagatttctttgtgctctttaattttttcccactttaaattatatctcacccggatccatttctcctactgatccaaaacatgataccttaataattctacccaccatgcacccttgatcctcatacacaagccattatccttttctccttcattctgatgcagacagtgattcacaagtatagtccctctgctgcccagctctcactccttcagccccggaatttcacctttctacctcactcaaacgacttgctcaaaggtttgcttctaaattaaggagacttttctcattcttctttcctctttatagcattttacatcgtaagattttaaaaattgtattaaaaattcctcctgcaaagaaaacttgtattgagataaaattcaacgttttaactattttaaagtgtacaatttaatgttttttagtatattcacaatgttatgcaaccatcatcactatctaatgccagaagattgctatcaccccagaaagaaacccggtacaaataaagcagtcacttcatattgacttctcctccccgccaacccccagccctggcagccgctcatctactttttgtctctatgactttgccttttcttgacatttcacaaaaatggaatcatactatatgtgaccttttctgtctggcattttttactcagtgtaaggtcatgttttcaagtttcattcaagttgaagcatgcatcagtacttccttttctttatggctgaataatattttattgtacggatattttgtgtatctgtcagttaatggacatttgggttgtttctaattgttgattattatgaatacttatgctgtgaatattccttttttgttgaatacgggttttccgttttcttgggtatatgcttagtagtaaaattgatgggtcacgtggtaattctatatttaacttttttgaggaactgccaaactgtttttcacagtggtggcaccattttacatcacaccagcagtgtataagggttccaagttcaccatttccttgccaatacttaccattattctttttaaattttagctaccccaggaggtgtgaagtggtgtctcctagtggttttgatttacatttccttatgactaatgatgttgagtaccttttcatatgcttagcagatacttgtactcttctctgaagaatatttaaatcccggccaagtgtggtgtctcacacctgtaaccccagcactttgggaggccaaggtggaaggatcacttgaagccagaaatttgagaccaggcttcacaatcccatttttacaaaaattttttaaaaaaattatccgtgtgtggtggcatgcacctgtagttccagctattggggaagctgaggcaggaggactgcttgagctcagaagtttaaggctacagtgagctatgatggtgacactgcactccagcctgggcaacagagcaagaccctgtctccaaaaaataaaaaaaattcctttgcctgtgttttaattgggctatttgtctttttattgttgagttgtaagagtcccttacatattctgcatagtagatccttatcagatacattatttacaaacattttctcccatctgggagttgccttttcactttcttgatagtgtccttcaacacacaaaagttcttaattttgtttttttgtttgtttgtttgttgttgttgtttggagacagagtcgcgctctgtcatccaggcgggaatgcagtggcatgatctcggctcactgcaacctccgcctcctgggttcaagcaatcctcctgcctcagcctcccgagtagctgggattacaggcttgtgccaccatgccaaactaatttttgtatttttagtagagatggagtttcaccctgttgcctaggctgatcttgaactcctggcctcaagtgatctgcccaccttggcctctcaaagtgctgggattacagttatgagccactgcacctggccaaaagtttttaattttgataaagtgcaacttaactattttttcttcatgctttttgtgccgtacctaagaaatcattgcctaaccaagattacatagattttcacctaagtctctttctaagagtttcatagttttagtttatccatttaggtctttaatctgttttgagttaattattgtatatagtgtgaggtggggtccagattcattttttttacatgtagacatccagttgtctctgcagcacttagtgaaaagggtattttccgtgtattgactttaagtgtaaagtttatttgaggactctcaattctattccactgacctatgtacctgtccttatcccagcaccaccctgtctcggttactgcagctttgcagtaagttttgaaattgagaaatatgaatccttcaacttgcttctttctcaaaattgttttggctatttggagtcccttgtaattccatatgaattttaggattactttgtccatttctgcaaaaaaaaaaaaaaaaaaaaaagcaattgaaatttttgtaaggcttacattgaatttgtagattgattggagaagtacagccatcctaacaatattaagttttccaattcatgaacaccggatgtttttccatttactcaggttctttttagtgttattcaacagaatttcatagttttcagtgtacaagtcttgcacttccttcattaaatctattcctaagtattttattctttattgtaagtgaaattattttgtgaacttcattttctgattgttctttccaaatgtagaaatactgctggttttgtgtattgagcgtctatcctgtaacttcgctgaactcgtttaaaccacctcccaccccccaccccagccctgccatttcaaactttctcctttcttaaggcttctgcagcatcattctttgctgctgctgcttttaggtgtcaggtgtcatttttactctgtccaccatattatgatgtggccaaaaaaccaaaaatatctatcaatggccctcttttctatcttcattcctttgatattcttttggtttaacattcattctgtcatgaattctctatctgaggtgtccccaaagctctagcctcagccacttaggtgttcttctaagacctcagactttatctttccaaagcagaacttatgattgatgcctttaaaactgcatctgctcctttgtttcctgctgtggtcagtggcatatccatcctcctggtcattcaaggtttgtatttcagagttgcctgggattcattcatcttctattctccttagcctctagtgtattgccaagttgtatcagttttgcccctactatatctctcctgtctgccccttctccatttttgctttttgctttcagaatcctagtttacatctttattacctctgccagattacagtagcctcataacttgtttcctcagcttgttccttctgcttagaagccattaacagattaatctcattgaagtgtggatctgagaaccccttctttattaactcataaagtataaatacttagacatcaaatcttagaattcaagatcctttcggatcaattttccagcctgcttttctatatttcttactatgactttcacttgctatccaaatataacatttacgtgcatttattgatgctattctgtttgcctacaaggttctcctcttatttctcacccaccatctgatatctatatttctacactgtcttcaacatccagattaaatgccagctcgtgatttattctttttaccctcttcctcctctcccttcccaacagtaaaggtaactactcgtcttcatgctcatggcattgtctctaatcttttgtggtcctttgtgttttctttcttgccttggggttataaggtaatagtcagtctcttgaggataggattcatgcttgatttaccattaaatccctcaaaatatgtagcttagagctttatacattttacaatatcagtaactatttagtatttgttgaataaataaccagaataaaatatttcaaaatttgaaagagaattttaaaatttacatagtctaaattttaaaaattctcaaatctgaaaaatgtacatttaatttgtatttaaattctttgtattgaagtatcctattatatataactaatctgcatatgcacatagttaattcataatactttaagtccacattagtacatgaatttgtctgcattaatacatgaataaattaatggagtagcaagtaacattcaaataacaataaagtaaagacaataaaagtaaaatatatcttttggcagtaccgattggatttttaaactgcttttattctttctgtaaagtttcatttccattttgtgattacaaatgcagttacaattgtttcagaaatattagaaaaaccaaaagctataagaaattataagtcagaatataagaagtgttaatgtaaaaatgatttcttaaaaattgagatttgggccaggcgcggtggctcatgcctgtaatcctagcactttgggaggccgaggcgggcagatcacttgaggtcaggagctggagaccagcctggccaacatggtgaaaccccatctctactaaaaatacaaaaattagctggacctggtggctcatgccactgcacccgaccattttctgttttaatttcaggtaatttctaaactagagaagtcaaagtaattttgctttattaaataaggagaatctgaagagggaaggaatatagaagaaaacagtgctttaaatttcttttgtttcaattcaagtaaattacatattgggggagacttttaaaattcatttttattatatgaaataatcttgtgcttataaatattcacactgtttcactgataactatctgtagtgaaagaccagggtttttttttttttttttatttccaatctgtcacagaccaacacttttgtaaaatgcaataaaaatgaattcctggccaggtgtggtggctcatgcctgtaatcccagcactttgggaggccaaagcaggcagatcacgtgaggtcaggaattcgagaccagcctgaccaacacggagaaaccccatctctactaaaaatacaaaattaaccaggcgtggtggcacatgcctgtaattccagctacttgggaggctgaggcaggagaatcgcttgaacctgggaggcggaggttgtggtgagccgagattgtgccattgcactccatcctgggcaacaagagcaaaactccatctcaaaaaaaaaaagaattcctattgtagaaaaatgaagagaaaaaaagacacaaaatacaaaccctgattatttcatagttagattcaacagacataaaactcttcatagtcaaattgttaggaacgtttttaagtgcttgctcttgctttttgtcctcatctcattgtggacggtagtgaacactttgaggaccagcactggtcgatggaccacctttgagtagcactgtttgatcctatcataacatcatgcctagtgtgctagtttgcatccattctaggaatggcaggcttgtcttctcaaataacatgtatcagttcatctgtggtatataccattttagaataaatttgaaaacttggctaggtctgactttgctttttaaatgtcctctaaatcggtgatgaaagtaactaaagagttaaattcctttaaaggaaagagctgttaggggtattttagtaaagttaaaatatgtctctttttcatcagcttatattggtagcagcagttaatataatcttacctgtgcccctagtcacagaaagatctgagtcatctcttccccctctcccttggcacctgaagcatagcagacattctgcattcaaatggttttttatatgcctatttaatgaaatcatttctatttcatcttaatttgtttttgttctttaatgattcacatgcttttttccccctagttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcaggtaatacattttaaaatactaattttcatatttttttttgccattcaccacagaatcatctcaagtcttagtagatcttcaataaagtacttttattgttttcttactttttccactggatgactttttcatgaagcttgattgccaacaactggcagatttctgatgcattctgtatgttaaaaacatttatttggcctgacagctgcttgtttattttacttctcatgataggccattgtcttaatatccttaacacattttggagatgattaggactgcttttcttttatgacttgcttagccttttagttagtacatttagtacaaatacagatgctcaatttggaagaccttaaatgtcatttcagattgaatcttgaacactggtctcagtaaaatcacagaatagtgttagatgaacctggctctttagacaaagcttgtaaacgatactcattttcataagggagaggtgaaatagaaaaggttaatgtactcctttaaaggtggataaaaatcaccatcagctgataagttgctatgtacatctcatctgactgttaggagaaataaatttgggattatggaatccctccttccatctctcattggctcataagcttagtgatgagagagctttgaaatgcttgactcattagaatctaaacctgaaagaacacaactagcatagtactttcctcagtgtggaaactgagtggaccaatttggaattaattttcaactgtatgttaaagtacgtgttctttttttagcattttagttaaatatttatgtgagcatagggagttgtaaaagaaatttactaagtaggctgtcttcagtaactagaaagtcaaataaagaaattgtaatctaagaagtatttcactatgttagagtttagtcagcgttgtttctgacggtaatctctataagagaccaggtccttttttttttcttttttaacctcttaatagcattcgctgtatttctagtgttgcttggttggtcgttttaaacctgacaaccaaagtataaaaatctggctattaataggtattgtggcctcacctcatggctgtgtaaacctcctgggtagccaggatgcatcagtttattgtggtttgttttttgtttttgtttttgagccagtttgctaggcgtagtttaaatcaagcttgttgcttgattaagctaacaagcaagaggtaataacaatgagtatcaagacagtaatgtttaggaattttgaccgaaagtactaaaaaggaatctaaattttaaaaagtagtttctgaattgaaagatctaccctgaatcttcaaccttgagcactttttctctagtttgtggagtgctggcacaaaaggatacattgaaaacagaatatctgaaatacttaaaatacttttcaatttcaccagatagcacttcatagcacagcgctgattcatagactgtttcagtcattcttcctgtaaccgtgtatcataggcaagagagatttctagtattattttacaaatgaggaatctttggtttcagttatgtgacttacagctggtaagctatggagccccgtctgaaaccttttatctttaaaactcttgagccgggtgcaactgtagtcccagctactcaggagtctgaggcaggaggattgcttgaccccaggagttcaaggctgtagggcgctatgattgtgcctaaggatagccactgcacactagcctaggcaacatagtgagaccccgtctctaaaacaaaattaaaacacaaacaaaaaaaaaacccttgattttcaaagccttttgggtaagaacgtggtatagtctgatctcagagataaaacacaagtcctagaaagctaagcatttttggcctagttttactttctttcctaaacatttttgccggaagtgatacttgcttgtagtttcttttttttctttctctccctatttcttcttcttttttttttttctgagaccgagtctcgctctgtcacccaggctggaatgcagtggtgtgatcttggctcattgcaacctctccctcccggctcaagcgattctcccgtctcagcgtcctgagtagctgggatcacaggtgcacaccaccacgcctggcaaatttttgtatttttaatagagatggggtttcaccatattgctcaggctggtcttgaactcctgacctcaggtgatccacctgcctcggcctcccaaagtcctgggattacaggcatgaaccaccacgcctggccttcttctttcttcttttttctttttcttttgtttttctctttgcagggcattttcttagtatagattcctaatagggtctaggtaacttgactgagattaaaaatttaatatgaatagtttggcaagtggctaatgtcttcatgcataattgagaacttacagtatcaagtattcataacactattgtgttatcacaatgctaatttgaaaaaattcataatacaaacatttactattgtttgtaacggtggtgattttaaaaagatagtaaaatactaaagcccatagcagaatgtaaagaacactgggaacattgtaaggaggccaaatcttgtccctgccctgagcatgatgagtttgaatttgatcaagtaacttagctacttgtcacattttctaattgttaaagtgaagttgatattacttttttaagtcaaagtttattatctcaaaatttgagttcagtccaaaaacatgggccaagtccatttgtcatgtcagagaaatctggcttgctttcctttcaggtaaatactgtataaagtataaaataaagggacctcaagtaatagatataaacacttaactaccaacaacttccaaaaaggctagcttgttttaaagttattaccaataggaagtagagaccatttcagagtacagtgaaacaagtttatcttgttgaaatttattttcatttttactacgttgagaaataatctgtgtcagccttaaatttcttaagcaacctatgacctacatttatgttaaaataaactacaaaccaaggtaacaccacacagagaaaatacaaagtctaaatagtaatgtatttgtttaaagccaaattgtactgatttatttatttaagcacctgcagatggcgaaatttagtgacctaaaaatcttaactacctgcagtgaagagtcatgtacaattctggacttaagttgtattttaaattttttctactttttttttttttttactaaatgcattcttttaaattattttttgtaaatgattccttcatacctaaaatacaatttaatgtgaattcattgtttattatgagttgagtctcagagaaggctattctgttgcaaatattatcaagggaggaggaatggagagaagttggttaatgagtccaaaagtacagttagaagaaataagttctagtattcagtagtacagtagggaaattagttaacaaaaacgtattgtatatttcaaaggagctagaagagaactgtgatgttcccaacacgaagaaaagataaatgctggaggtgatggatgtcccagttaccctaatttggtcattacacattacacattgtgaaatgtatcaaaatatcacatggaccccccccaaaataggtacaattatgctatatcaataaaaaatacccaaagcccccaagtattaccaagtaggagaatttactcttaaactatcctttactgggaatacatatttcctttcaattaccttgcttacagctaggttttgaaaaaaaataataaatgacttggagcagtttttaattctttaaaaaaatccatgttcatgaatctagtagtaagttagaaagactaaaatgggccttacagcataggacttgagagtttctgtttatgtaacaaaacatgttcatcgtagcgtctgtagctgtggtgattttcaaaagatagtaaaatgccgaagtctgtagcagaactggcgtgtgcccgagcattctccactgaatgccagagattgacttcctcattgctattcactgtgatcaaggctttgcaggttgttcagtggctgagagtgaaacattccgctgtgctggctgatgttgcacttggtcctgactccctcttccctccactgtgctgcagtgtctgtctcactcttgccacctgggttctctgcagcctcctcactgtagttagttttgttgcaaccaatccgtttcctttggctgcttagaagaagcaaactggaaggggtgagaagtttctattgaaagttctgagcaagtagtagcaactccttgtgtagtgtgccttttgctttgttgacatgactctgtaaagcccctttctgtgaagaataaacagacaattagaattcaagtaaaatcacgatattacatgtaaaacaagtgtgaggaactgtacacagatatacagttgtttggagaaagttaatactcatgcaagaaatgagatgatccctctctgtaatcaccattttgaaccttctcatccactttgaggcatagggtcgtcatcagttctatccccaagtactttcatttcattctggtgacaaggttctgtgattcgactttattttactgtatgtgtttttgggaattggcagtagttgaataatctgaggtgaggaatatcacttctaaaattactatatttaaaaaggtgtaatatcttcccatcttgttttttggtcttatgctcaatgggtcctctgtaattaatattatatatgacacactggtgcttttttatgaccccttgaacaatttcattaattgaatcaacctgcataaaataaacattctgactctgtcacatatttgtctttatatgtttatatattttttaaatctttaaagttttaggcctgcaatatatgtaatttgagatgatgagagctagtttagttgtagatattttcattgcagaagagcatgcgcagcagggaggaagatggtggattctgctttctttttttttgtttgagacagagtttcgctcttgttgcccaggctggagtgcagtggcgtgatctcggcccactgcaacctccacctcctgggttcaagcagttctcttgcctcagcctcccaagtagctgggattacaggcatgtgccaccacaccgggctaattttgtattttgagtagagacggggtttctccatgttggtcaggctggtctcgaactcccaacctcaggtgatccgcccgcctcagcctcccaaagtactgggattacaggtgtgagccactgggcctggccagattctcctttcttaaaagaacaaattgaaatagtaaattaagcacaccggtatacattatttttaaatgtctttctgttttttatctctccatagccatatgatgtaaacttacaagtaacctcagtgttatctagactttctctcttccctcatccacacatccacgagtaccttttggatccttacgtgaacctcgctcctggctgtagatctctcttctctgtaattgtcagggtgagttactagttctgttatattccctaggattgataaatctgtgcaattaatatgttaatatcattgtatgcagttagtgtcacataatgaaaaatatatctactgcttaaaagtaattattatacattctgaactactattttttcaattattttaaataatatgtaacttttattttaaagaattaggtatgagtccttggttaaagatgattatatgagtagtgaaagtttacgttctttattaaatagtagggaaggaagatttttctttttagatcctgaggttgtctgtgtagctgatttcaggaactgaagtgccttgcctctgtgatgcaggttgttggagaccttatgcttcgaatccagcgtattcaagactttactcccaagcttctgttagtcagaaagcggttacttggtttggaacctgaaggccctatgtaagttagtgttttacatttttttaatccaaaaatttcagtgaacttaatgatcggctgctatcttgaattgatttattgtctgttttttccttaccagtattgaccacatcacactgctagagggtgtgattgtgttagaagagttctgtaaggagctggcggcaatcgcatttgtaaaatatcatgcttcctccacaccataaataacatctttcatgtaactgggggaacagaactactgtgtacatttcaccaaaaaagactcagttccacccagccacaagaggataaaaagcctttttaaacgcagtattgctgtaaactggacagaaccattaagaacctattgagtggacattcttggtgaaatgttgtataatgttgttttcattggctttatcataatggttctatatatacaattgcacattgttgaatccaggatacaatcaaaggaacttcaggaaataagcatttctaatgactgtgaaaagctgcaatatttccaatgtcatgactttgatgatatttctgttatattaatgtccttttaggtagcaaggcattttgacattctctgggactcaaatgcttgtattcttttggattaataagtagcaaaaaaaaatcactaattttataactttttaaggtcagaattcttatcaaacaaaatatgaaaactgtaaatgagaaaaaaatacaattcagaaaccattgaatgaattaattataggcgataaaaatgtgtagagcaccattaactttcttcagcttttttaagaataacaatttaatatgataaattcttgattaatataatatatctatatttttaaagaaatgttcttttactcttttgtgcacatagccatgttagtgattttcttcatgtgtgggtcccagtttatttaaactgtgtcgttttcgcagcagtgttcaatttgctcaccattggtagtgtttgctaaaattgtatttttttaagctaagtaacatgtactgggttgagaacctttttcccccctctccctctcagaaaattgctttataaaattgctttataatttgattttcttactgaaacgcatggtggtgtctaggtggggaactgactgataacccttggcagcaatcaaagtgccagtggctcctcgatgtttacatttttttctattttgttcagtcttttgttttaaatgattctaaagagattaaagaaaacagagttttaaatgtcctatttacatgttaaaggatttggggaaattgggtatgtatgtgaatgggtgtacatgtaggaacctgtagttcagcaaagctgcgctgggcacagcatgcttgtacttgattgacaaaatcgtgtttgccagtccactttctatttttcctttaagtgatgctgatcactcaaataatgcttttaagctattgtttgtttttatttgacatgttaagccgcagcactttcttcttcatctttccatttactgatatttgggggaacaggctatcaaaggttccggcttgaagggaactgtcactaccccctctaggaagttattttatgtagcatgtttgcatatacgcattgtgtggcatgtgcatagaggcttgttttacacctatctgctcattttgttgtgttagcttttctggtttatttcatagtttgttcttgctatttattaagaacagaatatcaaaagattatgaatagcctcagctctagaatgcttaccactgttaaaacaacaaaaagactaaacctctaatttcatgcaaatctttgttagcttattctaagaaatttattaagtaaaacaaagaaaaaacagaagtgggagatagttattttgtgcgtaattttctttaaatcattttgaatgatgtgaaggcattcagtttgctgtatttttttaatcacttcatacaaggaaaacttcgacatttacatttctagatgtagtaacagtctactttgatatatgagtatttaaactaaggcattaagagatattagatatttcttaatgttttcatagtgctcaataggtgtagtagcaatgatattacctctgaaaccaaatactcttttatccttgattccactatgggaccttataactagtccatgaaaccaagctcagaaaagctttaactcttatatttgtgtatatgtatgctgcttctgaaaatataatttttctaagttgttgtaatgactttaatttgtaatcagctaaggcttaagatttcatttgtttctaagtttctgtttttcatcccttcttttttcttttatatttagttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgtttgtgcaatatggaagctgtgagtggattcatagctttttggtttaattgtacattattgtgtgtgtatatatgtatatatgtatatatataaggaccaaaattcttagctcgcttacactgttgctagtgtaaacattgttacacttaattttacagggcacaaattatggaattacttcataaattcatggtaatgttttcataaattattgcattaacatacaattgccatttaattatgaagtccatcagtattgacagaagacgttacagtgaagtgctaaaaccacactatatggtaattatattttgggttatgtagtaaatcaaatatgcatgtcattgtgacactttatgtgttaaaacatggtagataatcacattttctgggccctgtaaaatagtgttactgtaatactctgttttgcctcctgccttgtttacattaaacaggatatttggtaaatttttttgtattgaaagttgtgtaggttactgacagtgttaccagcgtctggaattcttggtccctccgtggagaaactcttcagatggtcattgtgtacctactctctcttcaaaggaagttgtgatcaagttcaactttttgtgctaacaatgcatgcaggactaagagggatgatctaaaaaataaataatgtaatttaaacaa

SEQ ID NO: 1001 - DNA, 58997 bp, Homo sapiens
cttccccgcccccaacccgggcccgggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtgagtacgcggcggcggtgcgcgggggcccgcggggcggggcggggcggggagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggagttgtcagtgggaggccggctgtgcccagggtcctagggccacgttatgggggtcgtcaggcctaggccactgtgcctcagggctgcatgggtggtgagcagtgggagggatgcgatggggggagtgggctcagctgtctgctgtgggtgtttcctcggggacctggctggcagggacctcccggccagcccagaactgccaacatgtctgccagcactgcccctccattcccagtcctggggggaggctctgtctgggcagcttgaggcctgacctactgtggctgcttcctctgctccccagcctgggtcctgagggcctggcttaagggaactgctgccagaaggctgggagtgtaggcagtgttcgggtgcccagctgtgccctgtctgacctcatggccacccacaagctggcaccccccacaggcctcttggggaagcctgtactttccaccgccggaggcgggtaccgcgtggaagccaggctcaggcggactcattctttttgaactttgggaacaggcctggtacaggctgagttctcacaagagacacacacccgtgtcactgtctcctgagctgtgccggacccgtcctacagactccacctcctctaggtcctggccctggcatctgccagggggattttaaatgagttgatatatgctaagtgctttgaaaggcgcctgcacggagggagagctgtataaatattcactattggtaatatttctcccatgctgttactctccaaagctgcccgataattctagagtgggttccggggacgtgcccgctgtttggggcctagaaatgaactcgggaggttgttttgcttgctgagagctggtctgggaatgccccttgaccgttccctgccctgctcctggcccactcccagactgctcctgtgcctggccccattgcgctgggtgggtgatcctaagctgccccatgggccctgggctctgtcaagacatggggagcttgccaggagttggggccagatcccccagactccaagatggtaaccgaggttgtgagggtgcacatggaaggaagagttagaagagtgaattggaaattgccagcttggactttgggcagagtgggtgtctttagcttggggatgggttgttgttcagagacaacagggccgccttctctgtgagctggcggcccaggctgaggtgcctctgggctgccttccctacgggaagcagtgactggccctctgcttctcaggaagagagtgccgtgcccccgccagcctcccaacctcgttagactcctagaatccggttttctggatagaactaagaatctgctcctttctggacttttaatcctggaaagggctcccttccccagcaggagcagagagaccaaaccccctttctgtgctccatcttgagctgtcattctgtcctaactccccactggccaccatctgcccttgctttgggggctaccccaggtctgacttgggcacgttctctgggtctctcctcagagaggctgctcctggggttgtcccaatggaattgggaattcttctcagaatggctcaaaggtttgcaccatctgttggagggaagggatccctctatcttggactaatacaaatgtttccgtgcctgccaagttccagaccctgggccgatagggaaaggagctggctggggggcctgcaggggatggagagggagcttgggccccaagtggggtctgaagtccaagcctacagattgccatcaaggcagccgctagagcctagcccagctcctggcccctcggagatggaccttagatgctggagagcggggcagtccagcagtgcagggtgggacaccccgagcaaacagcccctgcttcctgccccctcagttcagtcgcactgggccggctggacgtttccctgcaacaggcccctgctggtggtttagctcccgctccgtgtttccctcacgctgggatcctccttcctactcaagacccacgaccttgacctgaagcttttggttgccgggaggaaatggtgagtgtaggcagatttgggtgactcttgttattaaccccctcttctttgttgcccccttcccagaggcttctgtatgagtgtcctgagtggccctggatggactactggctgtccctggcctcagaatcaccccaacccctgccacatttcggggagggaggtgtgtgaatgatgtcctttattctacagactgaggaagtggtcagtgtagcttcacgtgagagcagcagcgtgcgatgcccaggccctagccaagtgctggtcagctttctgactggagcccctgagccctgcaggggctgaattcccccaaaggttgcttgggttgttgcatttcggggttagagggtgtgggtgtccagagctgtgggtttttagtgttggctgagccctttacctgggacctacagcctggccacaaccccatctctgttcccctgtaccccacactgccctgtgataggatgtgataagatggtaggattgcctatactgaagccctgggtgccactgctggcccagcagggaggaggttgctgctgctcgggctgaagtgaggtgtgggtctggctgggcctccagtttcccacctgggccttgattgtgaggaaggcctggcctggctgcagaagcccagaagcacctgagtaggagagttcctttgtcccacctgcagctcattcaagcctgtgcatgggggttggggtcctcaggatcttgctttcctgtttaggggaggcagccccaaagagtgctgggaccagtttggagagtgctaaggaatgctggtctgcagcgaccctacttgtgctctgcgtcctctgccaactgcagcatgggtgaacatctgtacatctgtccccataatgaaaatggcctcagcaaataacaaaaatattaccatttagcaatcaggcacttattaaaagcctggcccaataaacttaaaaaaaaaaaaaagatgtgctagacactttacgtcccttcatgtgagcttcacacaaccctgtaattaagcccatttataaatgaagaaatggaggattgaaggattaagttacttggccaaggtcatacagctcgtaagcagctgagctaggactcaaatccaggcttgcttccaaaaccttcacttttcagcccagttctcaactgccccctggagtttgctcattttgccccatgaagaaacagatcccagctcaaaggcgtgaaggggtttgctcaaggccacagtgtattagtgtcaaaggtggaacacaaaccctgacctctgagtgctctcccgaaccccacatcccggccgggccgtaccctgagcacacgcttgtccgctttctcagctgggcggggcggggcaggacaaggttcttctccctccctccttccctccttccctccttccctccttccccgtgggccctcccagcctccccagcccccacctctgctgctttcccttggcaattgcttccatctggcctgcctgcagctcctattcctttggaaatgtggctgccgcccacatggctgcaaggcaaccacggccacacgtggggaaggggaggggccctatggggtctaagcacagggaacccagccaaagtggctgctcctggcgtctggcatcctgattcctgccaggcagaagcaccttggctgcctggccctccttgatgcccgtcctgggctggctcaaggccagagaggctcccaaagacccaattctccttccaacatggtgagctgttttgcccacagacaagctccgcaccggcagccctccctgtctcttagaggttgctcaggttgggaggagggattcctggcaggagagaattaggggccagccggggtataccctgggttcccactgggttctgatcatttggagggaagtcatgcaagggactgacgagggcagaggctgagggatccgcggagttctgggcaggcgaggaggcagctgacttgctcatgactgtgggtatgcgccaccacactaggctaatttttctattttttgtagatacagggttttgccatgttgcccaggctggtttttgtttgtttgttttgttttgtttttgagacagagttttgctcttgtttcctaggctggagtgcagtggcgcgatctcggctaactgcaacctccatcttctggtttcaagttattctcctgcctcagcctcctgagtagctgagattacaggcacccgccaccacgcctggctaatttttgtacttttagtagagacagggtttcatcatgttggccaggctggtctcgaactcctgaccttgtgatccgcccacctcagcctcccaaagtgctgggattacaggcgtgagccaccgtgcccagccgagcgtgtctgtcttgttcactggtgtattttcttaatgcctggaatgatgtctagcaaacaataagcactcaatagattcttgtgtgatgagtgatggaaatgcagctcaggtatgctgatttgtctttgctgcatctttactttgcttcctcctcccagggcaaagggaaaaagtttcccttttgccagttgagctgtttgccagagaaaggtctggccccatctgtgtgctgccaccttgggggtctctgttcagacctcagagaggcaggcaggaacccaggtgaggatgggcaggagcttgtcccctgaggagtgcatgccccattccacccaccacagggtcggctggccacatttctctacccatcacccctccctagtaaccttcaggtccctgcagacaggtcctgacctcagctccaatccctatgtcagtcctctccttatttgaggcccaagaaaggtacccctacggtggaaccctcacttgggtcctgagagggagtgacagctttggaagagcgaggggttcacccacatttgcctcctcctgaacagctccacttttattccttgtacatattgcgtttccacttcaatttttttttgaaactgtgacagagggtttcttggctttaatttttttttttttttgaaaacccccattgagttccagttgtgacccccctgtggttctcattttctggtagcatgccgtgtggggtctcacctcctcgcctttgcttctgctgccccctcacatggcttgggcattgttggtaatgaccttgctagactgcaaatgtccttcagtatcaactgaagccccagtcctgggaagcctccgtggccacccagcaccggcacttcctcccccttcctccccctgcgttctccactccctgcaggtcctatgcctgtgacagggagggaaccctgtgctggggtgaccccagcatggacctcagtggggctcaggctgaaccaaaggtaggtggttctgggggtagtgcctgaggtggttgtatggagctgtgagatttgtattcctagaagcaggttggaggctctcagcccttccctccatgcatggccttggatacagcttgcagcctgccactgtagcctccatttccttctccgagaaattaacacttctttttttttttttttgagatggagtctggctctattgcccaggctggagtgcagtggtgcgatctcggctcactgccatctctgcctcctgggttcaagtgattctcctgcctcagcctcccaagtagctgggatcacaggtgtgtgccactactcctggctaatttttgtacttttagtagaaatggggtttcaccgtgttggccaggctggtctcaaactcctgacctcaggtaatctgcccacctgagcctcccagagtgccaggattacaggagtgagccaccgtgtctggccaacatttcttccttttttttttttttttttttttaagacggagtctcactctgttgcccaggctggagtgcagtggcacaatctcagctcactgcaacctctgcctcccgggttcaagcgagattctcctacctcagcctcccgagtagctgggattataggtgcccaccatcacacccggctaatttttgtatttttagtagagatgggggtctcaccatgttggccaagctggtctcgaactcctgacctcaaatgatccacctgcctcggcctcccaaagtgttgggattataggtgtgaactaccgtgctccgcctggccaacacttcttaatgggataatgtttcagataacatccagtgcccggactccagcactctataaatgctggctggtgtgcttttctgggattccagggtggggtccagagactgaagagggtctgctttctggcccaggggaagaggggcaggtggctcactaggagctgtcctggcatcctttgtccccgtccacttaccagttatgtgacctcgggcaggtcttgcactctggcactcaattagcatctgtgttaattggggtaagagtatctgccacgtctcacagcctggtgatggacaaacaaaacaaacattttttaggctgggagaggcctcagaggttggctgtcatattgcaaacgagggagcagagactcagaaaagtaacttagttgtttaaggtcacagagcacctctctccccacaggcagggagccggtaattgggctgagcctcaggagtaacccttctctctctgcctctccagcccctaccttatgcctggcccattcagctggtctgttctccaggcccctaggactgggtgggctaagatgagtggtctagaaatccctccccagctgggctggactgaatgaggggctggccgaggagcgggtgttgatggagtatgggagattgtcctcacaggcagtgtgggccgtttctctagacctcctgcccccatctccttcctgtccctgtttgagccgtgctcttcttcttcaatccctttctgtctgccttctctttccacccctagatttctcaccatcttcagtgatccctcctccttcctttctgcctcctctgcattctctccttgcccttgcttctctgatctgccttttttctccagcctcagcattcaggttgtcctcatagtggaactgggactctgggggtggctgggttgggttgcctggaggccgggaatgttcaggagagccttcattgggagcccatgggagcaggagtcagctcctcctgttggcagctccagcattttcgaacaaaaatggctcttccaggagttgagtttggcgaagagacagtgcctgcccaaagtatgcaatgcttttatctttagctcagctcctgagccctcatgcaactctttggacatcttcctgcaaaggacggtgggatcttgtctttctggggcctcagggtctccaaagatgggctgactaagcttccctagcctgggacctgaaccctccaccctcctctctcttgagctctttctcccaggggaagctgctcgaatgaggggagttggccaacacagttttctactctcagaccccattgaggtgagcacacaacagtgttctgtgtgagggtctggatacactccccaccctcccaggcccggcaccgtgtcgccctgccccagcccagagcttgcctctgttggctttgtgaccctcgctttgtactgtggctttgttctgccttagggaccagctggtcccctgctgtggttccacacagtggagactgatccctgaccactcattcagctgcctggcggccctggggcaagtgtttgtcccccatctcccaaaatggcggggtgcaggggctccctgcccggagtcccaaccctgccaaggcagagggaatggggaacagctgcgctggcccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtgttgggctggatgtgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctctcagcccactcatccagggatgcagctctggccttggcccacccccatcagagggcctgtggccctgatcaccgcactccccactctgtgaccagacgttctctcctgagcatcgctgaccctgcagctgtccaaatagagcaagaagtgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcatggtgttggggcctcacagatgatggagaagccagagttcaggcacttggcatgacccctggcatcgccttcagttgatttagtgtctctgccctgggatattccatgggaccctgggctggcttctgtgtgcagaggtgggtgtgggccatagcccagacctgttgaaccagttgtaggctctggaatcctctgtccccaggtagtgaccaggccctgacaggccggtatctgtccctcccatcaccctcccagttatgggtgcagatgaccctgaaattgctaaagcctcagggcttgagcccagaaagtgtgagcaggctggtggggcagctggaggaaggccttgcaggttcctggatttgggtgccgggtgggctgagaggacagtccctgtcactgggactgggcacaggtgcagagaggctgagacgggcccagaggacagtgagtgtgtgttgtgtgggcgccgggccaggaagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctccgggctgcctggtgatagctcccagggacctgcaagctgacaaacaaagtctatacgagccagagctggggtgggaggaacccagtgggcctgggggaggtaaagcagcagcagctgctgtagctgagcccggcccacggccagccctgaggaatggaggaagagagtgccctggctgggggagcccctcaagccctggaagctgtatgtgggcatggggtggtgggggcgtgcagagaggaggaggactgagagctgggtgtgtgtgtgcgcatgcctgtgtctgtgtgatctggttcccgggtgtctgagtagggaccaatgtgtttgtgctggagaagcctgtgtaggttactgacatggggaggggtggggcttgctttcctcaccccgcttcccacgtcttcattgagtcctcatctgggggccctgttccactctccttcccgtgtgcagggccctcccctctggcgagtctgcctctcactcgctcagcccctttaaccctgctggctcctaatgagacttcaggtgtggaccctcgaaccctcagctgcacaggtctggaaacatccttgttcatcaagcaccaggctgaccatggtgtccgtctcagtgcccagcagatgttctggtgaggggaggcgggagtgcaaggtctgccgagtgagggttccttccgggaggaggcagggtgagcgcagaaaccactgctccaaaactcttaaaagcagagccgagagcctgaattcagaggctgtactgtggggcagggctggaatttgtggcacctgcagggctgaacgttgcctttgctgtccctgcttggggattttggggtactgggtttggatagagtgtgtcatctgcagagggagcactgttctggaagtggactctgctcaggtgtggggggcctgcctgtagggggcaccgtggtggagatggagcaccgctcatgacaggaggctggtgtctggtcaggctgagggatccgtgtgccagcccttctgggaaggctgaatggggcggaactggtcagggcctggcaccaactccaggaggtgctacacccagacagacagatggaaagccacctccctagaggcctcctccccctccccttctgcatgccaccacaccccagcagcgtctcctgaggctgggccatgggtgaatctgagtcgagggcagggcagagtgggagtggcagtgcctctgcctgtctccctggccgtggcaggtcctttgtcacgtatggaccaggagaggtgagtatgattgtggtagtggtgggggcagtggctgaggacccctctctttgctgggctggggcagagcttgaatggagaggggctgccttgtgcctgggaagggaggaccaggtgtcgctggtaccttccaggtcctgaatgcttgttctgtgcctagcccctgctgaggctgcggacgttacaaaccaggatgtgttttgaggctcaggacacctctgaggacttgctgctgttacccccatttaaaagacgaggactctgaagatctgaggtgcatagagtgtagggattaaaagtagttctggctgaattttaaatcctggttccaccatttttgagctctctgatcttgggacccttaatgtatttgctctgtgcctcagtttccccatctgtaaatgagaatgaaagagtaatcccacatccattggttgaaaacttcaataagattatgcatagcaggccgggtgtggtggctcacaccagtaatcccagcactttgggaggccaaggcaggtggatcacttgaggtcaggattttgagaccagcctggtcaacatggtgaaaccccatctctactaaaagtacaacaattagctggacataatggcgcgcgcctgtgatcccagctacttgggaggctgagcaggagaatcctttgaattcaggaggtggaggttgcagtgagccaagatcacgccactgaactccagtctggaccacagagtgagactgtctcacaaaaaaaaaaaaaaagattatgcacagcacctgcagcacagccccagggatgatttttaaaagtgaatccagggccaggtgtggtggctcatgcctgtaatcccagcacttggggaggctgagacaggattacctgacatcaggagtcagtgaccagcctggccaatatggtgaaaccccatctctactaaaaagaaatcccagattctgccatgccacagtgtccaagtcagtcacctgctcgcagtcggccctcaggccctgtggctcctgtttctgctgacttgtccagcctcacagtctggggaggccttggggtccccagcctgcgctgggacaggggtattattccgtcagcccttctgtggaacaagtagggaaggagtgatgtgacctccgtggctctcctgggacacaggttagtcctgtgggtgacctcactttagagagggctggccagctgtgccggaattaggaagtgggtacagctggacaaaaggtggctggagccagctctacagaagccacacctgctcatgagaagggtatccttgtgagtacaggggaaatggcatggagaaagacaaacactggtgggtggctctgccagcttcccctggggtgcttctggcgatgcccaggcctttgcacgctcagatctttgcaccccactgttttaacttggagaggagaggaggaagttagctgctctgaatggtgttgctgctaatctctacagcactttcctgtaaattaggaacggtaacacacacacccctcccccaccccgttggagaagccctgcaccagagcatacagtttggcaagtagggggagggctggagcccagcctcacttgccaccctggccaggccgtgattgcccagggtgcatactgtggctggtgctctgccacctgctgtttctgtcctcagggtaggacacaaggagggcaagtagggctagtcagtgagaggcacaggtgatgcgtgttctagggcttgagatcagctgcttccatttcagtaattgtctttggaggtacgttgtttgctcaagcaacctcccttcaagatagtgcctttttctttctctctctctcttttttttgggggggggaggcagagttttactcttgtcgcccaggctggagcacagtggtgtgatctcggctcactgcaacctcggcctcctggattcaagcgattctcatgcctcagcctcccgagtagctgggattacacgtgtgtgccaccacgccctgctaatttttgtatttttagtaaagatagggtttccccatgttggccaggctggtctcgatctcctgacctcaggtgatccgctcgcctggcctcccaaagtgctgggactataggcatgagccaccgtgctggctgatagtgccattttttaaaatccctatttacccagtggaaaacctgagacccggaaaggtcattcacactcccagaagtgatggttggtccagaattcaggtccaagtgtgagacttcaacatttacattccttattttttcttcttccttttttttattttaatcaaattattacttcaaaatgtatcacactcatcagtttgaaacagttaagcagtacaaatgggaatatgagagaaagtcactctcccacccgccctcttgagaggcaatagccttgttttgcatccttctgagtactctattcacataagatgtatctgaatatgcatgtaattcttttgtgaaagtgcatttggagatcactgttttacacctgccttttacatcttaatattatgctttggagatcagttgacatcagcatgcatcgatttgcatcctatttttcacagctgcatagtgtttcgttgtgtgtgcctaattttttaaaacaggtgcctgtgcatagatttcatgtttccatcttatgctgttagaaaaagtgctgcagtaaagatcctaacagacaagtctctttgcaaatataggaaacttttctgtggaataagcttctggcacggaagccccggggtaaagggtattttgataaatattgtgaaatgtcttcccagaaggtggcctggttttcacttccagcatacatctgtgagaggtcctgcttcccacactcccccagcactgtgtagctcaggacccttgttttttgctgttactatttgtgaaaaatggtatctcaaccacaccggaagttttaaatgtagataaatgtcttatgtgccatttatatttctctacagtaaagtatatattcatagccttagcttatttttaaattatgttccttcattgtttggggagtggggggtagacttgcatgagtatgttataggctaagggaattaactgataagttaatatatgtacatcttgcaaatgcacttcttagttttttactcttttaagtatgagcttgctcacttgctctctgtatctcacttaaactttatgtgagtgtattaatctttcattatttagcttctgaatttatatttcttcaatctccattcctttttttttttttccttgaaatggagactcgctctgtcacccaggctggagtgcagtggcacgatctcggctcactgcaacctctgcatcccgggttcaagcaattctcctgcctcagcctcccgatttgctgggactacagacatgtgccaccacgctcggctaatttttgtattttttagtagagaccattttggtcaggcaggtctcgagctcctgaactcaatcaatctacctgccttggcctcccaaagtgctgggattactggtgtgaaccactgtgcctggccctcgttcttttttttatatgaaaatatttcaaatatgtaaaaattaatataacagacctccatgtgataatcagccagatttatcaagtgtgaaccttatcccatattagatattttttcctttaagaaataaaatattacaagtatagaactaaagatgtgctactatgatctattctattcttccccacattcctttttttttttttttttttgagatggagtctcactctgttgcccaggctggagtgcagtggcgcgatctcggctcactgcaatctctgcctcccagatccaagtgattttcctgcctcagcctcctgaatagctgggattacagacgcacgccatcacgcctgtctaatttttgtatttttagtagagacggggtttcaccatgttggccaggctggtctcaaactcctgacctcatgatccgcccaccgtggcctcccaaagtgctgggattataggcgtgagccaccgcgcctggcctattctttcatcatacacataagcacgcactatttacaaatatacacaaacttagtgctgttttctgattcatcctttatctatttgcaacactttaaaaagttaatgttatgttttcacattgatcccagttgacctgtatggattaatttcttcagttgacatggctatataatattcagttgcgtgaatgtagcacagcttatgtagccatccctctcctgacgatagttaagttgtttccattttttgctattgtaacactgctaataaacatgcttgaatggggtgtcccgtacaagggagggttactcggggctgtgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgtgtctatgagtttgactgcttttgagtacctcctataagtggaatgatacagtatttgtccttttgtaactggcttatttcactttgcatagtgtcttcaaggttgatccatgttgcagtgtatgtcagaatttctttttttcttttcttttcttttctttttttttttttctgagacagagtttcgctcttgctgcccaggctggagtgtaatggcgcgatctcagctcaccacaacctctgcctcctgggttcaagcgattctcctgcctcagcttcccgagtagctgggattacacgcatgcaccaccacacccggctaattttgtattttcagtagatacagggtgtctccatgttggtcaggctggtctcgaactcccaacctcaggtgatctgcgtgcctcgacctcccaatgtgctgggattaaaggtgtgagccattcacccggccgtctttggattttatacagcaaaactccataatatttcctttacatgaatttcctttctttttcaggctgaataatattccattgtacgcatagatcacattttgttcattcatccattgatggatacttgggttgcttcccgattagctattgtgaataatgctgctatgaacatgggtgtacaaatatcgctttgatattctggtttcagttctttggggtatataccccgaagcacagttgtgggatcctatcttgtctcttgttttctctttgcttccatgttttttctcattgtttcgtgggaatactgatattatatattcaagtatttgttgattacatgcactgtacctgacttgtttaaagcctgatgtcttgagtactgtgcacccctgtgcctggctgagtagtggaggaactttgaaagggtctgttctggagagggggtgctgctctggagaggcggtgctgctttggagatggattaatcaggaacttgggtgctgattctaggaggtactgcatctagaaagatgggaggtggggagtgcaacttccccaattttgcctttaacttcagatccttggggtgggtgcattgcttctcctgggatggaggggtgccggggagcccctgaccaggacctggagcaggtccacacaggcactggatttgtcctttactttgggcccaggctgcactcttgattccacctcctcacactggcttcagctttctcaccctcagaatggaattcaaagcctctgcccctcccaggcagacaccaaggtatgattttcaagtggttggtgtcttgtgactggcagctgataaacgggtgatacagtgtttctatacaggagtctgcagtgccaggctgcaggggcggacgggagggggtcgtggtgggtagcctgtggagcctgagggtgggaacagagagacttcttttgctgtaggtggaagcctgtctggctcctttccctcaaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctgcagcgtccagccagggactgtgccgcaggggccagaagatatctgacctactgtcactgcctcttccactctgttccacctgcactggagcgatgctatccgatgaacagatccatttattaattcaacacgtttgtattgagagcctgctgggtgccgggcactattgtcaacatgggtaatacagcagcaagcaaaacaagagaaacatctttgcaagcaggggagggggcctgcagtgttgggtgtgtggagttgttgctgggaagtagagaagctgagtaagagctggacaaagaggccaggcacagtggctcacccctgtaatcccagcactttgggaggccgagtttggcagatcacttgaggtcaggagttcgagaccagcctggacaacatggggaaaccccgttcctactaaaaatacaaaaattagctgggtatggtggtgcatgcctgaaatcccagctacttgggaggctgaggcacgagaattgcttgaacccgggaggtggaggttacagtgagccaagatcacacaccattgtaccccagcctgaatgacaaagcaagactttgtctccaaaaaaaaaaaaaaaaaaaaaaaatagagaaaaggaaagctggatgaagagagatagccaagcccatgtctacggaaaagcattcttgactgagtgaacgaaagtacaaagcctcagaggagggagcatgcctaggtagccccctagacctggtgaggctggtgcgtggggcagcctccatggagaggagttgggcaaggagggaggaggtgctggccagtagagcacgtgtgtctctgtgcgtcagagcaaggacccgggctctccccgtaagtgagaagagtccatggaggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaagttcggcagggaagccagaggagtccgcagcccgggagacctggcctacagcggagagagtcagtccatgccagtggtgggatgtggctgcaaaaaatggtcggattcatggaagtctggtgtccatctggcaggcgttagtggtcccacgaatacagctgtgtgccttgaacacatactgcagagcttccagagagcaccagggctgtgggggctagagactgtgtctcgtgcggaagcgtggctgaggaggggcttgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtgggggttctggctgaagtagccagaattccagtgccagctccgctcctcacgagctgtacaacctgggccggttactgacccctttcccaccttagttccctggctctacaatggaggtaattatcgtgttgaactcacagggtcgagatcatatttaatacttgcacagcccttagaagcatctagcacagtggtcctcagcatttggaaatgtctggaaacattctgtcacacctggggagtgggatttccttctggtgtctagtgggtagaggccagagatgctgctaagcgtcccacaatacacaggacagaccccgcaacaatgaactgtctggcccccaaagttagtggggcagagattgcaggatcctgattccttttcttccttttttttttttttttttttgcccctggctatgagtaagagatcctggtttcgcacaaagtgaacgtgcagtacattgtttcagttgttaattcgccatgcaatacatcgttagtcacgtattattgtttgtcaaatgtgtataaaacatctgccacattcttggcagtttaatagaatctagagatataaagaagttcctgaccacagagttcatagcctcacaggcaagataggaaaacacagaattatataatacgaaattacattatatcatagagcatattctatagtaagttactccgattggcttttggtattaaaatgtcttcagtttcagaggtcccaggatagtgggcaatatttgaaagccagtaaatataaaataaaatatattacctgtgtgaaagagaatttttcaggcacaataatattttaaagagtttatttgtgtaagaagtgaattgggaaacagaaaaccgaaagaggtttagtggcccaatgacagtttcagaggcaggtgtttggagagtgaatgtaaaagcaaaatgaagaatttatttgatttaattggttgcaattacaaaattgctttgtttggtttaccttgttggaagtttcctagtcacataaccatatgttagttggctacttatgattggctgaagttttatttgtgtcaaacagaagcatttaccataaataaccccagttaagatttgattatgctgtcttttaagcaaggttaaggctgttgttaaggcctcattggttttgtttggtaaggaatttttcaggcctggtctccaaattttgctttaacaattccttgcttctggttattctctcagcaagctgatagtgtgactagatgacacagtattactctctgttaccaccaccaatgtagtcactgggacaaagagtcaggtagatgttgttgtcatcatcagtaggtaggttggggatgagaattccatggccacagttagcagttacatagtcagtgttgctttcctcaagttgaatgatcctcatggtaactgtttgatatttgagcagctgttggaaatcatttagaacccttgagagaatacaaggcaccaggggggtaaacataataattataaggagaataatagccaaggattgaaaaattcctctgagcaaagattcccaggagccaagacttaaccagctgagtgaatcaatggagaaggcagtgcccatctaatgaaaaacccatgtgtgttctttaaggtattttaagttttcggtaatacctgatttgttaacataaaaatgacactttttttttttgagatcgagtcttactctgtcgcccaggctggagtgtagtggcgcaatctcagctcactgtaaactccacctcccaggttcaagtgattctcctgcctcaacctcctgagtagctgggactacaggtgtgtaccaccacacccagctaatttttgtgtttttagtagagatgggatttcaccatgttggccatgctggtcttgaactcctgacctcaggtgatccacctgcctcagcctcccaaagtgctgggattacaggtgtgagccaccgtgcctggccaacaccttctttttttttttttttttttgagatacagtctcactctgtcttgcccaggctggagtgtgcagtggtgtgatcttggctcactgcagcctctacctcctgggttcaagtgattctcctgtctcagcctcctgagtagctgggaatacaggcgtgtgccaccacacccggctaattttgtatttttagtagagacagggtttcacccaggctggtctcagactcttgacctcaggtgatccacctctctcagcctcccaaagtgctgggattataggcgtgagccatgcgctcggccagcaacacctttctaccaattagggaacaaggtctccctttttgagcagttaaagtagcaagaagtcttctattgtacagtactactgaggccaattcattcatcccagattgtactgcttaagataattcgaagtgtcaattaaactttttcagaagttggtaaaatattaattgatttttttcaattcactcaactgagagaaacgggctcttacagaagtatgaaatccagaaccccttcgtaagactgtgtctgggatattatgattctcttttgtgaggggtcactttatgtacaaatgactctaaggatttgtatggcaattgaagagtcatatctagtcattttaggtagaagatagcccacaccacagatccagactggctaggtagaacacctttacatactttgttgctgcataaaatgaataattcggtgttatcgatagaaagggtcaaagtgcatcctattacccacgagttgggggtgatacgaatgtcatggttattctccgtcacatctgcgtctgcacagcgccacgttgaatggttatggtttcaattggagtaggaacaaaaaacatttctatgaatttgataaaatgactgtatgccatcatcaattagggatgattggttttctttttatttgagacggagtcttgctgtgtcactcaggctggagtcagtggtgcaatcttggctcactgcaacctctgcttcccgggttcatgcgattctcctgcctcagcctcccaagtagctgggactacaggcaccaccaccacgcccagctatttttttgtatttttagtagagacagggtttcaccgtgttagccaggatggtctcgatctcctgacctcgtgatccaccctcctcggccccccaaagggatgactggttttctttccaaatatgacctgagcattgatctgtccaataagcaagactgttatgtacattatgtagtggatctattgaggcatacgattttcctgtagcatttccattgaaccaatgtctagttctagtaagttctctgatgatatggttgaggctttcatggtcatgttcagattttatatatgtgtctcatgtaggaatctagtcttcataatctgtgtcaaacctaagaatttgagtacagagggattctggaacactgcccagatttggcccagttccattcatgttttctgtgcgtagagataagttaccattaatgacatcaatcgtagttgtaggccatccctttgcctctgttgcttcttccaagagctacactggttgatcataaatatcagccaactgccaagggaaggataccaacccttttcataacgccattttcctgaattgctcactcaagtgtgtatgggagcaggttctaatattagttgtgattctttccatttatctagaggattacgtagccaccaattgctttgcttagtagtgaggatggcttcatgttgagcagtagatcttagaggatattcagtgtggataatgaaattccctaacgaaaataaaagtgtgaaccttttgtgctaaaacaaaacaaaaacaagtctgagtcaatagaagggggccacatggagtcttgtttcattgtcttgggaaagctgtgtctatttcatgatatcatctacttttatggaaggatttctcttgggtatccttaattttgtttttatattattattattattattgagacggagtttctctcttgttgcccaggctgcagtgcagtggcacgatcttggctcactgcaacctccacctcccgggttcaagtaattctcctgcctcatcctcctgagtaactgagattacaggaatctgccaccacacctggctaatttttgtatttttagtagagatggggtttcaccacgttggccaggctggtctcaaactcctgaccttaggcgatccaaccaccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaagctgaggcgggcggatcacctgaggtcaggagtttgagaccatcctggccaacatggtgaaaccccatctctactaaaaatacaaaaattagccgggcatggtgacacatgcctgtaatcccagctacttggaaggctgaggcaggagaatcgcttaaacccatgaggtagaggttgcagtgtgccgagattgtgccaccgcactccagcctgggtgacacagcgagactgtatcaaaaaaaaaaaaaaaagatccagtttccagattccaggtcacgtaaggtgggatcatcaataggcaggtcacagaaagcctccttcacctggtgggatatactttggcatcatacatcaagaccttgcagtattgagtcacatcagagccaccagtagagtggataaatgaagttctgttatgaaaggcacaagtcgttcagtatttattttgtgaagggccactttatgtgttcccctaggggctgatgttcttgccataaaggtcggtgataattcttttggccaaggtaattcagttgactctgttaatttagctaattttagttttgtgataccatttctgcattcagcctttccagaagagagagtgatgagggcaatgatagtgccgtcaggtctgtaaactcttatttggtggataacctgtcaaataaagcgaattgccctagcactagagacctcctcggcaggtaggtgggatttcatctttctggagcctgagcatctccaaagaagagctgccgcatggagcttccctgactggtgacctccaccctcttctctccagagctctttgacccagaggaatctgcaggaatggagggagttggccaaagtagggagatttttactcagaccatatccaggtgagcacacaacagccttttgggcttgggctgatgcgtgcatttctgtctgtacatgcgtgcctggaagtgtgcagatgagtgtgtgagagagggtaatggccatgcatccttgcatagacaagaacatggggtgcacttctgcatgtgcacagcccctccccaacccgggcctgtggtgctgtcctgcccctagcccagagctggcctctgttggctttgagaccctagctttgcactgtggctttgctcggccttagagaccagctgctcccctgctgtggtctctcatagtggagactgatccctggccacccattcagctgcctgagggccctgggaccagtgttcatccccccacctcccaaaacagaggtgtgtaggggttccctgcctggagtcccaaccctgcaggatggagaaaatgggcaccagttactgtgacccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtattgggctggacttgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctcccagcccactcatccagggatgcagctctggccttggcccacccccatcagagggcctgtggccctgatcaccgcactccccactctgtgaccagacgttctctcctgagcatcgctgaccctgcagctgtccaaatagagcaagaagcgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcttggtgttggggcctcacagatgatggagaagccagagttcaggcacttggcatgacccctggcatcgccttcagttgatttagtgtctctgccctggggtattccatgggaccctgggctggcttctgtgtgcagaggtgggtgtgggccatagcccagacctgttgaaccagttgtaggctctggaatcctctgtccccaggcagtcaccaggccttgacaggcgggaatctgtccctctcatcacccccccagttatgggtgcagatgaccctgaaattgctaaagcctcagggcttgagcccagaaagtgtgagcaggctggcggggcagctggaggaaggccttgcaggttcctggatttgggtgccgggtgggctgagaggacagtccctgtcactgggactgggcacaggtgcagagaggctgagacaggcccagaggacagtgagtgtgtgttgtgtgggtgccaggccagggagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctctgggctgcctggtgacagcttcggggacctgcaagctgacagagtctccaggagccagagctggggtgggaggaacccactgggcctgagggaggtagagcagcagcagcagcagctgagcccagcccccggccagccctgaggaatgggggaaaagagtgccctggcttgggggggccctcaagccccggaagctgtatgtgggcatggggggcgggggcagagaggaggaggactgagaagtgggtgtatttgggcaggtgtgtgtgtgtgaccaagcttgcgggcgcctgagtatggactagtgtgtttgtgctggaggagcctgtgtaggttactgacatgggagggccggtgtgagctgcagggaccggagagctgctggaaggggctgtctatgccttcaggctctgagtgtggatgcagctgggcctgttcaggcagattcaccagaggggctactgcgcagagcctgggccctggacacctagaagggcccctcctcccctcgtcttccctccctcatggcccacctttactctgagggggtgggcttcctgcgggggacaaactggagagggactctcttgccgccttctctgttcctggggacaggctgctgcagggtggagggcttgcttttcctgcccaccctcatctttgccgagtcctcgtctgggggccctgccccactctcccttcccaatgcagggccctctcctctggcgagcctgccttgatactccccggctcaacccctttaaccctgctggctcctaatgggactaatgggatttcaggtgtggacccttggaccctccgctgcacagttccagaaacttgttcatcaagtgccaggctgaccatggtgtccgtctcagtgcccagcagttgttctggtgatgggaggtgggagtacaaggtctgccgagtgaggcagaggaaaggggtttctgagcccagatctccggtgctccaagacactcaaaaccagagctgagagcctgaattcagaggctgtactgtggggcagggctggaatttgtggcacctgtgtagggactccagggctgaacgttgcctttgctgtccctgcttggggattttggggtactgggtttggatagagtgtgtcatctgcagaggcagcactgttctggaagtggactctgctcaggtgtggcgggcctgcctgtggggtcaccatggacaggaggctggtgtctggtcaggctgagggatccgtgtgccagcccttctgggaaggctgaatggggcggaactggtcagggcctggcaccaactccaggatgtgctacacccagacagacagatggagagccacctccctaggggcctcctccccctccccttctgcatgccaccacaccccagcagcatctcctgaggctgggccatgggtgaatctgagtcgagggcaggacagagtgggagtggcagtgcctctgcctgtctccctggccgtggcaggtcctttgtcacatatgggccaggagaggtgagtgtgattgtggtagtggtgggggcagtggctgaggacccctctctttgctgggctgggacagagcttgaatggagaggggccgccttgtgcctgggaagggaggaccaggtgtcgctggcaccttccacgtcctgagtgcttgttctgtgcccagcccctgctgaggctgcggacattaaataccaggatatgttttgagactcaggacacctctgaggacttgctgctgttatccacatttaaaagacgaggactctgaggctctgagaggttaagtacctggtccaggtcacctggtcagtttctttcttttttttttttgagatggagtcttgctctgttgcccaggctggagtgcagtggcgatctcggctcactgcgagctctgcctcccgggttcacaccattctcctgcctcagcctcccgagtaggggactacaggcgcccaccaccacacccggctaattttttttatttttagtagagacagggtttcactgtgttagccaggatggtctcgatctcctgacctcatgatcctcccacctcggcctcctaaagtgctgggatgacaggcatgagccaccgcgcctgacccacctggtgagtttctgagctccagacaactcatcccaaatttcatgggtgcatagagtatagagattaaaagtagttctggctgaattttaaatcctggttccactattttcgacctgtctgattttggaacatttaatgtattccttctgtgcctcagttttcttctgtgtaaatgagaatgaaagagtactcccccatcaatttgttgaaaacttcagtaagattatgccaggagctgcagcacagccccagggatgatttaaaagtgaattcaggacagggcgtggtggctcacgcctgtaatttcagcactttgggaggctgaggtgggaggatcccttgagcccaggagtttgaggccaccctagacaacatagtaagaccttgtctcaaaaaaaaaaagcgaatccagtggtgtcactctttgttatcaatgccctccagtgacattcatgacacccaaacttagaatctgagcttttagggtggcctgtgacatctataccacgtgtccccgtggcctccctggcaccccctttccttcctggctgtctgccaccatatggaactttctgtgccttgcacccagccagctcagagtcttgggcacttctctcagtctggaaccttctcttgcctaccccatcttcccatggctgcccttcatgtaggcctccggtttatagccggctcctcagagacatggttctatccccccagtggccaagggctggtggccctcactctctgcccctgtgccctgtgttagtggtcctgtggttgtcattgccccgtcatctccaccatttcctgtttgccgtgtgtctgtgccccccaaggatgaatgccatgagtccagcatgtcaccctgtttctgtcctgccacagtgctcgagtcagtgccctccctgcttgcattcggcccacaggccttgtggctcctgtttctgctgacctgtccagcctcacagtctggggaggccttggggtccccagcctgtgctgggacaggggtattattccagtagcccttctgtggaacaagtagggaaggagtgatgtgacctctgtggctctcctgggacacaggttagtcctgtgggtgacctcactttagagagggctggccagctgtgccggaattaggaagtgggtacagctggacaaaaggtggctggagccagctctgcagaagccacacctgctcatgagaagggtatccttgtgagtacaggggaaatggcatggagaaagacaaacaccggtgggtggctctgccagcttcccctggggtgcttctggcaacgcccaggtctgtgcacatccagatctttgcactgcgctgttttgacttggagaggagaggaggaagttagctgctctgaatggtgttgctgctaatctctacagcactttcctgtaaattaggaacggtaacacacacacccctcccccaccccgctggagaagccctgcaccagagcatacagtttggcaagtaggaggagggctggagcccagcctcacttgctgccctggccaggccgtgattgcccagggtgcatactgtggctggtgctctgccactgctgtttctgtcctcagggtaggacacaaggagggcaagtagggccagtcagcgagaggcgcaggtgacgcgtgttctagggtctgagatcagctgcttccatttcagtaattgtctttggagctacattgtctgctcatacaacttcccttccagatagtgccattttaaaaatcccatttacccaaaagaaaacctgacacctggaaaggtcgtttgcactcacacaagtgatggttggtccagaattcacatccaagtgtgagatttcaatattttttttcttcctcctttttttaaatcaaattttatttgaaagggtatcacagtcaccagtttgaaaaaggtaagcaggccaggtgtggtggctcacacctttaatctttgcattttgggaggcagaggcaggcgtgtcagttgagcccaggagtttgagaccagcctgttcaacgtggtgagaccccatctctccaacatttacaaaactagctggtcatggtggtatgtgcgtgtggtcgcagccactggggaggctgaggtgggagggttgcttcagcctggtgggtggctgcagtgagctgagattgggcctttggtcttcagtctgggctacagagcaagactctgtctcaaaaaaaaaaaaaaaattataaaggtaagcagtacaaatgggaatatgagcataagtcactctcattccagacctctgacccccaggacttttctcttgagaggccatagcctttgttttgcatccttctgagtaaacctattcgtgtacagacatatctgggtatgcatgtaactgttttgtgaaagtgcatttggagatatggatatcgttgttttcacccatcctaagttttgatgctatggatactatgttttggagattagacgataccagcacgcataggtttgcagcctctttttcacagctccatagtgtttccttgtctgtgagcagatttcaagttgtttccatcttaacccctagaaaaagtgctgttgaagatcctgacagacaagtctgtagaaacataggaaactttgtagaataaagttctggccatgggccaaattccctctgagaggtagctctagtttttcttcctagtacatctatgagagctcaggtccctcgtgttttgctgttatgatgaatgaaatatgctgtctccatcacgctggaatttgtagatgtagatgaccatagtttcttatttgccattcatttctttacattaaggtaaatattcatgtcctttggctatttttattttatttcttttttcttttcttttttaagacagagtctcgctctctctcccaggctggagtgaagtggcttaatcctggctcactgcaacctccacctcctgggttcaagcgattcttctgcctcagcctcctaagtagctgggattacaggcacctgccaccatgcctggctaatttttatatttttagtagaggtgggggttttaccatgttggccaggctggtctcgaactcatgacctcaaatgatccatccaccttggccttccagaatgctgggataataggtgtgagccactgcgcctggccctttgcctatttttaaattaggtttcttgtttttttttttttttttttttctgatttacgtgagcacatcataggctcagtgaatttactgatatgttaggtataggttgcaaatgtactttagtttttcagtgtctttttttttttttttttttttgagacggatttttgttcttgttgcccaggctggagtgcagtgcaatgacacgatcttggctcactgcagcctccacctccttgggttcaggcaattctccagcctcagcctcttgagcagctgggatcacaggcgcctgccaccatgcctggctaatttttgtatttttagtagagacggggtttcaccatgttggccaggttggtctcgaactcgtgacctcaggtgatccacccgcctcagtctcccacagtgctgggattacaggcgtgagccaccgctccccggctcagttgtcttttaagtgtttcatttgtcttctctctactcctccctctctctcttgcacttgctgtctgtctcacttaaattttatgtaggtgaatatattcatctttccttgtttagcttctcaatttatatttcttcactatctctattaatatgaaaatatctcatctatataaatattaatgtaacagagttgcatgtgataatctgccaggttgaacaaatgggaatattatctctcatatgacgttagatttttttcctttaagaaataaaatattgcaagtagagaaccaaagacatgcccctgtgacctcttttattcttccccatctccccagaatataattatcacttaaagttgggtgtcaacctgtatttcattctttcatcatacacacaagcacacactgtttatacacataaataatgttgtttttggacgcatactttgtttttgcaacacctttaaacataagtttttacttttattattttatttaagataggatcttgctctgtcacccaggctggagtatagtggcgcgatcatagctcgctgcaacctctcatctcctgggctcaagtgatcctcccaccttagttagcctcctgaggaactgggataatcacagtcataagccaccaagcccagctaagttgtttattttatttttttattttttaaataaagatgaaatcttgctatgttatccaggctggtctcaaactcttgggctcaagcaatcctcctgccttggcctcccaaagtgctgggattacaggcatgactttaaaaagttaacattatgggccaggcgcggtggctcacgcctgtaatcccagcacactgggaggccgaggcgggtgaatcacgaggtcaggagatcgagaccattctggctaacgcagtgaaaccccgtctctgctaaaaatacaaaaaaaaaaaaaaaattagctgggcgcggtggggggcgcctgtagtcccagctacttgggaggctgaggcaggagaatagcgtgaacccgggaggcagagctgcagtgagctgagatcacgccactgcactccagcctgggtgacagagcaagactctgtctcaaaaaaaaaaaaagttaacattatgtcttcaagtttatcccaattgacccatatggattgatttcttcagtttacatggctatatagtattcaggtagcacagtgtatatagccatggctgtactgatgatagtgtttccagtttgtttgtttttttttgctattgcagcactgcctaataaatatcctggagtgggttgtacttatatacttcaaaatggaattaccagattgtaaaatatgcacatattcagcctcactagatactgtgaagtgctcttctaagcctttgtgtcagtttgtacttctgccagcaatgtggaaatgagatttggttttaatatgtattccctggtcacgagtgagcctcagcatcttttcatatgtccaccaagtgtttgggtttaatctgtgaattgcctttttgtgttctttgctttttttttttttttttttatttctttgattgttttggtggttgttatggtaaaatgcacaagcacgaggttgtatttaccatcttaactctttctgtgtgtatagtgcagtggcattaagcactttcagaatgtgctaccgtgctaccatcccaccatccatctcccgaactctcttcatcttgccaaactgaaacatcccacccactagtcaagaactcctcatttccgcctccccccagcccttggcagccaccattctgctttctgtgtctgtgagcttgactactttaagtatctattctaaatggaatgatacaggacttgtctttttgggactggcttatttcacttcgcgtagtaccttcaaggttgatccatactggtagcagaatttcctttctttttcaggctgaataatattccattgtatgcgtagaccacattttgtggatccgttcatccactgatggacgcttgggggttgcttccacattagctattgcaaagtcaataatgctgctgtgaccacgggtgtacagatatctctttgacatcctggtctcaaatattttggggatatacccagaagtgcagttgcttgatcctatcctgtcccttgcttttccctttgcttccttgttttttttttttctttttgttttatgggagtgctgatatattcaagtatttgttgattgcatgcattatgcctgacttgctcaaagcatgatgtcttgagcacttagcaaccttgtgcctgctgagtggtggaacagttctgaaaaggtctgttctggagtgggggtgctgtttcggagagcgatgaatcaggggcttgggtgctgactttaggaggtgcggctcttggaaagacagagtgtgacttccccagtgtggtctccttccttttcctcaccacttctcctacctaaccccaagaatgagtccttgagtctgtctcagtaggtggatctgcattcagtgcagggcagagcctgggtggcagtgcctctccttgcctccctggctgctacaaggtcctgtgtagcatctggtgtggacccagcagccaggaggagagctgagtgtgattggggtcgtggtggggccagtggcagtggatctctctctttgttgggctgggccagcgcttgaattgagaggggctgccatgtgtctggggagggcagaacccagcgtcactgacaccctccagatacagagttcttgctctgtgtttggcccatacctaatgttgtgaagtggaaatactggggtgtgttttgaggctcagaacacctgtgataacttggtcgtgtgtgtgtgtgtgtgtgtgtgtgtgtgtgtgtgtatgtgtgtgtatgtgtatatataaaattattttccttaacaccactgacctgaaggcagttacacgtaatttacaaatgaggaatctgaggctttgagattgtcaaggtcacctgaccagtgactgcagaggctggattggcctgtgggcctgagtccgtaccccttttcactggctcctcctggaggccacatgtaccttgcgcttcctggggcttggtcctggggtttcatctcaggttgacccccgttaggaggaagtaagtaggaaggaaggagatttcctgggtattagggtgtcctcaagcctgcagctctcctgggactgcacagagtttactgtcggacatcagttctgatatggtgcagcagacatggagctggtaagtggttaagatcagtcggacatgacaacctccagttctgcagaagccacttcatttgcctggggataaagcaggtccttgtgagctcatcgacatgcatttggcagaaagtgcgctggctctgccagctcccagtgtgagcttctagcaagccccttgtgccttagatgcccaggtcttttcagaataagcctggcttgttttaacttgatgcaacttgctgctcacagtcatcttattgtttgctgatgaattcagacctccattcatttaaatatttgtcagttatctaccatgtgtcaggcattaaatttagtgctggagatactatgggacataagaagtccctgcttgctgggagtgcgtggtctaattggtacttgggacagtgtggtttaactgccacaaagttaataaagcagcatgatgtgacagagctggatgtgggggagtgaggaagcttctctggactgggtggtctgaaccccatgcagggaggaaactgtggctgggaggagaggaggccggaagagaggtctgggcttgggtcccaaccactgattccagatctctcaacatttgtaacacgaccaactcctgttcttttttttttttttttttgagacaggctagagtgcagggggacgatcatagcttactgcagcctcgatctcctggactcagggggtcctcctgtctcagcctcccaagtatctaggactacaggtgtgtgccaccacacccggctaattttatttttatttttatagagacggggcagagtctgcagtcacatgccttgcaagtagcagagacagggtttagtctcggtagccagtgcctagggcacaggtcttggccagaggagagaaggctcaggtgaaccagtttcatctgacctgcttgctaactcaaacatggctgcccaactgcgtgggctggcaaggtatgtgaggtgggtagctgggtggcccgccccttgcaggcactggggcaggatatcagggggtccagaagaggttgggtttaggcagagtagaggtgattgtgtgggccgggggagcaatgtcaccttgaatgtgtttccatacccagggcccagatggctcaggaggagggggatggggacggggagagtgaggtctttttgactttgatgtgctttgactgcacatcagagtcaaacgagtcagaataagcgggacccctccacaggcatctcagccctcctaatttagcctttctgaagtggagccttgggagccgatgaagcttaataaactctcctggtgcttccagtaggcacttgagggtggacaccaccgtcttcaggtcataggaagtgtgagctagcaggaatcctggagattttctagcccaacagtgtccggtcaaaatagaatgggagccagaaatacaagccacatgtaattttaaattacttttaaaacatttaaatttagccacggttttaaaaagtaaaaataggtgaaattcgttttaatattttaacccaatatagccaaaatcttggcatttcaacatgggatgagcataaaataatgaaggtgatattttattctttttttggggtactaaatctttgaaatccggtgtgtattttccacttaaagcacatgtcagtgtggactggccccattgcaaatactcagtggcctgggactggggtgaccaagtgggatgtggtggggctggtgcagtccaccattctcacagcaggcatctggggtcaggggaggcagggcactggctgtgctggaagcaggggattggctgtgctggtgggaagccagattccagccccagacactggtacctttggctttagatccttggggtgggtgcattgcttctcctgggagggaggagcgcccgggagcccctgaccaggacctggggcaggtccacacaggccctggatttctcctgtatcctgggcctggccctgctctcttgactcccacctcgtcacagtggcttcagctttttcaccctgagaagggaattcaaagcctctgcccctctcaggcaggcaccaggatatgattttcttttttcttttctttttgtttgagacaggatctgacttggtctggagtgtagtagcctgatctcagctcactgcagcctccacctcccgggctcaagtgatcctcccacctcagcctctgaagtaattgggattacaagcacatgccaccatgcccggctaatttttgtattttttatagagatggggtttcaccatgatgcccaggctgttcttgaactcctgagctcaagcaatctgccctcctcggcctctcaaagtgctgggattactggcatgaggcacggggccctgccctgggtatgattttcaagtggttggtgtcttgtgactggcagctgataaacgggtgatacaatgtttctgtacaggagtctgcagtgccaggctgcaggggcggatggtggggggtgggtgggtagcctgtggagcccgagggtgggaacagagagtcttcttttgctgtaggtggaagcctgtctggctcctttccctctaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctacagcgtccagccaggggctgtgccacaggggccagaagatatctgacctactgtcactgcctcttccactctgttccacctgcactggggcaatgccatctgatgaacagatccatttattaattcaacacgtttgtattgagagcctgctgggtgccgggcactattgtcaacatgggtgatacagcagcaagcaaaacaagagaaacatctttgcaagcaggggagggggcctgcagtgttgggtgtgtggagttgttgctgggaagtagagaagctgagtaaagagctggacggagagagatagccaggcccatgtctacagaaaagcattctagactgagtgagcataaatcgcaaaggcccagaggagggagcatgcctagctagccccctagacctggtgaggctggtgtgggttgggcagtgatacggtttggctgtgtccccacccaaatctcatattgaattgtagctcccataattcccatgtgtcatgggagagacctggtgggagataattgaatcatggtggtgttctcccccaagttgttctcctggtagtaagtgtcaggtgagccgatggttttatgaggggtttcccttttcacgtggctgtccttctttcttgcctgctgccatgtaagatatactttttttcttctgccatgattgtcaggcctccccagccacgtggaactgtgagtccattaaacttctttttctttattaatttcccagtctcgtgcatgtctttatcagcagcacgaaaacagactaacgcaggcagcctgtgttgggaggagttggcaaggagggaggaggtgctggccagtagagcacatgtgtctctgtgcatcagagcaaggacccgggctctccccgtgagtgagaagagtccatggggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaggttcggcagggaagccagaggagtccgcagcccgggagacctggcctacagcggagagagtcagtccatgccagtggtgggatgtggctgcaaaaaatggtcggattcatggaagtctggtgtccagctggcaggcattagtggtcccatgaatacagctgtgtgccttgaacacgtactgcagagcttccagagagcaccagggctgtgggggctagagactgtgtctcgtgcggaagcgtggctgagaaggggctcgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtggaggttctggctgaaggagccagaattccagtgccagctccactcctcacgagctgtacaacctgggccggttactgacccctttcccaccttagttccctggctctacaatggaggtaattatcgtgttgaactcacagggtcgagatcatatttaacactttcacagcccttagaagtgtctagcacagtggtcctcagcatttggaaatgtctggaaacactttgtcacacctgagaagagggatttcctactggtgtctagtaggtagaggccagagatggctgctaaacaccccataatacacaagacagaccccgcaacagtgaactctctggcccctccaagtcagtggtgcagagattgagagatcctggtttcgcgttttgagcgtgcagtacatttcagttgttagtggaacatgcaatacatctttattcacatgttattacttatttgtcagatgtttgtaaaacatctgctacattcttggcagtttaatagaatctggagatacaaagaagttcctgaccacagaggtcatttaggcaagctaggaaagcacagaatgatataacacaaagttacattgtaccataaagcatattctatagtacacttaactctggtgggctcttggtataaaaatgtctccaatctcagaggtcatgggatagtgggcaagacatgaaaaccttgtataatataaaattttgttacctctaagtgctgaaattaaggtataaacaacgtctcatgggaaccaaaacatcagtcatttggaagtataagtcaagccttcgtaggagaggaaccatttcagcccgatattaccagagtgggatggtcccagcgagcgggatgtggagggttaggatgttatcttagtctgttttgtgctgccattaccaccaagtaggtaatttataaggagcagaagtttatttggctcacagttctggaggctcggatgtccaagatctagaggacacatccggtgagggtcttcttgctgcattgtctcatggtggatggaagaagggcaaggtggagagagagagcaggaaggggcctaattgtccttttataaggaacccactcctgtaataatggcattaaacccattcatgagaacagagcccttgacccattcatgagaacagagccctcatggcctactcttatgagaccccacctcacaacattgttaacatttaggatcaagtttctagcacatgaactttgagggacacattcaaaccatagcattctgccccagtccccaaaatggatgtccttgtcacatgtagaatacatttgcttcttacctataatcccaaattcttatttgtttcagcaccacattaaaagtccaaagtccacagtctcatctaagtcagctgtgggtaaaactcaaggtatggttcatcctgaatcaaattcccctccagtcatgggctgtgaaatcaagcaagttgtctgcttccaaagtacagtgatgggacaggcataggacagatattccattccaaaagggagagataggcaagaagaaaggggcaactggtccagacaactccagaacccagcagggggaacaataccaaatcccaacttgacaataatcttctttgactccatgtcctgccttccagacacactcgggtagggacttgggcccccaaggcctccggcagccctgcttccctggccttgctgggctcattccatgcagcagctctcaccggttggagtctcatgcttgcagctcccccaggttgctgttgcacactggtagctctgcagttctggggtgtcaggatggccttactcccacagctccactaggcttcctggggactctcagcagctcagactccacagttctgctgggcattgccctacaggggctccctggtggtggctctgaccctgcaaccagtctctgcctgggtcccgagtctgtccgcaatatcctttgaaatctagttggagggagccaggcccatagcccctgcattctgtactctggtggcattaggaccatgtgggatgccaccaagactcaccacttgcaccttctagaatggtaggtcaagctgcacctgggcccatttaagccatggctggggaggcagaggagcactgtgcccaaatgtgggagcagagacttgaggtggccctggacagtgagccacaggtcctgagggctcccaagacctggcttttgacatagttccttccctcagattttggcactgccggagctgtgatcacaggtcatctctgcagtacctttgggatcattcttattttcttgatgaatagcctctggcttcattcttattgtactaatctccttatcaaactgtggctctggccaatactaatctccttatcaagtggtccatactaatattcttattaaactatcaaacggtaacatgcctgcacccttgctttcctctcctgaaagttctttcattctctactacagggccggtctcagaatccttccagtctctaagttctgtttcgcttttcattataaatttctttctttctttccttctttttttttttttttttttttgagatggagtctcactctgttgcccaggctggagttcagtggcacgatctcagtttactgcaacttctgtctcctgggttcaaaccattctcctgccttagcctccctaatagctgggatttcaggtgtgtgccaccacacccagctaatttttttgtatttttagtagagatggggtttcatcatgtcagccaggctggtctcgaactcctgacctcaaatgatccgcccgcctcagcctcccaaagtgctaggattacagacgtgagctactgcgcccaaccctgcttttatttataagtttcatctttaaattatttatttcttctcaagttttacagtatacagttaaaataagtcatacagcaaccaaaatgctttgctgcttaggtatttcttccaccaaatagcctagtttatcactcttaagttctgcctgctatacagtttgaggacctggacacaatgtagccacattctttgctgctttgtaacaaggatgactgttatgccagtttccagtaccttaatcttcagatatatctgagacctcatcagaatggccttcacgatcgatatttctaccaccattctgatcacaaccacttagtctaagaagtttcagactttccctacagatcttctaatcccgctttattgcctgcctgcctccctccctcccttccttctttcctctctgctctctctctcttttcttcctttccctcccctcccctgctttcctctcccctctccacttcttggcaccaattttctgtcttagtccattttgtgctgctgtaacagaataccacagattgagtatattataatgaatagaattttatttggctcatggttctggaggctgggaagtccaagatcaaggggctgctctggcaagggccttcttgctgcatcatcccatggtggagagtggaatggcaagacagatcaagaggggacctaactggccttttataaggaacccagttccacagtaatggcattaacccatccatgagagcagagccccatgatctaaacaccttttattaggccctgcttatactgttgcactggggatcaagttgcagcacttggacttcgggcaacacattcaaaccatagcaggcaccttaataaaggtggaaaagggatgtggcagctacagtgggagggaaaaggtggctcccttagtgtgcttgggaggagggtaagagatgcgtttgcagttctcatggccgcagactgaaggggcctggttacctaagggaccttggcttcatgtaaggagtgcggagtgagtgaagcaagagggtgatttgatccatatcatttcttagaaggataccatgttggcagtttcgaagaaggggcatgagtgaggaaacagttgtggtgaagagaccagttaggaagcctgtaacttggggtgggatctggaaccaggctgtggctccggaagaggagctggagggctgcactgtgaagtatttctcagagtctagacaatgtgaccttcacactggggctgagttttgtaaaatccgacatccccagtttcacctatgatgccaggcctgtggtaaggagctttgcaagcatttgctagaatatgagcaaatggaggtagaactgataatatttagtaaccatggggggatgaaagagggaggtgttgggagactgggttgataatatgggggttgggagtgaggagagagtccagctttgaacatcttcttccatttgaggaatttaagatcatccagctagaaaattagaaatactaggatggagtgtggaagagaaattagtgctgaaaataaagagctcgaatcatcagtgtatgaatagtagttaaacctctgaaaatgagtgaacttgtcccctgaaaatgtgtggcaggggagaagcgaggttcaaggacagtgcccccgagaatgccagcatttaaagggtggaccctcggtggctcacgcctgtaatcccagcactttgggaggctgaggtgggcggatcgcttgaggtcaggagtttgaaaccagcttggccaacatggtgaaaccccgtctctactaaacatacaaaaattagccaggcatggtggtgggtgcctgtatcccagctactagggaggcacaagaatcacttgaacctacaaggcagaggttccagtgggttcgtgccacttcactccagcctgggtgacagagggagactccctctcagaaaaaaaaaaagaagaagaagaaaaaaaaaaaggtgggccccggcagcagagcctactgtcccggaggcaggaggaaaacctgaagggaatcttgaccttgacctagaagccaaggaggaggcatggccaacaacatcaaaggcctctgagcagcgcagtgaagactgacaatagacctttcttaagtttggcaattagaaggtcattggcctcagcaagagcaatttcagaataaaaacaagagtggagggagtggcataggggtcgggggacagagtaggaagtgagggtgtagtagaggggaagaagtttgatcactgagggaaggagggagatgcaggggtagcttgaggaggagatagagcagagagaggtttgctgtttattttaggaagaggagacttgagcatgtttataagtcagagaatagagaaggagaggtgggagacacagggaaaagaggagtcattgattgggaactattctgggaaggtgaggtggatctggtgtctaggtggaaggatttgggggaaagaggggaggtaggagagtctagacgtagacagcaggcagacaggggctccaggttttccctacagaactgaggacagtgatggccgagcgtggtggctcatgcctgcaatcccagcactttgggatgccaaggtaggtggatcacttgaggccaggagttggacaccagcatgggcaacatggagaaaccccatctctactaaaaatacaaaaattagccgggcatggtgacacatgcctgtagtcccagctactcaggaggctgaggcacgagaatcatttgaacctgggaggtggaggttgccgtaagctgatggcaccactgcactttagcctgggcgatagagcaagactgtctgaaaaaaaaaaaaaaaaaagaagaagaagaagaactgaggacagtaagagtaagtggtcgcttgtgatcacagaaccagcaagtaaaccgcgagcttctgcccctctggtcttcccagaccccttccccggaacattaagccatatcgcttttatgggtccaggggctctgaggggctgggcatcatactgtgcccctgggggcatatctagttctgccccacttggttgggcgggtacctgctgagtactcactgtgtgttaggctgtgaatgctggggcagcaggaggcatggtttctgcctccactgggccttatttcttcaccttgtcccccagttctgcccttgggtaagttctgtggcagaactgaccagctcccttcggccagggacatcttggttcctggcagagcaccaagaagagcagattgtcttcctacccgggggcacctttgcccagcaggtcgggtgagctggcctcttggtgagaggctggtccccttggacatgagtggattcgatgcctgctttcccacccaggtactctactgtggctttgctcctgccctttatgctcagagctagaccagcaatgtgggggagctgctggggaaaggcgccatgttgtcttgaggtagcagccagccccggaagccctggaatgcctggggccactgagcaatcctcaccctcagccccacaaggggagggcgtggctcgtgaaattcctgattgggtatagcccagcaagccccaagactcgcccagtttgcttagcgcaacactgacgctgttttggaatgaagacaagacaatgtagaactttactggggaagaggtcgaagaagggctaattgtcttgttgttcaagactggttagcgctgctcacctctgacgctgctcacctctgacgccaaaggtttttccctggaaggcagccctggaggatacctgtgtatctgtctttcacaaaaggtgaaatgagctctttgtagtgtttcccgcccaggctgcattttagaatcacagaggaggtacggcgctgatttgttttactattccctattcatgcctgggccccacccctaaccaattaaataaacatctcggagagtggggcctagactttatatgtttaagctcctcaggtcattgcattgtgcagccaatgctgtgacctatgaatacaaaggaagatgaaacgcaccctggtcatgcaaggaagatggagagagggagcagggagggtgagagaggctgcagttcgtaaggtcctgaaatgttagagctggagggatcctggttcggagcactgcaactcaaaagagtagttctagccatgcagcaggccccattagggagctggttagaatgcaaatccccgcctgccctgcaccccatctggcaccctctgagtcacggcgtgcacatcgaggtttgagaagtgtgctttcaggtcacccacagatcatccagaccagtggttctcaaccttggctgcactttagaatcacccagcgggcttcagcgaattccagtgctgggctagatgaattaacccagaatttctaggtgttgggacccaaatactcatttaaaaaattttttttgtttaagtacttcaggtgagtctcttcttcagccataatcaagaatatcaggcttgaccagtgcttctcaaacttggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcaaggaaactgcaggtcagagagggaggtgtgatcgtccacggtaaccaacctgatatgcattcagtactttctgatgtactctactgtgtgccaagcagcatgctacatgtgggactagagctgcgaacaggacagacccaattccaaccctcacagagcttatatcccaactggggagacagacagaaagaaaacaagtaactaagctgatgacagatgggaaaagctatgaaggcgaggagggccatgtgtagggaacgactcagagattgctgtggggtgaggggtaggtaaggcacgcccctttcagaagagctgtcgggggagttactaggacaatacctttaactggggactcctgctgattacaaactgatcacttttctttactggacaggactaggcttcatcccctctggggtttggggatggtgcttctgactctcctgaggcagtctgaccctggtccctgcctggctgtctcctctgactcaagactctgatccttcagtgtttgtgggttcagagcagagcctgggaatgagcccgctggggagcaggacactgactccaccataggacagggctcaggatcattggttaatggtttgtaaaatggaccaggcctcatccagatgctgtccccagcccctatgaaaacatggaaagtttccactggtgcacaaacactagtgcttgcctccctttcctgatcaaccgtcggactcacatgggctgtttgtgaaaatgcctgtcccaggccatactcaggctgaccaaggtggtctggtctccagggaagggccgtgaaatgtatttttaggaagtggtccaaaggactcttctgatccagatcatcaggaagcatggcgtggatggaagaaactggcacttggcatctggtgcctctgtgtggctgtagaagctacagaaatgtcttctgcagtgactgcagcgtggccctggctgagctggtgcttgtgaggaagcctctgcttgtgtgcaggggtgaacagcagctcaccccttcccatgcacagtcctcaccttactaccttcacccttactggaagcatctcttgacttctctttggccagccagaccctcccagctccctgtgctccccatttaaacaccttccctccctgagcttagcccatggctgggtggggaggcgtgagcactgtttgcatttggtcagggcctagaagggatcaaggaggcctcatgaggaccatgtcatagccccaccctcactccccacccctgacctgagcaaacctgtttggctggattgatgatggagaggcaggcagtgaccagaccaagagacgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggaccctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagctgaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaaggcagccagcgctctgaggagcagtggagggagggcaggcagccttcagaatgctatctgtcacatcagtccctccgcctggtactttttgtagaggatctgctcctccgggtgctagccatcaccagctcctccatccccaagaacatccagaggtaaggcggcactccgactccagtctgggcaccttctcctatttcctgccccctgcccgctccccccactccccacccccccgctctgtgaaacagtcatggactggtaccatcccagccaattctcatggtagcctagcctgggcatctgggtgcagagtgggcagaggctgctcgagggtattgcaacagtggggcaggcgtttctcattgatacacccccccatgccttccctccactcctctgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtacgatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaaaactttagtcccttctacctgtgtggatgttcttggaagtggtccatggtttagaccctccactctatacacctggtcacctggcctcccgagggggtgcctttcctcctctctttccctggtcctctcctggtctcccatctgtggcacagacttcacctccctttcctctcaccttgtgctcctgaaggcctctgccatcgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcactagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcgcacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggtaagtgcctggcttgtgagcatggtgggccagggcgtggacgggcagacagtcagaggggcactgggtgagtgggagcagtgctgagacccagaggtggctcccgcagtcagaactggaaccgaggcacctggactccctggccagcatcctccatgttcagccacatgggctttgtcttccttccaagagccagcctggggaagggagctcccaagaagtgtggggccattgggaggggcagggagactttcctggggacagagaggtccctgggagtccctcagtttatttccttggctgtctccacaggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagca

SEQ ID NO: 1002 - DNA, 58748 bp, Homo sapiens
gagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggagttgtcagtgggaggccggctgtgcccagggtcctagggccacgttatgggggtcgtcaggcctaggccactgtgcctcagggctgcatgggtggtgagcagtgggagggatgcgatggggggagtgggctcagctgtctgctgtgggtgtttcctcggggacctggctggcagggacctcccggccagcccagaactgccaacatgtctgccagcactgcccctccattcccagtcctggggggaggctctgtctgggcagcttgaggcctgacctactgtggctgcttcctctgctccccagcctgggtcctgagggcctggcttaagggaactgctgccagaaggctgggagtgtaggcagtgttcgggtgcccagctgtgccctgtctgacctcatggccacccacaagctggcaccccccacaggcctcttggggaagcctgtactttccaccgccggaggcgggtaccgcgtggaagccaggctcaggcggactcattctttttgaactttgggaacaggcctggtacaggctgagttctcacaagagacacacacccgtgtcactgtctcctgagctgtgccggacccgtcctacagactccacctcctctaggtcctggccctggcatctgccagggggattttaaatgagttgatatatgctaagtgctttgaaaggcgcctgcacggagggagagctgtataaatattcactattggtaatatttctcccatgctgttactctccaaagctgcccgataattctagagtgggttccggggacgtgcccgctgtttggggcctagaaatgaactcgggaggttgttttgcttgctgagagctggtctgggaatgccccttgaccgttccctgccctgctcctggcccactcccagactgctcctgtgcctggccccattgcgctgggtgggtgatcctaagctgccccatgggccctgggctctgtcaagacatggggagcttgccaggagttggggccagatcccccagactccaagatggtaaccgaggttgtgagggtgcacatggaaggaagagttagaagagtgaattggaaattgccagcttggactttgggcagagtgggtgtctttagcttggggatgggttgttgttcagagacaacagggccgccttctctgtgagctggcggcccaggctgaggtgcctctgggctgccttccctacgggaagcagtgactggccctctgcttctcaggaagagagtgccgtgcccccgccagcctcccaacctcgttagactcctagaatccggttttctggatagaactaagaatctgctcctttctggacttttaatcctggaaagggctcccttccccagcaggagcagagagaccaaaccccctttctgtgctccatcttgagctgtcattctgtcctaactccccactggccaccatctgcccttgctttgggggctaccccaggtctgacttgggcacgttctctgggtctctcctcagagaggctgctcctggggttgtcccaatggaattgggaattcttctcagaatggctcaaaggtttgcaccatctgttggagggaagggatccctctatcttggactaatacaaatgtttccgtgcctgccaagttccagaccctgggccgatagggaaaggagctggctggggggcctgcaggggatggagagggagcttgggccccaagtggggtctgaagtccaagcctacagattgccatcaaggcagccgctagagcctagcccagctcctggcccctcggagatggaccttagatgctggagagcggggcagtccagcagtgcagggtgggacaccccgagcaaacagcccctgcttcctgccccctcagttcagtcgcactgggccggctggacgtttccctgcaacaggcccctgctggtggtttagctcccgctccgtgtttccctcacgctgggatcctccttcctactcaagacccacgaccttgacctgaagcttttggttgccgggaggaaatggtgagtgtaggcagatttgggtgactcttgttattaaccccctcttctttgttgcccccttcccagaggcttctgtatgagtgtcctgagtggccctggatggactactggctgtccctggcctcagaatcaccccaacccctgccacatttcggggagggaggtgtgtgaatgatgtcctttattctacagactgaggaagtggtcagtgtagcttcacgtgagagcagcagcgtgcgatgcccaggccctagccaagtgctggtcagctttctgactggagcccctgagccctgcaggggctgaattcccccaaaggttgcttgggttgttgcatttcggggttagagggtgtgggtgtccagagctgtgggtttttagtgttggctgagccctttacctgggacctacagcctggccacaaccccatctctgttcccctgtaccccacactgccctgtgataggatgtgataagatggtaggattgcctatactgaagccctgggtgccactgctggcccagcagggaggaggttgctgctgctcgggctgaagtgaggtgtgggtctggctgggcctccagtttcccacctgggccttgattgtgaggaaggcctggcctggctgcagaagcccagaagcacctgagtaggagagttcctttgtcccacctgcagctcattcaagcctgtgcatgggggttggggtcctcaggatcttgctttcctgtttaggggaggcagccccaaagagtgctgggaccagtttggagagtgctaaggaatgctggtctgcagcgaccctacttgtgctctgcgtcctctgccaactgcagcatgggtgaacatctgtacatctgtccccataatgaaaatggcctcagcaaataacaaaaatattaccatttagcaatcaggcacttattaaaagcctggcccaataaacttaaaaaaaaaaaaaagatgtgctagacactttacgtcccttcatgtgagcttcacacaaccctgtaattaagcccatttataaatgaagaaatggaggattgaaggattaagttacttggccaaggtcatacagctcgtaagcagctgagctaggactcaaatccaggcttgcttccaaaaccttcacttttcagcccagttctcaactgccccctggagtttgctcattttgccccatgaagaaacagatcccagctcaaaggcgtgaaggggtttgctcaaggccacagtgtattagtgtcaaaggtggaacacaaaccctgacctctgagtgctctcccgaaccccacatcccggccgggccgtaccctgagcacacgcttgtccgctttctcagctgggcggggcggggcaggacaaggttcttctccctccctccttccctccttccctccttccctccttccccgtgggccctcccagcctccccagcccccacctctgctgctttcccttggcaattgcttccatctggcctgcctgcagctcctattcctttggaaatgtggctgccgcccacatggctgcaaggcaaccacggccacacgtggggaaggggaggggccctatggggtctaagcacagggaacccagccaaagtggctgctcctggcgtctggcatcctgattcctgccaggcagaagcaccttggctgcctggccctccttgatgcccgtcctgggctggctcaaggccagagaggctcccaaagacccaattctccttccaacatggtgagctgttttgcccacagacaagctccgcaccggcagccctccctgtctcttagaggttgctcaggttgggaggagggattcctggcaggagagaattaggggccagccggggtataccctgggttcccactgggttctgatcatttggagggaagtcatgcaagggactgacgagggcagaggctgagggatccgcggagttctgggcaggcgaggaggcagctgacttgctcatgactgtgggtatgcgccaccacactaggctaatttttctattttttgtagatacagggttttgccatgttgcccaggctggtttttgtttgtttgttttgttttgtttttgagacagagttttgctcttgtttcctaggctggagtgcagtggcgcgatctcggctaactgcaacctccatcttctggtttcaagttattctcctgcctcagcctcctgagtagctgagattacaggcacccgccaccacgcctggctaatttttgtacttttagtagagacagggtttcatcatgttggccaggctggtctcgaactcctgaccttgtgatccgcccacctcagcctcccaaagtgctgggattacaggcgtgagccaccgtgcccagccgagcgtgtctgtcttgttcactggtgtattttcttaatgcctggaatgatgtctagcaaacaataagcactcaatagattcttgtgtgatgagtgatggaaatgcagctcaggtatgctgatttgtctttgctgcatctttactttgcttcctcctcccagggcaaagggaaaaagtttcccttttgccagttgagctgtttgccagagaaaggtctggccccatctgtgtgctgccaccttgggggtctctgttcagacctcagagaggcaggcaggaacccaggtgaggatgggcaggagcttgtcccctgaggagtgcatgccccattccacccaccacagggtcggctggccacatttctctacccatcacccctccctagtaaccttcaggtccctgcagacaggtcctgacctcagctccaatccctatgtcagtcctctccttatttgaggcccaagaaaggtacccctacggtggaaccctcacttgggtcctgagagggagtgacagctttggaagagcgaggggttcacccacatttgcctcctcctgaacagctccacttttattccttgtacatattgcgtttccacttcaatttttttttgaaactgtgacagagggtttcttggctttaatttttttttttttttgaaaacccccattgagttccagttgtgacccccctgtggttctcattttctggtagcatgccgtgtggggtctcacctcctcgcctttgcttctgctgccccctcacatggcttgggcattgttggtaatgaccttgctagactgcaaatgtccttcagtatcaactgaagccccagtcctgggaagcctccgtggccacccagcaccggcacttcctcccccttcctccccctgcgttctccactccctgcaggtcctatgcctgtgacagggagggaaccctgtgctggggtgaccccagcatggacctcagtggggctcaggctgaaccaaaggtaggtggttctgggggtagtgcctgaggtggttgtatggagctgtgagatttgtattcctagaagcaggttggaggctctcagcccttccctccatgcatggccttggatacagcttgcagcctgccactgtagcctccatttccttctccgagaaattaacacttctttttttttttttttgagatggagtctggctctattgcccaggctggagtgcagtggtgcgatctcggctcactgccatctctgcctcctgggttcaagtgattctcctgcctcagcctcccaagtagctgggatcacaggtgtgtgccactactcctggctaatttttgtacttttagtagaaatggggtttcaccgtgttggccaggctggtctcaaactcctgacctcaggtaatctgcccacctgagcctcccagagtgccaggattacaggagtgagccaccgtgtctggccaacatttcttccttttttttttttttttttttttaagacggagtctcactctgttgcccaggctggagtgcagtggcacaatctcagctcactgcaacctctgcctcccgggttcaagcgagattctcctacctcagcctcccgagtagctgggattataggtgcccaccatcacacccggctaatttttgtatttttagtagagatgggggtctcaccatgttggccaagctggtctcgaactcctgacctcaaatgatccacctgcctcggcctcccaaagtgttgggattataggtgtgaactaccgtgctccgcctggccaacacttcttaatgggataatgtttcagataacatccagtgcccggactccagcactctataaatgctggctggtgtgcttttctgggattccagggtggggtccagagactgaagagggtctgctttctggcccaggggaagaggggcaggtggctcactaggagctgtcctggcatcctttgtccccgtccacttaccagttatgtgacctcgggcaggtcttgcactctggcactcaattagcatctgtgttaattggggtaagagtatctgccacgtctcacagcctggtgatggacaaacaaaacaaacattttttaggctgggagaggcctcagaggttggctgtcatattgcaaacgagggagcagagactcagaaaagtaacttagttgtttaaggtcacagagcacctctctccccacaggcagggagccggtaattgggctgagcctcaggagtaacccttctctctctgcctctccagcccctaccttatgcctggcccattcagctggtctgttctccaggcccctaggactgggtgggctaagatgagtggtctagaaatccctccccagctgggctggactgaatgaggggctggccgaggagcgggtgttgatggagtatgggagattgtcctcacaggcagtgtgggccgtttctctagacctcctgcccccatctccttcctgtccctgtttgagccgtgctcttcttcttcaatccctttctgtctgccttctctttccacccctagatttctcaccatcttcagtgatccctcctccttcctttctgcctcctctgcattctctccttgcccttgcttctctgatctgccttttttctccagcctcagcattcaggttgtcctcatagtggaactgggactctgggggtggctgggttgggttgcctggaggccgggaatgttcaggagagccttcattgggagcccatgggagcaggagtcagctcctcctgttggcagctccagcattttcgaacaaaaatggctcttccaggagttgagtttggcgaagagacagtgcctgcccaaagtatgcaatgcttttatctttagctcagctcctgagccctcatgcaactctttggacatcttcctgcaaaggacggtgggatcttgtctttctggggcctcagggtctccaaagatgggctgactaagcttccctagcctgggacctgaaccctccaccctcctctctcttgagctctttctcccaggggaagctgctcgaatgaggggagttggccaacacagttttctactctcagaccccattgaggtgagcacacaacagtgttctgtgtgagggtctggatacactccccaccctcccaggcccggcaccgtgtcgccctgccccagcccagagcttgcctctgttggctttgtgaccctcgctttgtactgtggctttgttctgccttagggaccagctggtcccctgctgtggttccacacagtggagactgatccctgaccactcattcagctgcctggcggccctggggcaagtgtttgtcccccatctcccaaaatggcggggtgcaggggctccctgcccggagtcccaaccctgccaaggcagagggaatggggaacagctgcgctggcccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtgttgggctggatgtgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctctcagcccactcatccagggatgcagctctggccttggcccacccccatcagagggcctgtggccctgatcaccgcactccccactctgtgaccagacgttctctcctgagcatcgctgaccctgcagctgtccaaatagagcaagaagtgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcatggtgttggggcctcacagatgatggagaagccagagttcaggcacttggcatgacccctggcatcgccttcagttgatttagtgtctctgccctgggatattccatgggaccctgggctggcttctgtgtgcagaggtgggtgtgggccatagcccagacctgttgaaccagttgtaggctctggaatcctctgtccccaggtagtgaccaggccctgacaggccggtatctgtccctcccatcaccctcccagttatgggtgcagatgaccctgaaattgctaaagcctcagggcttgagcccagaaagtgtgagcaggctggtggggcagctggaggaaggccttgcaggttcctggatttgggtgccgggtgggctgagaggacagtccctgtcactgggactgggcacaggtgcagagaggctgagacgggcccagaggacagtgagtgtgtgttgtgtgggcgccgggccaggaagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctccgggctgcctggtgatagctcccagggacctgcaagctgacaaacaaagtctatacgagccagagctggggtgggaggaacccagtgggcctgggggaggtaaagcagcagcagctgctgtagctgagcccggcccacggccagccctgaggaatggaggaagagagtgccctggctgggggagcccctcaagccctggaagctgtatgtgggcatggggtggtgggggcgtgcagagaggaggaggactgagagctgggtgtgtgtgtgcgcatgcctgtgtctgtgtgatctggttcccgggtgtctgagtagggaccaatgtgtttgtgctggagaagcctgtgtaggttactgacatggggaggggtggggcttgctttcctcaccccgcttcccacgtcttcattgagtcctcatctgggggccctgttccactctccttcccgtgtgcagggccctcccctctggcgagtctgcctctcactcgctcagcccctttaaccctgctggctcctaatgagacttcaggtgtggaccctcgaaccctcagctgcacaggtctggaaacatccttgttcatcaagcaccaggctgaccatggtgtccgtctcagtgcccagcagatgttctggtgaggggaggcgggagtgcaaggtctgccgagtgagggttccttccgggaggaggcagggtgagcgcagaaaccactgctccaaaactcttaaaagcagagccgagagcctgaattcagaggctgtactgtggggcagggctggaatttgtggcacctgcagggctgaacgttgcctttgctgtccctgcttggggattttggggtactgggtttggatagagtgtgtcatctgcagagggagcactgttctggaagtggactctgctcaggtgtggggggcctgcctgtagggggcaccgtggtggagatggagcaccgctcatgacaggaggctggtgtctggtcaggctgagggatccgtgtgccagcccttctgggaaggctgaatggggcggaactggtcagggcctggcaccaactccaggaggtgctacacccagacagacagatggaaagccacctccctagaggcctcctccccctccccttctgcatgccaccacaccccagcagcgtctcctgaggctgggccatgggtgaatctgagtcgagggcagggcagagtgggagtggcagtgcctctgcctgtctccctggccgtggcaggtcctttgtcacgtatggaccaggagaggtgagtatgattgtggtagtggtgggggcagtggctgaggacccctctctttgctgggctggggcagagcttgaatggagaggggctgccttgtgcctgggaagggaggaccaggtgtcgctggtaccttccaggtcctgaatgcttgttctgtgcctagcccctgctgaggctgcggacgttacaaaccaggatgtgttttgaggctcaggacacctctgaggacttgctgctgttacccccatttaaaagacgaggactctgaagatctgaggtgcatagagtgtagggattaaaagtagttctggctgaattttaaatcctggttccaccatttttgagctctctgatcttgggacccttaatgtatttgctctgtgcctcagtttccccatctgtaaatgagaatgaaagagtaatcccacatccattggttgaaaacttcaataagattatgcatagcaggccgggtgtggtggctcacaccagtaatcccagcactttgggaggccaaggcaggtggatcacttgaggtcaggattttgagaccagcctggtcaacatggtgaaaccccatctctactaaaagtacaacaattagctggacataatggcgcgcgcctgtgatcccagctacttgggaggctgagcaggagaatcctttgaattcaggaggtggaggttgcagtgagccaagatcacgccactgaactccagtctggaccacagagtgagactgtctcacaaaaaaaaaaaaaaagattatgcacagcacctgcagcacagccccagggatgatttttaaaagtgaatccagggccaggtgtggtggctcatgcctgtaatcccagcacttggggaggctgagacaggattacctgacatcaggagtcagtgaccagcctggccaatatggtgaaaccccatctctactaaaaagaaatcccagattctgccatgccacagtgtccaagtcagtcacctgctcgcagtcggccctcaggccctgtggctcctgtttctgctgacttgtccagcctcacagtctggggaggccttggggtccccagcctgcgctgggacaggggtattattccgtcagcccttctgtggaacaagtagggaaggagtgatgtgacctccgtggctctcctgggacacaggttagtcctgtgggtgacctcactttagagagggctggccagctgtgccggaattaggaagtgggtacagctggacaaaaggtggctggagccagctctacagaagccacacctgctcatgagaagggtatccttgtgagtacaggggaaatggcatggagaaagacaaacactggtgggtggctctgccagcttcccctggggtgcttctggcgatgcccaggcctttgcacgctcagatctttgcaccccactgttttaacttggagaggagaggaggaagttagctgctctgaatggtgttgctgctaatctctacagcactttcctgtaaattaggaacggtaacacacacacccctcccccaccccgttggagaagccctgcaccagagcatacagtttggcaagtagggggagggctggagcccagcctcacttgccaccctggccaggccgtgattgcccagggtgcatactgtggctggtgctctgccacctgctgtttctgtcctcagggtaggacacaaggagggcaagtagggctagtcagtgagaggcacaggtgatgcgtgttctagggcttgagatcagctgcttccatttcagtaattgtctttggaggtacgttgtttgctcaagcaacctcccttcaagatagtgcctttttctttctctctctctcttttttttgggggggggaggcagagttttactcttgtcgcccaggctggagcacagtggtgtgatctcggctcactgcaacctcggcctcctggattcaagcgattctcatgcctcagcctcccgagtagctgggattacacgtgtgtgccaccacgccctgctaatttttgtatttttagtaaagatagggtttccccatgttggccaggctggtctcgatctcctgacctcaggtgatccgctcgcctggcctcccaaagtgctgggactataggcatgagccaccgtgctggctgatagtgccattttttaaaatccctatttacccagtggaaaacctgagacccggaaaggtcattcacactcccagaagtgatggttggtccagaattcaggtccaagtgtgagacttcaacatttacattccttattttttcttcttccttttttttattttaatcaaattattacttcaaaatgtatcacactcatcagtttgaaacagttaagcagtacaaatgggaatatgagagaaagtcactctcccacccgccctcttgagaggcaatagccttgttttgcatccttctgagtactctattcacataagatgtatctgaatatgcatgtaattcttttgtgaaagtgcatttggagatcactgttttacacctgccttttacatcttaatattatgctttggagatcagttgacatcagcatgcatcgatttgcatcctatttttcacagctgcatagtgtttcgttgtgtgtgcctaattttttaaaacaggtgcctgtgcatagatttcatgtttccatcttatgctgttagaaaaagtgctgcagtaaagatcctaacagacaagtctctttgcaaatataggaaacttttctgtggaataagcttctggcacggaagccccggggtaaagggtattttgataaatattgtgaaatgtcttcccagaaggtggcctggttttcacttccagcatacatctgtgagaggtcctgcttcccacactcccccagcactgtgtagctcaggacccttgttttttgctgttactatttgtgaaaaatggtatctcaaccacaccggaagttttaaatgtagataaatgtcttatgtgccatttatatttctctacagtaaagtatatattcatagccttagcttatttttaaattatgttccttcattgtttggggagtggggggtagacttgcatgagtatgttataggctaagggaattaactgataagttaatatatgtacatcttgcaaatgcacttcttagttttttactcttttaagtatgagcttgctcacttgctctctgtatctcacttaaactttatgtgagtgtattaatctttcattatttagcttctgaatttatatttcttcaatctccattcctttttttttttttccttgaaatggagactcgctctgtcacccaggctggagtgcagtggcacgatctcggctcactgcaacctctgcatcccgggttcaagcaattctcctgcctcagcctcccgatttgctgggactacagacatgtgccaccacgctcggctaatttttgtattttttagtagagaccattttggtcaggcaggtctcgagctcctgaactcaatcaatctacctgccttggcctcccaaagtgctgggattactggtgtgaaccactgtgcctggccctcgttcttttttttatatgaaaatatttcaaatatgtaaaaattaatataacagacctccatgtgataatcagccagatttatcaagtgtgaaccttatcccatattagatattttttcctttaagaaataaaatattacaagtatagaactaaagatgtgctactatgatctattctattcttccccacattcctttttttttttttttttttgagatggagtctcactctgttgcccaggctggagtgcagtggcgcgatctcggctcactgcaatctctgcctcccagatccaagtgattttcctgcctcagcctcctgaatagctgggattacagacgcacgccatcacgcctgtctaatttttgtatttttagtagagacggggtttcaccatgttggccaggctggtctcaaactcctgacctcatgatccgcccaccgtggcctcccaaagtgctgggattataggcgtgagccaccgcgcctggcctattctttcatcatacacataagcacgcactatttacaaatatacacaaacttagtgctgttttctgattcatcctttatctatttgcaacactttaaaaagttaatgttatgttttcacattgatcccagttgacctgtatggattaatttcttcagttgacatggctatataatattcagttgcgtgaatgtagcacagcttatgtagccatccctctcctgacgatagttaagttgtttccattttttgctattgtaacactgctaataaacatgcttgaatggggtgtcccgtacaagggagggttactcggggctgtgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgtgtctatgagtttgactgcttttgagtacctcctataagtggaatgatacagtatttgtccttttgtaactggcttatttcactttgcatagtgtcttcaaggttgatccatgttgcagtgtatgtcagaatttctttttttcttttcttttcttttctttttttttttttctgagacagagtttcgctcttgctgcccaggctggagtgtaatggcgcgatctcagctcaccacaacctctgcctcctgggttcaagcgattctcctgcctcagcttcccgagtagctgggattacacgcatgcaccaccacacccggctaattttgtattttcagtagatacagggtgtctccatgttggtcaggctggtctcgaactcccaacctcaggtgatctgcgtgcctcgacctcccaatgtgctgggattaaaggtgtgagccattcacccggccgtctttggattttatacagcaaaactccataatatttcctttacatgaatttcctttctttttcaggctgaataatattccattgtacgcatagatcacattttgttcattcatccattgatggatacttgggttgcttcccgattagctattgtgaataatgctgctatgaacatgggtgtacaaatatcgctttgatattctggtttcagttctttggggtatataccccgaagcacagttgtgggatcctatcttgtctcttgttttctctttgcttccatgttttttctcattgtttcgtgggaatactgatattatatattcaagtatttgttgattacatgcactgtacctgacttgtttaaagcctgatgtcttgagtactgtgcacccctgtgcctggctgagtagtggaggaactttgaaagggtctgttctggagagggggtgctgctctggagaggcggtgctgctttggagatggattaatcaggaacttgggtgctgattctaggaggtactgcatctagaaagatgggaggtggggagtgcaacttccccaattttgcctttaacttcagatccttggggtgggtgcattgcttctcctgggatggaggggtgccggggagcccctgaccaggacctggagcaggtccacacaggcactggatttgtcctttactttgggcccaggctgcactcttgattccacctcctcacactggcttcagctttctcaccctcagaatggaattcaaagcctctgcccctcccaggcagacaccaaggtatgattttcaagtggttggtgtcttgtgactggcagctgataaacgggtgatacagtgtttctatacaggagtctgcagtgccaggctgcaggggcggacgggagggggtcgtggtgggtagcctgtggagcctgagggtgggaacagagagacttcttttgctgtaggtggaagcctgtctggctcctttccctcaaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctgcagcgtccagccagggactgtgccgcaggggccagaagatatctgacctactgtcactgcctcttccactctgttccacctgcactggagcgatgctatccgatgaacagatccatttattaattcaacacgtttgtattgagagcctgctgggtgccgggcactattgtcaacatgggtaatacagcagcaagcaaaacaagagaaacatctttgcaagcaggggagggggcctgcagtgttgggtgtgtggagttgttgctgggaagtagagaagctgagtaagagctggacaaagaggccaggcacagtggctcacccctgtaatcccagcactttgggaggccgagtttggcagatcacttgaggtcaggagttcgagaccagcctggacaacatggggaaaccccgttcctactaaaaatacaaaaattagctgggtatggtggtgcatgcctgaaatcccagctacttgggaggctgaggcacgagaattgcttgaacccgggaggtggaggttacagtgagccaagatcacacaccattgtaccccagcctgaatgacaaagcaagactttgtctccaaaaaaaaaaaaaaaaaaaaaaaatagagaaaaggaaagctggatgaagagagatagccaagcccatgtctacggaaaagcattcttgactgagtgaacgaaagtacaaagcctcagaggagggagcatgcctaggtagccccctagacctggtgaggctggtgcgtggggcagcctccatggagaggagttgggcaaggagggaggaggtgctggccagtagagcacgtgtgtctctgtgcgtcagagcaaggacccgggctctccccgtaagtgagaagagtccatggaggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaagttcggcagggaagccagaggagtccgcagcccgggagacctggcctacagcggagagagtcagtccatgccagtggtgggatgtggctgcaaaaaatggtcggattcatggaagtctggtgtccatctggcaggcgttagtggtcccacgaatacagctgtgtgccttgaacacatactgcagagcttccagagagcaccagggctgtgggggctagagactgtgtctcgtgcggaagcgtggctgaggaggggcttgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtgggggttctggctgaagtagccagaattccagtgccagctccgctcctcacgagctgtacaacctgggccggttactgacccctttcccaccttagttccctggctctacaatggaggtaattatcgtgttgaactcacagggtcgagatcatatttaatacttgcacagcccttagaagcatctagcacagtggtcctcagcatttggaaatgtctggaaacattctgtcacacctggggagtgggatttccttctggtgtctagtgggtagaggccagagatgctgctaagcgtcccacaatacacaggacagaccccgcaacaatgaactgtctggcccccaaagttagtggggcagagattgcaggatcctgattccttttcttccttttttttttttttttttttgcccctggctatgagtaagagatcctggtttcgcacaaagtgaacgtgcagtacattgtttcagttgttaattcgccatgcaatacatcgttagtcacgtattattgtttgtcaaatgtgtataaaacatctgccacattcttggcagtttaatagaatctagagatataaagaagttcctgaccacagagttcatagcctcacaggcaagataggaaaacacagaattatataatacgaaattacattatatcatagagcatattctatagtaagttactccgattggcttttggtattaaaatgtcttcagtttcagaggtcccaggatagtgggcaatatttgaaagccagtaaatataaaataaaatatattacctgtgtgaaagagaatttttcaggcacaataatattttaaagagtttatttgtgtaagaagtgaattgggaaacagaaaaccgaaagaggtttagtggcccaatgacagtttcagaggcaggtgtttggagagtgaatgtaaaagcaaaatgaagaatttatttgatttaattggttgcaattacaaaattgctttgtttggtttaccttgttggaagtttcctagtcacataaccatatgttagttggctacttatgattggctgaagttttatttgtgtcaaacagaagcatttaccataaataaccccagttaagatttgattatgctgtcttttaagcaaggttaaggctgttgttaaggcctcattggttttgtttggtaaggaatttttcaggcctggtctccaaattttgctttaacaattccttgcttctggttattctctcagcaagctgatagtgtgactagatgacacagtattactctctgttaccaccaccaatgtagtcactgggacaaagagtcaggtagatgttgttgtcatcatcagtaggtaggttggggatgagaattccatggccacagttagcagttacatagtcagtgttgctttcctcaagttgaatgatcctcatggtaactgtttgatatttgagcagctgttggaaatcatttagaacccttgagagaatacaaggcaccaggggggtaaacataataattataaggagaataatagccaaggattgaaaaattcctctgagcaaagattcccaggagccaagacttaaccagctgagtgaatcaatggagaaggcagtgcccatctaatgaaaaacccatgtgtgttctttaaggtattttaagttttcggtaatacctgatttgttaacataaaaatgacactttttttttttgagatcgagtcttactctgtcgcccaggctggagtgtagtggcgcaatctcagctcactgtaaactccacctcccaggttcaagtgattctcctgcctcaacctcctgagtagctgggactacaggtgtgtaccaccacacccagctaatttttgtgtttttagtagagatgggatttcaccatgttggccatgctggtcttgaactcctgacctcaggtgatccacctgcctcagcctcccaaagtgctgggattacaggtgtgagccaccgtgcctggccaacaccttctttttttttttttttttttgagatacagtctcactctgtcttgcccaggctggagtgtgcagtggtgtgatcttggctcactgcagcctctacctcctgggttcaagtgattctcctgtctcagcctcctgagtagctgggaatacaggcgtgtgccaccacacccggctaattttgtatttttagtagagacagggtttcacccaggctggtctcagactcttgacctcaggtgatccacctctctcagcctcccaaagtgctgggattataggcgtgagccatgcgctcggccagcaacacctttctaccaattagggaacaaggtctccctttttgagcagttaaagtagcaagaagtcttctattgtacagtactactgaggccaattcattcatcccagattgtactgcttaagataattcgaagtgtcaattaaactttttcagaagttggtaaaatattaattgatttttttcaattcactcaactgagagaaacgggctcttacagaagtatgaaatccagaaccccttcgtaagactgtgtctgggatattatgattctcttttgtgaggggtcactttatgtacaaatgactctaaggatttgtatggcaattgaagagtcatatctagtcattttaggtagaagatagcccacaccacagatccagactggctaggtagaacacctttacatactttgttgctgcataaaatgaataattcggtgttatcgatagaaagggtcaaagtgcatcctattacccacgagttgggggtgatacgaatgtcatggttattctccgtcacatctgcgtctgcacagcgccacgttgaatggttatggtttcaattggagtaggaacaaaaaacatttctatgaatttgataaaatgactgtatgccatcatcaattagggatgattggttttctttttatttgagacggagtcttgctgtgtcactcaggctggagtcagtggtgcaatcttggctcactgcaacctctgcttcccgggttcatgcgattctcctgcctcagcctcccaagtagctgggactacaggcaccaccaccacgcccagctatttttttgtatttttagtagagacagggtttcaccgtgttagccaggatggtctcgatctcctgacctcgtgatccaccctcctcggccccccaaagggatgactggttttctttccaaatatgacctgagcattgatctgtccaataagcaagactgttatgtacattatgtagtggatctattgaggcatacgattttcctgtagcatttccattgaaccaatgtctagttctagtaagttctctgatgatatggttgaggctttcatggtcatgttcagattttatatatgtgtctcatgtaggaatctagtcttcataatctgtgtcaaacctaagaatttgagtacagagggattctggaacactgcccagatttggcccagttccattcatgttttctgtgcgtagagataagttaccattaatgacatcaatcgtagttgtaggccatccctttgcctctgttgcttcttccaagagctacactggttgatcataaatatcagccaactgccaagggaaggataccaacccttttcataacgccattttcctgaattgctcactcaagtgtgtatgggagcaggttctaatattagttgtgattctttccatttatctagaggattacgtagccaccaattgctttgcttagtagtgaggatggcttcatgttgagcagtagatcttagaggatattcagtgtggataatgaaattccctaacgaaaataaaagtgtgaaccttttgtgctaaaacaaaacaaaaacaagtctgagtcaatagaagggggccacatggagtcttgtttcattgtcttgggaaagctgtgtctatttcatgatatcatctacttttatggaaggatttctcttgggtatccttaattttgtttttatattattattattattattgagacggagtttctctcttgttgcccaggctgcagtgcagtggcacgatcttggctcactgcaacctccacctcccgggttcaagtaattctcctgcctcatcctcctgagtaactgagattacaggaatctgccaccacacctggctaatttttgtatttttagtagagatggggtttcaccacgttggccaggctggtctcaaactcctgaccttaggcgatccaaccaccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaagctgaggcgggcggatcacctgaggtcaggagtttgagaccatcctggccaacatggtgaaaccccatctctactaaaaatacaaaaattagccgggcatggtgacacatgcctgtaatcccagctacttggaaggctgaggcaggagaatcgcttaaacccatgaggtagaggttgcagtgtgccgagattgtgccaccgcactccagcctgggtgacacagcgagactgtatcaaaaaaaaaaaaaaaagatccagtttccagattccaggtcacgtaaggtgggatcatcaataggcaggtcacagaaagcctccttcacctggtgggatatactttggcatcatacatcaagaccttgcagtattgagtcacatcagagccaccagtagagtggataaatgaagttctgttatgaaaggcacaagtcgttcagtatttattttgtgaagggccactttatgtgttcccctaggggctgatgttcttgccataaaggtcggtgataattcttttggccaaggtaattcagttgactctgttaatttagctaattttagttttgtgataccatttctgcattcagcctttccagaagagagagtgatgagggcaatgatagtgccgtcaggtctgtaaactcttatttggtggataacctgtcaaataaagcgaattgccctagcactagagacctcctcggcaggtaggtgggatttcatctttctggagcctgagcatctccaaagaagagctgccgcatggagcttccctgactggtgacctccaccctcttctctccagagctctttgacccagaggaatctgcaggaatggagggagttggccaaagtagggagatttttactcagaccatatccaggtgagcacacaacagccttttgggcttgggctgatgcgtgcatttctgtctgtacatgcgtgcctggaagtgtgcagatgagtgtgtgagagagggtaatggccatgcatccttgcatagacaagaacatggggtgcacttctgcatgtgcacagcccctccccaacccgggcctgtggtgctgtcctgcccctagcccagagctggcctctgttggctttgagaccctagctttgcactgtggctttgctcggccttagagaccagctgctcccctgctgtggtctctcatagtggagactgatccctggccacccattcagctgcctgagggccctgggaccagtgttcatccccccacctcccaaaacagaggtgtgtaggggttccctgcctggagtcccaaccctgcaggatggagaaaatgggcaccagttactgtgacccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtattgggctggacttgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctcccagcccactcatccagggatgcagctctggccttggcccacccccatcagagggcctgtggccctgatcaccgcactccccactctgtgaccagacgttctctcctgagcatcgctgaccctgcagctgtccaaatagagcaagaagcgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcttggtgttggggcctcacagatgatggagaagccagagttcaggcacttggcatgacccctggcatcgccttcagttgatttagtgtctctgccctggggtattccatgggaccctgggctggcttctgtgtgcagaggtgggtgtgggccatagcccagacctgttgaaccagttgtaggctctggaatcctctgtccccaggcagtcaccaggccttgacaggcgggaatctgtccctctcatcacccccccagttatgggtgcagatgaccctgaaattgctaaagcctcagggcttgagcccagaaagtgtgagcaggctggcggggcagctggaggaaggccttgcaggttcctggatttgggtgccgggtgggctgagaggacagtccctgtcactgggactgggcacaggtgcagagaggctgagacaggcccagaggacagtgagtgtgtgttgtgtgggtgccaggccagggagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctctgggctgcctggtgacagcttcggggacctgcaagctgacagagtctccaggagccagagctggggtgggaggaacccactgggcctgagggaggtagagcagcagcagcagcagctgagcccagcccccggccagccctgaggaatgggggaaaagagtgccctggcttgggggggccctcaagccccggaagctgtatgtgggcatggggggcgggggcagagaggaggaggactgagaagtgggtgtatttgggcaggtgtgtgtgtgtgaccaagcttgcgggcgcctgagtatggactagtgtgtttgtgctggaggagcctgtgtaggttactgacatgggagggccggtgtgagctgcagggaccggagagctgctggaaggggctgtctatgccttcaggctctgagtgtggatgcagctgggcctgttcaggcagattcaccagaggggctactgcgcagagcctgggccctggacacctagaagggcccctcctcccctcgtcttccctccctcatggcccacctttactctgagggggtgggcttcctgcgggggacaaactggagagggactctcttgccgccttctctgttcctggggacaggctgctgcagggtggagggcttgcttttcctgcccaccctcatctttgccgagtcctcgtctgggggccctgccccactctcccttcccaatgcagggccctctcctctggcgagcctgccttgatactccccggctcaacccctttaaccctgctggctcctaatgggactaatgggatttcaggtgtggacccttggaccctccgctgcacagttccagaaacttgttcatcaagtgccaggctgaccatggtgtccgtctcagtgcccagcagttgttctggtgatgggaggtgggagtacaaggtctgccgagtgaggcagaggaaaggggtttctgagcccagatctccggtgctccaagacactcaaaaccagagctgagagcctgaattcagaggctgtactgtggggcagggctggaatttgtggcacctgtgtagggactccagggctgaacgttgcctttgctgtccctgcttggggattttggggtactgggtttggatagagtgtgtcatctgcagaggcagcactgttctggaagtggactctgctcaggtgtggcgggcctgcctgtggggtcaccatggacaggaggctggtgtctggtcaggctgagggatccgtgtgccagcccttctgggaaggctgaatggggcggaactggtcagggcctggcaccaactccaggatgtgctacacccagacagacagatggagagccacctccctaggggcctcctccccctccccttctgcatgccaccacaccccagcagcatctcctgaggctgggccatgggtgaatctgagtcgagggcaggacagagtgggagtggcagtgcctctgcctgtctccctggccgtggcaggtcctttgtcacatatgggccaggagaggtgagtgtgattgtggtagtggtgggggcagtggctgaggacccctctctttgctgggctgggacagagcttgaatggagaggggccgccttgtgcctgggaagggaggaccaggtgtcgctggcaccttccacgtcctgagtgcttgttctgtgcccagcccctgctgaggctgcggacattaaataccaggatatgttttgagactcaggacacctctgaggacttgctgctgttatccacatttaaaagacgaggactctgaggctctgagaggttaagtacctggtccaggtcacctggtcagtttctttcttttttttttttgagatggagtcttgctctgttgcccaggctggagtgcagtggcgatctcggctcactgcgagctctgcctcccgggttcacaccattctcctgcctcagcctcccgagtaggggactacaggcgcccaccaccacacccggctaattttttttatttttagtagagacagggtttcactgtgttagccaggatggtctcgatctcctgacctcatgatcctcccacctcggcctcctaaagtgctgggatgacaggcatgagccaccgcgcctgacccacctggtgagtttctgagctccagacaactcatcccaaatttcatgggtgcatagagtatagagattaaaagtagttctggctgaattttaaatcctggttccactattttcgacctgtctgattttggaacatttaatgtattccttctgtgcctcagttttcttctgtgtaaatgagaatgaaagagtactcccccatcaatttgttgaaaacttcagtaagattatgccaggagctgcagcacagccccagggatgatttaaaagtgaattcaggacagggcgtggtggctcacgcctgtaatttcagcactttgggaggctgaggtgggaggatcccttgagcccaggagtttgaggccaccctagacaacatagtaagaccttgtctcaaaaaaaaaaagcgaatccagtggtgtcactctttgttatcaatgccctccagtgacattcatgacacccaaacttagaatctgagcttttagggtggcctgtgacatctataccacgtgtccccgtggcctccctggcaccccctttccttcctggctgtctgccaccatatggaactttctgtgccttgcacccagccagctcagagtcttgggcacttctctcagtctggaaccttctcttgcctaccccatcttcccatggctgcccttcatgtaggcctccggtttatagccggctcctcagagacatggttctatccccccagtggccaagggctggtggccctcactctctgcccctgtgccctgtgttagtggtcctgtggttgtcattgccccgtcatctccaccatttcctgtttgccgtgtgtctgtgccccccaaggatgaatgccatgagtccagcatgtcaccctgtttctgtcctgccacagtgctcgagtcagtgccctccctgcttgcattcggcccacaggccttgtggctcctgtttctgctgacctgtccagcctcacagtctggggaggccttggggtccccagcctgtgctgggacaggggtattattccagtagcccttctgtggaacaagtagggaaggagtgatgtgacctctgtggctctcctgggacacaggttagtcctgtgggtgacctcactttagagagggctggccagctgtgccggaattaggaagtgggtacagctggacaaaaggtggctggagccagctctgcagaagccacacctgctcatgagaagggtatccttgtgagtacaggggaaatggcatggagaaagacaaacaccggtgggtggctctgccagcttcccctggggtgcttctggcaacgcccaggtctgtgcacatccagatctttgcactgcgctgttttgacttggagaggagaggaggaagttagctgctctgaatggtgttgctgctaatctctacagcactttcctgtaaattaggaacggtaacacacacacccctcccccaccccgctggagaagccctgcaccagagcatacagtttggcaagtaggaggagggctggagcccagcctcacttgctgccctggccaggccgtgattgcccagggtgcatactgtggctggtgctctgccactgctgtttctgtcctcagggtaggacacaaggagggcaagtagggccagtcagcgagaggcgcaggtgacgcgtgttctagggtctgagatcagctgcttccatttcagtaattgtctttggagctacattgtctgctcatacaacttcccttccagatagtgccattttaaaaatcccatttacccaaaagaaaacctgacacctggaaaggtcgtttgcactcacacaagtgatggttggtccagaattcacatccaagtgtgagatttcaatattttttttcttcctcctttttttaaatcaaattttatttgaaagggtatcacagtcaccagtttgaaaaaggtaagcaggccaggtgtggtggctcacacctttaatctttgcattttgggaggcagaggcaggcgtgtcagttgagcccaggagtttgagaccagcctgttcaacgtggtgagaccccatctctccaacatttacaaaactagctggtcatggtggtatgtgcgtgtggtcgcagccactggggaggctgaggtgggagggttgcttcagcctggtgggtggctgcagtgagctgagattgggcctttggtcttcagtctgggctacagagcaagactctgtctcaaaaaaaaaaaaaaaattataaaggtaagcagtacaaatgggaatatgagcataagtcactctcattccagacctctgacccccaggacttttctcttgagaggccatagcctttgttttgcatccttctgagtaaacctattcgtgtacagacatatctgggtatgcatgtaactgttttgtgaaagtgcatttggagatatggatatcgttgttttcacccatcctaagttttgatgctatggatactatgttttggagattagacgataccagcacgcataggtttgcagcctctttttcacagctccatagtgtttccttgtctgtgagcagatttcaagttgtttccatcttaacccctagaaaaagtgctgttgaagatcctgacagacaagtctgtagaaacataggaaactttgtagaataaagttctggccatgggccaaattccctctgagaggtagctctagtttttcttcctagtacatctatgagagctcaggtccctcgtgttttgctgttatgatgaatgaaatatgctgtctccatcacgctggaatttgtagatgtagatgaccatagtttcttatttgccattcatttctttacattaaggtaaatattcatgtcctttggctatttttattttatttcttttttcttttcttttttaagacagagtctcgctctctctcccaggctggagtgaagtggcttaatcctggctcactgcaacctccacctcctgggttcaagcgattcttctgcctcagcctcctaagtagctgggattacaggcacctgccaccatgcctggctaatttttatatttttagtagaggtgggggttttaccatgttggccaggctggtctcgaactcatgacctcaaatgatccatccaccttggccttccagaatgctgggataataggtgtgagccactgcgcctggccctttgcctatttttaaattaggtttcttgtttttttttttttttttttttctgatttacgtgagcacatcataggctcagtgaatttactgatatgttaggtataggttgcaaatgtactttagtttttcagtgtctttttttttttttttttttttgagacggatttttgttcttgttgcccaggctggagtgcagtgcaatgacacgatcttggctcactgcagcctccacctccttgggttcaggcaattctccagcctcagcctcttgagcagctgggatcacaggcgcctgccaccatgcctggctaatttttgtatttttagtagagacggggtttcaccatgttggccaggttggtctcgaactcgtgacctcaggtgatccacccgcctcagtctcccacagtgctgggattacaggcgtgagccaccgctccccggctcagttgtcttttaagtgtttcatttgtcttctctctactcctccctctctctcttgcacttgctgtctgtctcacttaaattttatgtaggtgaatatattcatctttccttgtttagcttctcaatttatatttcttcactatctctattaatatgaaaatatctcatctatataaatattaatgtaacagagttgcatgtgataatctgccaggttgaacaaatgggaatattatctctcatatgacgttagatttttttcctttaagaaataaaatattgcaagtagagaaccaaagacatgcccctgtgacctcttttattcttccccatctccccagaatataattatcacttaaagttgggtgtcaacctgtatttcattctttcatcatacacacaagcacacactgtttatacacataaataatgttgtttttggacgcatactttgtttttgcaacacctttaaacataagtttttacttttattattttatttaagataggatcttgctctgtcacccaggctggagtatagtggcgcgatcatagctcgctgcaacctctcatctcctgggctcaagtgatcctcccaccttagttagcctcctgaggaactgggataatcacagtcataagccaccaagcccagctaagttgtttattttatttttttattttttaaataaagatgaaatcttgctatgttatccaggctggtctcaaactcttgggctcaagcaatcctcctgccttggcctcccaaagtgctgggattacaggcatgactttaaaaagttaacattatgggccaggcgcggtggctcacgcctgtaatcccagcacactgggaggccgaggcgggtgaatcacgaggtcaggagatcgagaccattctggctaacgcagtgaaaccccgtctctgctaaaaatacaaaaaaaaaaaaaaaattagctgggcgcggtggggggcgcctgtagtcccagctacttgggaggctgaggcaggagaatagcgtgaacccgggaggcagagctgcagtgagctgagatcacgccactgcactccagcctgggtgacagagcaagactctgtctcaaaaaaaaaaaaagttaacattatgtcttcaagtttatcccaattgacccatatggattgatttcttcagtttacatggctatatagtattcaggtagcacagtgtatatagccatggctgtactgatgatagtgtttccagtttgtttgtttttttttgctattgcagcactgcctaataaatatcctggagtgggttgtacttatatacttcaaaatggaattaccagattgtaaaatatgcacatattcagcctcactagatactgtgaagtgctcttctaagcctttgtgtcagtttgtacttctgccagcaatgtggaaatgagatttggttttaatatgtattccctggtcacgagtgagcctcagcatcttttcatatgtccaccaagtgtttgggtttaatctgtgaattgcctttttgtgttctttgctttttttttttttttttttatttctttgattgttttggtggttgttatggtaaaatgcacaagcacgaggttgtatttaccatcttaactctttctgtgtgtatagtgcagtggcattaagcactttcagaatgtgctaccgtgctaccatcccaccatccatctcccgaactctcttcatcttgccaaactgaaacatcccacccactagtcaagaactcctcatttccgcctccccccagcccttggcagccaccattctgctttctgtgtctgtgagcttgactactttaagtatctattctaaatggaatgatacaggacttgtctttttgggactggcttatttcacttcgcgtagtaccttcaaggttgatccatactggtagcagaatttcctttctttttcaggctgaataatattccattgtatgcgtagaccacattttgtggatccgttcatccactgatggacgcttgggggttgcttccacattagctattgcaaagtcaataatgctgctgtgaccacgggtgtacagatatctctttgacatcctggtctcaaatattttggggatatacccagaagtgcagttgcttgatcctatcctgtcccttgcttttccctttgcttccttgttttttttttttctttttgttttatgggagtgctgatatattcaagtatttgttgattgcatgcattatgcctgacttgctcaaagcatgatgtcttgagcacttagcaaccttgtgcctgctgagtggtggaacagttctgaaaaggtctgttctggagtgggggtgctgtttcggagagcgatgaatcaggggcttgggtgctgactttaggaggtgcggctcttggaaagacagagtgtgacttccccagtgtggtctccttccttttcctcaccacttctcctacctaaccccaagaatgagtccttgagtctgtctcagtaggtggatctgcattcagtgcagggcagagcctgggtggcagtgcctctccttgcctccctggctgctacaaggtcctgtgtagcatctggtgtggacccagcagccaggaggagagctgagtgtgattggggtcgtggtggggccagtggcagtggatctctctctttgttgggctgggccagcgcttgaattgagaggggctgccatgtgtctggggagggcagaacccagcgtcactgacaccctccagatacagagttcttgctctgtgtttggcccatacctaatgttgtgaagtggaaatactggggtgtgttttgaggctcagaacacctgtgataacttggtcgtgtgtgtgtgtgtgtgtgtgtgtgtgtgtgtgtgtatgtgtgtgtatgtgtatatataaaattattttccttaacaccactgacctgaaggcagttacacgtaatttacaaatgaggaatctgaggctttgagattgtcaaggtcacctgaccagtgactgcagaggctggattggcctgtgggcctgagtccgtaccccttttcactggctcctcctggaggccacatgtaccttgcgcttcctggggcttggtcctggggtttcatctcaggttgacccccgttaggaggaagtaagtaggaaggaaggagatttcctgggtattagggtgtcctcaagcctgcagctctcctgggactgcacagagtttactgtcggacatcagttctgatatggtgcagcagacatggagctggtaagtggttaagatcagtcggacatgacaacctccagttctgcagaagccacttcatttgcctggggataaagcaggtccttgtgagctcatcgacatgcatttggcagaaagtgcgctggctctgccagctcccagtgtgagcttctagcaagccccttgtgccttagatgcccaggtcttttcagaataagcctggcttgttttaacttgatgcaacttgctgctcacagtcatcttattgtttgctgatgaattcagacctccattcatttaaatatttgtcagttatctaccatgtgtcaggcattaaatttagtgctggagatactatgggacataagaagtccctgcttgctgggagtgcgtggtctaattggtacttgggacagtgtggtttaactgccacaaagttaataaagcagcatgatgtgacagagctggatgtgggggagtgaggaagcttctctggactgggtggtctgaaccccatgcagggaggaaactgtggctgggaggagaggaggccggaagagaggtctgggcttgggtcccaaccactgattccagatctctcaacatttgtaacacgaccaactcctgttcttttttttttttttttttgagacaggctagagtgcagggggacgatcatagcttactgcagcctcgatctcctggactcagggggtcctcctgtctcagcctcccaagtatctaggactacaggtgtgtgccaccacacccggctaattttatttttatttttatagagacggggcagagtctgcagtcacatgccttgcaagtagcagagacagggtttagtctcggtagccagtgcctagggcacaggtcttggccagaggagagaaggctcaggtgaaccagtttcatctgacctgcttgctaactcaaacatggctgcccaactgcgtgggctggcaaggtatgtgaggtgggtagctgggtggcccgccccttgcaggcactggggcaggatatcagggggtccagaagaggttgggtttaggcagagtagaggtgattgtgtgggccgggggagcaatgtcaccttgaatgtgtttccatacccagggcccagatggctcaggaggagggggatggggacggggagagtgaggtctttttgactttgatgtgctttgactgcacatcagagtcaaacgagtcagaataagcgggacccctccacaggcatctcagccctcctaatttagcctttctgaagtggagccttgggagccgatgaagcttaataaactctcctggtgcttccagtaggcacttgagggtggacaccaccgtcttcaggtcataggaagtgtgagctagcaggaatcctggagattttctagcccaacagtgtccggtcaaaatagaatgggagccagaaatacaagccacatgtaattttaaattacttttaaaacatttaaatttagccacggttttaaaaagtaaaaataggtgaaattcgttttaatattttaacccaatatagccaaaatcttggcatttcaacatgggatgagcataaaataatgaaggtgatattttattctttttttggggtactaaatctttgaaatccggtgtgtattttccacttaaagcacatgtcagtgtggactggccccattgcaaatactcagtggcctgggactggggtgaccaagtgggatgtggtggggctggtgcagtccaccattctcacagcaggcatctggggtcaggggaggcagggcactggctgtgctggaagcaggggattggctgtgctggtgggaagccagattccagccccagacactggtacctttggctttagatccttggggtgggtgcattgcttctcctgggagggaggagcgcccgggagcccctgaccaggacctggggcaggtccacacaggccctggatttctcctgtatcctgggcctggccctgctctcttgactcccacctcgtcacagtggcttcagctttttcaccctgagaagggaattcaaagcctctgcccctctcaggcaggcaccaggatatgattttcttttttcttttctttttgtttgagacaggatctgacttggtctggagtgtagtagcctgatctcagctcactgcagcctccacctcccgggctcaagtgatcctcccacctcagcctctgaagtaattgggattacaagcacatgccaccatgcccggctaatttttgtattttttatagagatggggtttcaccatgatgcccaggctgttcttgaactcctgagctcaagcaatctgccctcctcggcctctcaaagtgctgggattactggcatgaggcacggggccctgccctgggtatgattttcaagtggttggtgtcttgtgactggcagctgataaacgggtgatacaatgtttctgtacaggagtctgcagtgccaggctgcaggggcggatggtggggggtgggtgggtagcctgtggagcccgagggtgggaacagagagtcttcttttgctgtaggtggaagcctgtctggctcctttccctctaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctacagcgtccagccaggggctgtgccacaggggccagaagatatctgacctactgtcactgcctcttccactctgttccacctgcactggggcaatgccatctgatgaacagatccatttattaattcaacacgtttgtattgagagcctgctgggtgccgggcactattgtcaacatgggtgatacagcagcaagcaaaacaagagaaacatctttgcaagcaggggagggggcctgcagtgttgggtgtgtggagttgttgctgggaagtagagaagctgagtaaagagctggacggagagagatagccaggcccatgtctacagaaaagcattctagactgagtgagcataaatcgcaaaggcccagaggagggagcatgcctagctagccccctagacctggtgaggctggtgtgggttgggcagtgatacggtttggctgtgtccccacccaaatctcatattgaattgtagctcccataattcccatgtgtcatgggagagacctggtgggagataattgaatcatggtggtgttctcccccaagttgttctcctggtagtaagtgtcaggtgagccgatggttttatgaggggtttcccttttcacgtggctgtccttctttcttgcctgctgccatgtaagatatactttttttcttctgccatgattgtcaggcctccccagccacgtggaactgtgagtccattaaacttctttttctttattaatttcccagtctcgtgcatgtctttatcagcagcacgaaaacagactaacgcaggcagcctgtgttgggaggagttggcaaggagggaggaggtgctggccagtagagcacatgtgtctctgtgcatcagagcaaggacccgggctctccccgtgagtgagaagagtccatggggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaggttcggcagggaagccagaggagtccgcagcccgggagacctggcctacagcggagagagtcagtccatgccagtggtgggatgtggctgcaaaaaatggtcggattcatggaagtctggtgtccagctggcaggcattagtggtcccatgaatacagctgtgtgccttgaacacgtactgcagagcttccagagagcaccagggctgtgggggctagagactgtgtctcgtgcggaagcgtggctgagaaggggctcgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtggaggttctggctgaaggagccagaattccagtgccagctccactcctcacgagctgtacaacctgggccggttactgacccctttcccaccttagttccctggctctacaatggaggtaattatcgtgttgaactcacagggtcgagatcatatttaacactttcacagcccttagaagtgtctagcacagtggtcctcagcatttggaaatgtctggaaacactttgtcacacctgagaagagggatttcctactggtgtctagtaggtagaggccagagatggctgctaaacaccccataatacacaagacagaccccgcaacagtgaactctctggcccctccaagtcagtggtgcagagattgagagatcctggtttcgcgttttgagcgtgcagtacatttcagttgttagtggaacatgcaatacatctttattcacatgttattacttatttgtcagatgtttgtaaaacatctgctacattcttggcagtttaatagaatctggagatacaaagaagttcctgaccacagaggtcatttaggcaagctaggaaagcacagaatgatataacacaaagttacattgtaccataaagcatattctatagtacacttaactctggtgggctcttggtataaaaatgtctccaatctcagaggtcatgggatagtgggcaagacatgaaaaccttgtataatataaaattttgttacctctaagtgctgaaattaaggtataaacaacgtctcatgggaaccaaaacatcagtcatttggaagtataagtcaagccttcgtaggagaggaaccatttcagcccgatattaccagagtgggatggtcccagcgagcgggatgtggagggttaggatgttatcttagtctgttttgtgctgccattaccaccaagtaggtaatttataaggagcagaagtttatttggctcacagttctggaggctcggatgtccaagatctagaggacacatccggtgagggtcttcttgctgcattgtctcatggtggatggaagaagggcaaggtggagagagagagcaggaaggggcctaattgtccttttataaggaacccactcctgtaataatggcattaaacccattcatgagaacagagcccttgacccattcatgagaacagagccctcatggcctactcttatgagaccccacctcacaacattgttaacatttaggatcaagtttctagcacatgaactttgagggacacattcaaaccatagcattctgccccagtccccaaaatggatgtccttgtcacatgtagaatacatttgcttcttacctataatcccaaattcttatttgtttcagcaccacattaaaagtccaaagtccacagtctcatctaagtcagctgtgggtaaaactcaaggtatggttcatcctgaatcaaattcccctccagtcatgggctgtgaaatcaagcaagttgtctgcttccaaagtacagtgatgggacaggcataggacagatattccattccaaaagggagagataggcaagaagaaaggggcaactggtccagacaactccagaacccagcagggggaacaataccaaatcccaacttgacaataatcttctttgactccatgtcctgccttccagacacactcgggtagggacttgggcccccaaggcctccggcagccctgcttccctggccttgctgggctcattccatgcagcagctctcaccggttggagtctcatgcttgcagctcccccaggttgctgttgcacactggtagctctgcagttctggggtgtcaggatggccttactcccacagctccactaggcttcctggggactctcagcagctcagactccacagttctgctgggcattgccctacaggggctccctggtggtggctctgaccctgcaaccagtctctgcctgggtcccgagtctgtccgcaatatcctttgaaatctagttggagggagccaggcccatagcccctgcattctgtactctggtggcattaggaccatgtgggatgccaccaagactcaccacttgcaccttctagaatggtaggtcaagctgcacctgggcccatttaagccatggctggggaggcagaggagcactgtgcccaaatgtgggagcagagacttgaggtggccctggacagtgagccacaggtcctgagggctcccaagacctggcttttgacatagttccttccctcagattttggcactgccggagctgtgatcacaggtcatctctgcagtacctttgggatcattcttattttcttgatgaatagcctctggcttcattcttattgtactaatctccttatcaaactgtggctctggccaatactaatctccttatcaagtggtccatactaatattcttattaaactatcaaacggtaacatgcctgcacccttgctttcctctcctgaaagttctttcattctctactacagggccggtctcagaatccttccagtctctaagttctgtttcgcttttcattataaatttctttctttctttccttctttttttttttttttttttttgagatggagtctcactctgttgcccaggctggagttcagtggcacgatctcagtttactgcaacttctgtctcctgggttcaaaccattctcctgccttagcctccctaatagctgggatttcaggtgtgtgccaccacacccagctaatttttttgtatttttagtagagatggggtttcatcatgtcagccaggctggtctcgaactcctgacctcaaatgatccgcccgcctcagcctcccaaagtgctaggattacagacgtgagctactgcgcccaaccctgcttttatttataagtttcatctttaaattatttatttcttctcaagttttacagtatacagttaaaataagtcatacagcaaccaaaatgctttgctgcttaggtatttcttccaccaaatagcctagtttatcactcttaagttctgcctgctatacagtttgaggacctggacacaatgtagccacattctttgctgctttgtaacaaggatgactgttatgccagtttccagtaccttaatcttcagatatatctgagacctcatcagaatggccttcacgatcgatatttctaccaccattctgatcacaaccacttagtctaagaagtttcagactttccctacagatcttctaatcccgctttattgcctgcctgcctccctccctcccttccttctttcctctctgctctctctctcttttcttcctttccctcccctcccctgctttcctctcccctctccacttcttggcaccaattttctgtcttagtccattttgtgctgctgtaacagaataccacagattgagtatattataatgaatagaattttatttggctcatggttctggaggctgggaagtccaagatcaaggggctgctctggcaagggccttcttgctgcatcatcccatggtggagagtggaatggcaagacagatcaagaggggacctaactggccttttataaggaacccagttccacagtaatggcattaacccatccatgagagcagagccccatgatctaaacaccttttattaggccctgcttatactgttgcactggggatcaagttgcagcacttggacttcgggcaacacattcaaaccatagcaggcaccttaataaaggtggaaaagggatgtggcagctacagtgggagggaaaaggtggctcccttagtgtgcttgggaggagggtaagagatgcgtttgcagttctcatggccgcagactgaaggggcctggttacctaagggaccttggcttcatgtaaggagtgcggagtgagtgaagcaagagggtgatttgatccatatcatttcttagaaggataccatgttggcagtttcgaagaaggggcatgagtgaggaaacagttgtggtgaagagaccagttaggaagcctgtaacttggggtgggatctggaaccaggctgtggctccggaagaggagctggagggctgcactgtgaagtatttctcagagtctagacaatgtgaccttcacactggggctgagttttgtaaaatccgacatccccagtttcacctatgatgccaggcctgtggtaaggagctttgcaagcatttgctagaatatgagcaaatggaggtagaactgataatatttagtaaccatggggggatgaaagagggaggtgttgggagactgggttgataatatgggggttgggagtgaggagagagtccagctttgaacatcttcttccatttgaggaatttaagatcatccagctagaaaattagaaatactaggatggagtgtggaagagaaattagtgctgaaaataaagagctcgaatcatcagtgtatgaatagtagttaaacctctgaaaatgagtgaacttgtcccctgaaaatgtgtggcaggggagaagcgaggttcaaggacagtgcccccgagaatgccagcatttaaagggtggaccctcggtggctcacgcctgtaatcccagcactttgggaggctgaggtgggcggatcgcttgaggtcaggagtttgaaaccagcttggccaacatggtgaaaccccgtctctactaaacatacaaaaattagccaggcatggtggtgggtgcctgtatcccagctactagggaggcacaagaatcacttgaacctacaaggcagaggttccagtgggttcgtgccacttcactccagcctgggtgacagagggagactccctctcagaaaaaaaaaaagaagaagaagaaaaaaaaaaaggtgggccccggcagcagagcctactgtcccggaggcaggaggaaaacctgaagggaatcttgaccttgacctagaagccaaggaggaggcatggccaacaacatcaaaggcctctgagcagcgcagtgaagactgacaatagacctttcttaagtttggcaattagaaggtcattggcctcagcaagagcaatttcagaataaaaacaagagtggagggagtggcataggggtcgggggacagagtaggaagtgagggtgtagtagaggggaagaagtttgatcactgagggaaggagggagatgcaggggtagcttgaggaggagatagagcagagagaggtttgctgtttattttaggaagaggagacttgagcatgtttataagtcagagaatagagaaggagaggtgggagacacagggaaaagaggagtcattgattgggaactattctgggaaggtgaggtggatctggtgtctaggtggaaggatttgggggaaagaggggaggtaggagagtctagacgtagacagcaggcagacaggggctccaggttttccctacagaactgaggacagtgatggccgagcgtggtggctcatgcctgcaatcccagcactttgggatgccaaggtaggtggatcacttgaggccaggagttggacaccagcatgggcaacatggagaaaccccatctctactaaaaatacaaaaattagccgggcatggtgacacatgcctgtagtcccagctactcaggaggctgaggcacgagaatcatttgaacctgggaggtggaggttgccgtaagctgatggcaccactgcactttagcctgggcgatagagcaagactgtctgaaaaaaaaaaaaaaaaaagaagaagaagaagaactgaggacagtaagagtaagtggtcgcttgtgatcacagaaccagcaagtaaaccgcgagcttctgcccctctggtcttcccagaccccttccccggaacattaagccatatcgcttttatgggtccaggggctctgaggggctgggcatcatactgtgcccctgggggcatatctagttctgccccacttggttgggcgggtacctgctgagtactcactgtgtgttaggctgtgaatgctggggcagcaggaggcatggtttctgcctccactgggccttatttcttcaccttgtcccccagttctgcccttgggtaagttctgtggcagaactgaccagctcccttcggccagggacatcttggttcctggcagagcaccaagaagagcagattgtcttcctacccgggggcacctttgcccagcaggtcgggtgagctggcctcttggtgagaggctggtccccttggacatgagtggattcgatgcctgctttcccacccaggtactctactgtggctttgctcctgccctttatgctcagagctagaccagcaatgtgggggagctgctggggaaaggcgccatgttgtcttgaggtagcagccagccccggaagccctggaatgcctggggccactgagcaatcctcaccctcagccccacaaggggagggcgtggctcgtgaaattcctgattgggtatagcccagcaagccccaagactcgcccagtttgcttagcgcaacactgacgctgttttggaatgaagacaagacaatgtagaactttactggggaagaggtcgaagaagggctaattgtcttgttgttcaagactggttagcgctgctcacctctgacgctgctcacctctgacgccaaaggtttttccctggaaggcagccctggaggatacctgtgtatctgtctttcacaaaaggtgaaatgagctctttgtagtgtttcccgcccaggctgcattttagaatcacagaggaggtacggcgctgatttgttttactattccctattcatgcctgggccccacccctaaccaattaaataaacatctcggagagtggggcctagactttatatgtttaagctcctcaggtcattgcattgtgcagccaatgctgtgacctatgaatacaaaggaagatgaaacgcaccctggtcatgcaaggaagatggagagagggagcagggagggtgagagaggctgcagttcgtaaggtcctgaaatgttagagctggagggatcctggttcggagcactgcaactcaaaagagtagttctagccatgcagcaggccccattagggagctggttagaatgcaaatccccgcctgccctgcaccccatctggcaccctctgagtcacggcgtgcacatcgaggtttgagaagtgtgctttcaggtcacccacagatcatccagaccagtggttctcaaccttggctgcactttagaatcacccagcgggcttcagcgaattccagtgctgggctagatgaattaacccagaatttctaggtgttgggacccaaatactcatttaaaaaattttttttgtttaagtacttcaggtgagtctcttcttcagccataatcaagaatatcaggcttgaccagtgcttctcaaacttggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcaaggaaactgcaggtcagagagggaggtgtgatcgtccacggtaaccaacctgatatgcattcagtactttctgatgtactctactgtgtgccaagcagcatgctacatgtgggactagagctgcgaacaggacagacccaattccaaccctcacagagcttatatcccaactggggagacagacagaaagaaaacaagtaactaagctgatgacagatgggaaaagctatgaaggcgaggagggccatgtgtagggaacgactcagagattgctgtggggtgaggggtaggtaaggcacgcccctttcagaagagctgtcgggggagttactaggacaatacctttaactggggactcctgctgattacaaactgatcacttttctttactggacaggactaggcttcatcccctctggggtttggggatggtgcttctgactctcctgaggcagtctgaccctggtccctgcctggctgtctcctctgactcaagactctgatccttcagtgtttgtgggttcagagcagagcctgggaatgagcccgctggggagcaggacactgactccaccataggacagggctcaggatcattggttaatggtttgtaaaatggaccaggcctcatccagatgctgtccccagcccctatgaaaacatggaaagtttccactggtgcacaaacactagtgcttgcctccctttcctgatcaaccgtcggactcacatgggctgtttgtgaaaatgcctgtcccaggccatactcaggctgaccaaggtggtctggtctccagggaagggccgtgaaatgtatttttaggaagtggtccaaaggactcttctgatccagatcatcaggaagcatggcgtggatggaagaaactggcacttggcatctggtgcctctgtgtggctgtagaagctacagaaatgtcttctgcagtgactgcagcgtggccctggctgagctggtgcttgtgaggaagcctctgcttgtgtgcaggggtgaacagcagctcaccccttcccatgcacagtcctcaccttactaccttcacccttactggaagcatctcttgacttctctttggccagccagaccctcccagctccctgtgctccccatttaaacaccttccctccctgagcttagcccatggctgggtggggaggcgtgagcactgtttgcatttggtcagggcctagaagggatcaaggaggcctcatgaggaccatgtcatagccccaccctcactccccacccctgacctgagcaaacctgtttggctggattgatgatggagaggcaggcagtgaccagaccaagagacgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggaccctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagctgaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaaggcagccagcgctctgaggagcagtggagggagggcaggcagccttcagaatgctatctgtcacatcagtccctccgcctggtactttttgtagaggatctgctcctccgggtgctagccatcaccagctcctccatccccaagaacatccagaggtaaggcggcactccgactccagtctgggcaccttctcctatttcctgccccctgcccgctccccccactccccacccccccgctctgtgaaacagtcatggactggtaccatcccagccaattctcatggtagcctagcctgggcatctgggtgcagagtgggcagaggctgctcgagggtattgcaacagtggggcaggcgtttctcattgatacacccccccatgccttccctccactcctctgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtacgatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaaaactttagtcccttctacctgtgtggatgttcttggaagtggtccatggtttagaccctccactctatacacctggtcacctggcctcccgagggggtgcctttcctcctctctttccctggtcctctcctggtctcccatctgtggcacagacttcacctccctttcctctcaccttgtgctcctgaaggcctctgccatcgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcactagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcgcacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggtaagtgcctggcttgtgagcatggtgggccagggcgtggacgggcagacagtcagaggggcactgggtgagtgggagcagtgctgagacccagaggtggctcccgcagtcagaactggaaccgaggcacctggactccctggccagcatcctccatgttcagccacatgggctttgtcttccttccaagagccagcctggggaagggagctcccaagaagtgtggggccattgggaggggcagggagactttcctggggacagagaggtccctgggagtccctcagtttatttccttggctgtctccacaggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagca

SEQ ID NO: 1003 - DNA, 11226 bp, Homo sapiens
ctttcacaaaaggtgaaatgagctctttgtagtgtttcccgcccaggctgcattttagaatcacagaggaggtacggcgctgatttgttttactattccctattcatgcctgggccccacccctaaccaattaaataaacatctcggagagtggggcctagactttatatgtttaagctcctcaggtcattgcattgtgcagccaatgctgtgacctatgaatacaaaggaagatgaaacgcaccctggtcatgcaaggaagatggagagagggagcagggagggtgagagaggctgcagttcgtaaggtcctgaaatgttagagctggagggatcctggttcggagcactgcaactcaaaagagtagttctagccatgcagcaggccccattagggagctggttagaatgcaaatccccgcctgccctgcaccccatctggcaccctctgagtcacggcgtgcacatcgaggtttgagaagtgtgctttcaggtcacccacagatcatccagaccagtggttctcaaccttggctgcactttagaatcacccagcgggcttcagcgaattccagtgctgggctagatgaattaacccagaatttctaggtgttgggacccaaatactcatttaaaaaattttttttgtttaagtacttcaggtgagtctcttcttcagccataatcaagaatatcaggcttgaccagtgcttctcaaacttggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcaaggaaactgcaggtcagagagggaggtgtgatcgtccacggtaaccaacctgatatgcattcagtactttctgatgtactctactgtgtgccaagcagcatgctacatgtgggactagagctgcgaacaggacagacccaattccaaccctcacagagcttatatcccaactggggagacagacagaaagaaaacaagtaactaagctgatgacagatgggaaaagctatgaaggcgaggagggccatgtgtagggaacgactcagagattgctgtggggtgaggggtaggtaaggcacgcccctttcagaagagctgtcgggggagttactaggacaatacctttaactggggactcctgctgattacaaactgatcacttttctttactggacaggactaggcttcatcccctctggggtttggggatggtgcttctgactctcctgaggcagtctgaccctggtccctgcctggctgtctcctctgactcaagactctgatccttcagtgtttgtgggttcagagcagagcctgggaatgagcccgctggggagcaggacactgactccaccataggacagggctcaggatcattggttaatggtttgtaaaatggaccaggcctcatccagatgctgtccccagcccctatgaaaacatggaaagtttccactggtgcacaaacactagtgcttgcctccctttcctgatcaaccgtcggactcacatgggctgtttgtgaaaatgcctgtcccaggccatactcaggctgaccaaggtggtctggtctccagggaagggccgtgaaatgtatttttaggaagtggtccaaaggactcttctgatccagatcatcaggaagcatggcgtggatggaagaaactggcacttggcatctggtgcctctgtgtggctgtagaagctacagaaatgtcttctgcagtgactgcagcgtggccctggctgagctggtgcttgtgaggaagcctctgcttgtgtgcaggggtgaacagcagctcaccccttcccatgcacagtcctcaccttactaccttcacccttactggaagcatctcttgacttctctttggccagccagaccctcccagctccctgtgctccccatttaaacaccttccctccctgagcttagcccatggctgggtggggaggcgtgagcactgtttgcatttggtcagggcctagaagggatcaaggaggcctcatgaggaccatgtcatagccccaccctcactccccacccctgacctgagcaaacctgtttggctggattgatgatggagaggcaggcagtgaccagaccaagagacgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggaccctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagctgaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaaggcagccagcgctctgaggagcagtggagggagggcaggcagccttcagaatgctatctgtcacatcagtccctccgcctggtactttttgtagaggatctgctcctccgggtgctagccatcaccagctcctccatccccaagaacatccagaggtaaggcggcactccgactccagtctgggcaccttctcctatttcctgccccctgcccgctccccccactccccacccccccgctctgtgaaacagtcatggactggtaccatcccagccaattctcatggtagcctagcctgggcatctgggtgcagagtgggcagaggctgctcgagggtattgcaacagtggggcaggcgtttctcattgatacacccccccatgccttccctccactcctctgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtacgatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaaaactttagtcccttctacctgtgtggatgttcttggaagtggtccatggtttagaccctccactctatacacctggtcacctggcctcccgagggggtgcctttcctcctctctttccctggtcctctcctggtctcccatctgtggcacagacttcacctccctttcctctcaccttgtgctcctgaaggcctctgccatcgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcactagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcgcacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggtaagtgcctggcttgtgagcatggtgggccagggcgtggacgggcagacagtcagaggggcactgggtgagtgggagcagtgctgagacccagaggtggctcccgcagtcagaactggaaccgaggcacctggactccctggccagcatcctccatgttcagccacatgggctttgtcttccttccaagagccagcctggggaagggagctcccaagaagtgtggggccattgggaggggcagggagactttcctggggacagagaggtccctgggagtccctcagtttatttccttggctgtctccacaggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagca

SEQ ID NO: 1004 - DNA, 8460 bp, Homo sapiens
tccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaaggcagccagcgctctgaggagcagtggagggagggcaggcagccttcagaatgctatctgtcacatcagtccctccgcctggtactttttgtagaggatctgctcctccgggtgctagccatcaccagctcctccatccccaagaacatccagaggtaaggcggcactccgactccagtctgggcaccttctcctatttcctgccccctgcccgctccccccactccccacccccccgctctgtgaaacagtcatggactggtaccatcccagccaattctcatggtagcctagcctgggcatctgggtgcagagtgggcagaggctgctcgagggtattgcaacagtggggcaggcgtttctcattgatacacccccccatgccttccctccactcctctgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtacgatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaaaactttagtcccttctacctgtgtggatgttcttggaagtggtccatggtttagaccctccactctatacacctggtcacctggcctcccgagggggtgcctttcctcctctctttccctggtcctctcctggtctcccatctgtggcacagacttcacctccctttcctctcaccttgtgctcctgaaggcctctgccatcgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcactagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcgcacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggtaagtgcctggcttgtgagcatggtgggccagggcgtggacgggcagacagtcagaggggcactgggtgagtgggagcagtgctgagacccagaggtggctcccgcagtcagaactggaaccgaggcacctggactccctggccagcatcctccatgttcagccacatgggctttgtcttccttccaagagccagcctggggaagggagctcccaagaagtgtggggccattgggaggggcagggagactttcctggggacagagaggtccctgggagtccctcagtttatttccttggctgtctccacaggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagca

SEQ ID NO: 1005 - DNA, 74991 bp, Homo sapiens
agaaggagggcgtggtaatatgaagtcagttccggttggtgtaaaacccccggggcggcggcgaactggctttagatgcttctgggtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggtggggaccgggcgaacgccggagagtcgtctccttcgcccgccggaggagcgcggactgcgggcgggcagcggggtccgcggcagggcgggccggcggtgcggcgccgggggtccggctctgcggcgggtctggcgcgccctcccccgcccgtccctgcttggcgcagtgcttagcgctggaggtcgggctgcctcagccgccgcagaggccaaatgaaaggcgtcggggctgctgggggcggccgtccgcctcggccgacccagcccccaacccgcccgcggcgccgccacctcctccggggacccagtgcccccgggcgcccgccccgccctcccccgggacaatgccagggcgctcctctcccgccggagtccgcggctgggctttctccaggggcggccccgcgcggaccccgtacgctccctcgcgcggcaccggggcctcggctccgggcctcccacctgcgagcggcgggcttcgcctttgttgccaggtggacgcggccccggccttcgcgcgcggcagggatgctgcgagccccgggggagctcccgcgccaggccgcccgctgctccctctgccgcctggggccgggtcgcggacgcgcattttttaagtggcgctgtttgcctgcgtccgtagaccgaggaaacccgctctgggtgcgttgaccgctttcgtgagggtttcagtgagtagggaaggtgcccgcgaaggcgtgtaaactgttggaaaaatcgtcctcttcgggtgtcagaattccatcagtggttgtgcttcgaggtcgcaccctgagcatccccgctgcgagaaaggcgaagcggcagggccgggggttggggaggccgcgggagggggcgggggcggcggggtccgcggtgcgggccggagcgggcagccttggaggagccctgctgtggccgagggagacggcgagcttgatctttacttcccttctcgaagtggtgcttgaactgctggtctggaatgtgtagttctggtgtcgtttatttcttctccctcttcgctcttttaaaaattacaactggtttctgcatacttagctaatttcagagagacctgaagactggatttgattgggcattaattgagagctttcttttaaagacctcaggtttagaatatatttacttctacagaatgttcaagtatttccacgggtaaaaataaatctaataaaaagcctctctgatggaacggcttaacacctttgtattcatccagtttaaagctttgtgactgtgagggtaagaaaggagttcagctttaaagagaaatagttaacgtttatctacagaggattttggattgcgattgtttcagtgtgtccacacaatggtcagagttgtatctgtgatccctgatatgtcgcatgaaaacagctaggtgagtgagatgggaagaaaaaataaaggctttcgtatggaagatgggacttcactagtgggtcgggtgtcagaaaccatcgttcacactcgcactccacttcccactgctatgactaatttgaggcattagtgaattcacagtagaagactcagcagttttaaagaattcgttaatacttgtgtagcgggaaaaaataatatgagaattcattgttgtgtgttaaatttgattgttagccacagcgttgttcagttgaaaagtatggttgaagaaagtaggaattaaacatttctgaaaaatggttttatggtaactcctgttctttggagctgtatttttgctcacacttactaaatgatctttcaaggggccttttgtcaagctatcagaattttattcatatgaatataatttgattttgtttatttgctgtcaggcaagggactgtcgaagcttaatttagatgagagtggcctaaatcaggatgtctttgggaaggccctgattgagattagcgaaagggattctggccaaatccctgatcaagttgcttggcacagaattattgattggcaaatctttagtgttgcttggtgttgactgaattaatctcttacacctgtttaaaaagaaaaagctcacctctggactcagggtcacttcctctcttaaatccgagacaagttctcctgtgtgcatgctcccatttgggactgagacagtattgtgctgaaaccccgcatactgtgcagtggatgactaggctcctgagaaccggaacttgagtttgttctgtcacatttgaaagaaagaaggccatttgattgccagttttctggaaactcaaacccaaattaaaggatgtcaactgaggcagagtagagaaggctttgtgttggtgtttctgacaggtggtatgggagatgtgtaattgtaccttggagagaaaccttggtgtgcttctgataggaatatcgtcttttttttttttttttttttgatacggagtctcgctctgtcccaggctggagtgcaatggtgggatctctgggctcactgcaacttccgccttccgagttcaagcgattctcctgcctcagactcccaagtagctgggattgcaggcgcctgccaccacgcccagctaatttttgtatttttagtagagacagggtttcaccatgttggccaggctggtctggaacacctgatctcaggtgatccacctgcctcggcctcccaaagtgctgggattacaggcgtgagccacagcgcccggcccgttatttttatcataactatgttttaaaaatcttttgataaatacgataaacttcagttttatcaattagttcctccttttgtagagggaatttgttttaccatctaaagccaggctttcccagggtgtagccacaagccacatgtggttattgagtctgtagggtgactagtgtgaatgaggagtgaatttttcattttatttaattttaattaatttaagtttacatttaaaatctgattcagtggttggaaaacttttaactgaaataatttggttatgcgaatttacttttaaactgtacattttatgaaatctaaatgtagatcaagtatttcctatgaaaatttagcttctgaattgagatgtactggaagtgtaacatacacatcagattttgaagatttaatacagaagaattaaaatctcaatttttgtattgactaaattgaaacaatactttagacatgggctaaataaaacattaaaattaatttcacttgtttcttttcactctaatatggttcctagaaaatttaatactatgtatgtggctcacattgtatttctgttagatggtgctgatttaaaattttgcttaaagttggtcctgcatatgtttttattagcagaattttttaatatgttcctatatttttccacataaagtcttgctggaagttggcccaacatgctcttaagtatttttgttagaacaattttgaatgtgttgatttttaaactttttcaattaaaaatgttttacttagaaataactttaatcaccaggcgcggtggctcacgcctgtaatcctagcactttgggaggccgaggtgggtggatcacgaggtcaggagttcgagaccagcctgagcaacatggtgaaactccgtctctactaaaaatacaaaaattagctgggcgagatggcgtgcgcctgtaatcccagctactcaggaggctgaggcaggagaatctgggaggtggaggttacagtgagccgagatcacaccactgcactccagcctgggcaacagagcgagactccatctcaagaaaacaagaataaaaaaaagaaataactttaatcttataaaaaatgcaaaaattgtacaattttcttaccctttactcagattcaccaattgttaacatttcttctagtcacatttgctttactactgcattttttgccaaattatttgagagtaagttgcatacgtcgtcccccatcccctttacccctgagaacttcagtatatattttctaagagccaaagacattgtcttacataggcttagtacagccatcaacctaatgaaatttaacattgatacaatacttggatcttatctgctgtcggttttctagttagtttgttgacccaatcatgttctttatagcatttgaaaacatgttttgttgttgttgttgttgttttgtttttcttttttgagttggagtctcactctgtcgcccaggctggagtgcactggcatgatctcggcttactgcaacctccgtttttcaggttcaagcgactctcctgcctcagcctccagagtagctgggactacaggagcccaccaccatgcctggctcatttttatatttttagtagagacagggtttcaccatattggccaggctggttccaaacttctgaccttgtgatctgcctgccttggccttccaaagtgctgggattacaggcgtgagcctccacacctggcccctttcaagattgtttaattctgtttacccttactaaattttgaggcttttggattttctttctaaaataacagaagaagaattctataggtagtacatattcattgtaagaaatttaaaagtacagataaccaataagaagtgaaaaatgacctaaaatcttattccccagggaaaccttactgtaatattgtatatacccttctgttaatagataggtcatgtacataaattttataaaaatggcacatactgcatattgaagccagcacctaacaatgattatttcgaattatgctaacatgaactactcaaagaaaataatgttttccgtgtgacaaaaagtaggggtaaatctttgtacagtaattgtagtttccatggaggggccagttgagagagaattctaaattgcctataattcaattttcatgggttgatttttaatgagataaactagattaccttgaagtttaattaaatttagtgtattgtaccttgatttatggcctaagatggaaagtggactatgtaggcacattcaagcagaaatgagttccagtcctttgtgtcaagtacaactaataattgcttttgctgagggaatttttcttacctaagcatcgtgaagtctttatttttattttttattttttgagacagggtctcactcttaccaaggctggagtgcagtggcgcagccatggctcactgcggcctcaaactcctgggctcaagtgatcctcctgcctcagcctcccgagtatctaggagtacagtgcataccaccacattcggccaagatctgtttttcaaaatgagatcttttaaaacataactaatctatttttttaaagatgaagattagaaaattagctgactttcatttgtaattcatcctactagtatttattaaacctgttacatggttctgtgctagatgctaaacagtacagtagtaaaaccaaatgtggatagtgctttttactttgcgaaacacactcgtgtatgatttctaggccctaaccccagagattgtcgttgagtacctctgggatgctcagtttcaaaagctccccggatgattctaatgtgcaaggagagaaaaacaaaacaaagtctttgggtaatttatctccataagtccctaacagtctcgtgaatttggtattcttatccctacctaaaaagggagtcagtagaggccgagggttgaacatcacccagctcgaccaggggaaggagtctgcccatcctatctaagcctactgctctgtcctgtcagtgtggttcatatttcccttttggatgcagatttctttttactcatgtctacctgtctttcccattaccaaaacctggtatgagtgtttcccttaaaaggaactaatttcatacaagttgtgatatattatgaaccattgtaaaccatatggttaatagtgaccctttgaagtatgtaattacaggggactttgatgttttacattttccattgatttatttttttctttcgcatcattcaaatgatattcactgatttttaaaaactttttgggcctttctgtttgtttgttttgagaccgagtctcactctgtcatccaggctggagtgcagtggtgccatcttggctcactgcaacttccgcctcctgggttcaagcgattctcgtgcctcatcctcctgagtagctgggattacaggtgtgcgccaccatgcccggctaatttttatatttttagtagagacaaggtttcaccatgttggccaggctggtctcgaactcctgacctcaagcgatccagccgcctcagcctcccaaagtgctgggattacaggcatgagccactgcgggcccagctcttttgtgtctttttatattatgtgcaagttctctttttttagtagtaagttgtgtcatttttgtattctgacctaaagttttaagaaaagaagttacggttccctgtagagatttttatcaaaatcaaggtgcgggattatttggaagagagaaggctgccagcaccagatactcaatcagtggccagtgaccagtgtgatgggggtaagattgtggtccagaaaaaaactacttcgtgtgtggagtggggcacctaaaaggttgcttaattgagctgtccccaccgccttcctaccctgccttccttgggcacactccccagtggttgtggaattaactccaggggacatgctctgataggataatgtccagaggaggaagagatagtctcttcctgtatatctccttttaagagtgaagaaacctttctcaaagcccaccagcataagacccctcaggtgtcactggatagaagtgtatcagatgcttctagccaaagcaagccttggcaaggggaatggtactgcctccacaggctttgacttctcagggcctgcttttggaagcatgtggccaggaggaggagggtgcagcctctaatcaggttgggcttatcagatggtgatacctcttactaaaaagaaaaagttgggcttggttggaaaagaaagctgtggatgttggtgagaacccagtgtctgctacaggggcattccctgtctgggaagttatgtagctgggatggctgaaagagaaagaagtaatttcttctgaagaaattatctgtgggttaaaagttagctggcaaaatggagacatctgagacatcacaatgcgtttgttagatctgggataatgctatcattttaaagggataatgctatccagaagagaatggctggaatggtgaagaatgtgaaaaatttgacatgacaggtgagtggactgtgagggagatatttcgcctagataagaaaatgtgacattagtggtggtagtaaggatcgttagtattttcacatattttatgctttgtctctggaaggctaagcatgtaacttgcttaggctgaagcaggctttttacccggagaggtgaactattagagcttttattttactctctttaattatgagcattccccacataggatagttaaacatgtaaaacagacccttatgtccagcccccagttttgttgaatcttaacatttctcatgtatgttttagccttaaaaaaaaaaacaaaaaaccactggatacggaaatataacattaccaataaaagcctcatttgaactttccagaagtaactcttgagttaggaatttacatttccattcatattttcattacatttgcttaggctgttattagagttgtaacacatatttatcaacacatagtgttaattatttgtgcatactgtgatgattttagaaggtaagaatgtcaagctgtttgagctgaaagtaaagatagccccttatcaggaaagtgccagccacccttgctgcttctacccactattgaaagcccttgagtatttttgagcttttcaaaatttaaaagtacacaaaagaaaaaaaaagctcagtgtgtttttgtaaatgaaacacttgtgtaactaccactgaggtcaagaaataaaacatggccagtatctcctttccttccttgctcaggagtaactgctcctctgactttatggtatcactttttgtatttccttatagtattacctcccatgcattcgtccctaaacactgtagttcagtttttctttctttttttttttttttagcttcatataagtggaatcattccgtatatatttttatgcatttggtctcattcactagacacatttttgacagccacgtgtattgagtgtagctgtggctcactcatttccgttgctgcatagtactccattatatgaataaaccacgcagtttgttctgctgttgatggacgtttgagttgtttccactttgaggttattaagataatgctgttctctgtgtggtttgccttttcactcttagtgatgtcttttgaagaagttcttaattttaatgtctaattttttagtcttgtcttttctttttctttttttgttatggtaggtgctttttgtatcctgtttgagaagtcttttcctaccctgaggatataacgatagtctcctatattgtcaatggggaactttatttttttgcctttcgcttttggagctataatttatctggatttttgtgtagaggtgaagttaagggccatttcatttctgtttttttccttatggatatctggcctgcaccatttattgtcaaggtcatcctttcccttctgctcggctctgtcacccttgtaatcaagtatctccctgtgcgtgaatctgttcctgggttctcccttctattccattgttctctttgtttatccttgcaccaactccacattgtcttaattattatataataagattttatatttactagatcaagcccttccttgcttgtcttgaatagcatcttagctcttcccttaacctttttcttttcacataaatttgccacattttaccaaaacagcttcttgttagaattttgcttttgctttgggtctatagtttaattgggggaaaattgacatttttcaaatacctagttttccaatccgggaacatgacatgtattttttttatttatttatttatttatttatttatttttgagacaggttgttgctctgtcacccaggctggagtgcagtggtgcagtctctgctcactgcaacctttgtctcccgggttcaagcgattcttctgcctcagccttctgagtagctgggattacaggcacccaccaccatgccaggctaatttttgtatttatagtagagatggggtttcaccatgttggtcaggctggtctcaaactcctgacctcagatgatcctcccgccttggcctaccaaagtgctgagattataggtgtgagccactacgcccggcccatgacatgtgttttatttaggccctctataattctgccttcaatgtttggtagatttctgcatagagatcttgtgtatcttttgttagatttattcatagtcatttgatcttttttatgctattataaatggcatctttaagattttttgttgttggtttgtgtgtttgtgaaaaatacaattgatatttttcagattgaccttgtatccagtaatcttgctaaacatgtatactaattataataatttatctgtaactttaaatttttctgagtatattctgtgaattgtgacagttctatttctttccattcaatccttgtaacttttatttctttttcttgctttgctgccccagctaaaatgttcagatagaaaagacaatagctagtgtcttagtctgacttctctcagagggaaactgtttttgcaatttatatgatactcgtagttttttggtagataccagaccctttatcggataaggaagagtttatattctaagtttgccaaagattcttgtcatgaatgaatgttgagtttttttcaaacatctttttttgccaagtataagatgatgatatgaatttaattttgagagtgcagtatgtaggaaactttgcattcctgaaatgaaccaaacttggtttattttctgcatttggtttgcaaaaattttgttcaggagttttgcctctttgctaataagtgagtttgacctgtaatttttctctttttgtaatatacttgtcaagttctgatttcaaagttaatagcctcctaagttttgggggaagagagcattgcctttattactattataattttttgagacggaatcttaccctgttgaccaggctggagtgcagtggtgtggtcttgtctcaacctttgcctcctgggttcaggtgcctcctgcctcagcctcctgagtagctgggattacaggcgccagccaccatgcctggctaatttttgtatttttagttgagatggggtttcaccatgttggccaggctggtctcaaactcctgacctcaagtgatccacccaccttggcctcccaaagtgctaggattacaggcatgagccaccgtgcccggccagacattttatttatacaggtgcttacagactgattaatttgaggtctaggctaatgtgtgttccagacaaaaattttcattctacctggagcctgaggacactagcaatccaggatcttactgtaagttcctggactgtgatgactgtaagctgaactctgtggagtcctgtcagtttctgatttatctttctttttttttttttttttgagatggagtcttgctttgttgcccaggctggagtgcagtggcgtgatctcggctcactgcaagctccgcctcccgggttcacgccattctcctgactcagcctcccaagtagctgggactacaggtgcccgccaccgtgcctggctaattttttttaatttttagtagagatggggtttcactgtgttagccaggatggtctcaatctcctgatccacctgcctcggcctcccaaagtgctgggattacaggcgtgagccaccacgtccggtcgttggatttatctttctagattcatatgctttgagctacaaactccaaacctttaagttctccaagttattacaaaaaatttagaaaatacagttttgaccaaaacaaaaaacaaacccccccaaaaacaaaagagtagattcccccttatgtgtgtataacccgttttttccttcatttaacatattgaataatttccaggtcattacatattttgtaacgtgtatagctttttttgggatcacacttgatggtttggggcttttgaacactctgcaattttaaatgtacaacattcatccctctaaataggtattcatgctgtgaatttggatttgagtaactaaactattgtatgaacattttgagttattgcatagggatgttgcctactagccagtgattggatatttgcagtagtattgaactgttacttgactattttaccctcattttataagggtgataaaaaggagggaaaatgtttattttattgataagcacatggtgataactggtgcttttttggtgtttttctaggtagtttctttgaacttatataaatgctcagtgggttcaattatgtggaaaaaaattaaggaatgcctataaaatgctggaaattttcaagggtgttttcccccctaaaacactggaagtaattgggatctgataaattattagcttgctagtagcagaatccccaaataacatgcatatgtttgtaacttgttcatgtttacagaaatataccttatgtgaaagtagaggactgcctattttgtaatttatttgattcttttataactgaacatgtatgtttctcattcttctctaatgtaaacagcatactgtggatatcttttaaaaaaaaatcattgtagctatatcccaaattggcatttaaaagaacctctggaaaggacttgatctaaaatggaagactttatggtaattggttcgtttgaggcttttcatagtcatcattattagcaaacatttatggaattgccatatgtagggcaccgtgacagaacaaataacaccatagctgaaggcactgtatggttcttaagatgatataataactagaaacttcttctgttggagagatggtagtcaacacttttccagtcttctcatacagattttattaatttagccttttaatttttattactcaaaacttcatttttttttttgtttgtttctgaggtggagttctgctcttgtcgcccaggctggagtacagtggcacgattttggctcactacaacctctgcctcccaggttcaagcgattctcctgcctcagcctcctgagcagctgggattacaggtgcccgccatcacgcccagctgatttttgtatttttagtagagacggggtttcaccatgttggccaggctggtcttgaactcttgacctcaggtgatccacccgcctcggcctcccaaagtgctgggattacaggcgtgagccacctcatccggtctcagtttttaatttaattttctgactctgtgcttgtgcttttaatactttcacactgattttctgcttctcaataaggaaagcacgtttgatctggtcacaaacacaaaacaaatggaaccactgtaggccccgatgccatgtgttttgttttgaataacctcataagaactcctggtctcccagcatgaagccctctaagtcagcctgggcacacgccactgcaggtgttggtgcatttgggacagcctagttttgttagaggctgtattgtaggaaagcctgtgacagtatgtcagactcattgcctatagacagcatccccagaaagagagaggggggaagcttttcatatacagatttttaaaatctaggttatctgttttcttactgatttatagtgtttccttccagatgttttacacatgtcagccacaagacataagcattttctaaattgaacagcctaaagtccacagatctttttgtgtatatggtaaaatgtacataacaaaatatattaaccactgaaacttttcttttctttttttttttttttttttttttttttgagacacggtctcacactgttgtccaggccagagtgcagtggcacaatcatagctcactagagcttcaacctcctgggctcaaatgactctcccacctcagcctcccaagtagctgggatcacaggcgttgagccatcatgcctgggtaattaaacattttttttgtggagatggggacttgctctcttgcccaagctggtcctgaactcgtggcctcaagcagtcctgccttggcctccccaagtgctgtgattgcaggtgtgggccaccaagccctgccttaaaacattttttttttgtggtaagaacacttaacatgagatctaaattttaagtgcacaatgcagtattgttaactgtagagaaaatgttatacagcaaatctctagaacttatgcatcttgcaaaacggaaactttatacctgttgaatagcaactgttttttcctcccttcagcctgtgtcagtgacagttctgtgaatttgattatgttagatatcccatataaggggaatcatgcagtacttgtctttttgtgacttgtttattttacttagcataatgtcctccaggttcatccatgttgttgaatgtggcagaatttacattttttttaaggctgaacaatattccattttatgtatatatcatattttccttatccattcatctctcgatggacatttaggttgtttccatgtcttggctattgtcagtaattctgcagtgaacatgggaatgcatatatctgtctgggataatgagtttaattcttttgctgtatacccaggtgtgagattgatagatcatatgataattctacttttaattttttaagaaccttcatactattttctatagtggctgcaccattttttcaccagcggcatacaggagttccgatttctcggccgggcgcggtgcctcacgcctgtaatcccagcactttgggaggccgaggcaggcggatcacgaggtcaggggatcgagaccatcctggctaacacggtgaaaccctgtctctactaaaaatacaaaaaattagccaggcgtggtggcgggtgcctgtagtcccagctactcgggaggctgaggcaggagaatggcgtgaacctgggaggtggagcttgcagtgagccgagattgcaccactgcactccagcctgggcgatagagcgagactccgtctcaaaaaaaaaaaaatgctttttctgcatcttttgagggtatcatattatttttgtccttcattctgttaatgtgatatgccacattttttggtttgtatgtgttaaaccattcttgcatcccagggataaatcccacttgatccaggtgtatgatcttattaatgtgttgtctgattcagtttgctagtattttgttgacatcctttgcgtctgtgattatcagggatattggcttatagtgttcttttttttgtagtgtcttaatcctattttgttattagggtaatgctggcttcatgggtggaaattaaacacacccttggtaaacagcagtcttaaccattgagccaaagaagaaatcaaatgggaaattagatgatgttttgaacgaatgaaaacacaacataccaaaacccttgggatgcagcaaaagcaccactgagagggaagtttatagcagtaaatgcctacattaaaaaaataagaaagatctcaaacagcctaattgtacacctcaaactagaaaaagaataagctaatcccaaagtgagcagaaggaggaaaataatttgcaacagaataaatgaaaacagaatagaaaaaaacaatagaaaaaaatcaaagaaagagttgggtttttgaaaagataagcaaaattgacaaacccttggctagactaagaaaaacagaagacacaaaatcagatatgaaagaggagacattacaattgataccatgaaaataaaaagtatcgtgagactattatgagcagttgtatgccaaaaaattggataacctagaagaaatgggtaaatttctaaaaacgtgcaaactaccaagactgaatcatgaagaaatagaaaacttgagcagatcagtaacaaataagaagattgagtcagtaatcaaaaacctcccaacaggctgagtgcggtggcttatgcctgtaatcccagcactttgggaggccgaggtgggttgatcacctgaggtcaggagtttgagaccagcttggccaacatggcgaaacgccgtctctactaaaaatacaaaaaaattagccaagcatggtggtaggtgtgtgtaatcccagctactccggaggctgaggcaggagaattgcttgaacctgggaggcagaggttgcagtgagctgagattgtgccagtgaactccagtctgggcaacagagcgagactccatctcaaaaaaaaaaccaaaaaacaaaacaaaacaaaaaaaacttcgaactaaggaaagctcaggaccagatgacttcactggagaattctactaaacattaaggaagaattaacactaatccttctcatagtcttccaaaatattgaagagggaacattttcattttaactgtttttaagtgtacaattcggtggcattaaggacatccacaacattgtgcaaccatccccgctgtccatttccagtactttttcatccaaacagaaaccctgtacccattagacactaactttctattcccctggatcccccagcccctggtgatctatgaatttgcctattctggggctcaagtaagtgaaatcataaaatatgtccttttgagtttggtgtatttagtatattttcaaggcttgtgcatcagaattccattccttttcgagactgagtaatattccattgtgcatatataccacattttgttcattcatctgttaatgggcacttgggatgtttctacctttggctactgtaaacaatgctgctatgaaaattggcgtacatgtagatatgggagtccctgctttcagttctttcggatatttactaagaagtgaaactgctggatcatatagtaattctgtgcttaaatttttgagaaattgccaaactgttttccacagtgactttactgttctccagtcccactgacagtggacaaaggttccaatttctccacatccttgccaacagttactttcctttttcaaataatagctatcctaatgggcgtggagcggtgtcttattgttttgatttgcatttctctaatagctagtgatgttgagtatcttttcatgttgaccatttttatatctttggaaaaatgtccgttgaagtctttggcccattttcgaattagattgttttgttgctattgttgaattgttggagttctttatatattctggatgttaattagatatgtgatttgtagatattttctgtcattctgcagtttgtgttttcactctcaatagtgtcctttgatgcacaaaagtttaactttgatgaattccagtttatctatttttttcttttgttgcctgtagttttggtgtcatttttaagaaatcgttgtgaaatataatgttatgaagcttttctcctaagtcttcttctaagctaagagttttatagtcttagctcttaagcttaggtctttgatccattttgagttcagttttgtatatggtttaaggtaagggtccagcttcactcttctgcaagttgctatccagtctctgcaacatttgttgcatccccattcaattgtcctggcagatcaattgaccaaacatgtgaggatttatttctgggctctctattccaaatgtctgtctttatgccaatatcacactgtttgattactgtagcttcgtagtaagttttgaaatcaggaagtatgagtcttccgtctcaagattgtgtgatttcatatgaattttaagatggatttttctgtttctgtgaaaaaacaaaacaaaaccctgttgggctattaagtattgcattgaatctgtagattgttttaggtagtcttgtcataacagtattgtcttctaaccctcaaatgccatagagctttaaagttaattattgtaaattagtaattaacagaatacaattacttttagtttacactatggcttttgagtgtaaggtgtttggtgaattttattcttttagagtaactgtcatcagcgtcctcactgtgatacctagtacgtaacctaaagttgaggttgaagacctgcagtctgcaggcagaatgtgacctgtccttgtgttttatttggctgttaccatttgaccttccttgtgtcttaaattcaaagtaaatatattcatttccaaagatcatgggttttaatataaaaattccgctctggttttaaagaaattagaacatctggcagcaggggctaagtagtggcagccccgcttcagttggtgaagagagcctgtggtctcttcgagggggctgagtatgggtctccattttggtcttaccctctagctccccattccctgtctgtgatgtagaggcagttgagttttcaacctttgttgaaaacgaggaaaagagaacattggtttgaaatgatcttttgtagtaaatatttaacaccatggcaggtttcaagtgaaccaaaaaccacatttcatagcagaatggccctgcgattggttggactccaccctgccccttatcctcttctgaagaggctttctgtgtaatactgtagaatgtttttccgtctagccacttcctattagaagaatgattatttgcggcttgattagcttcctcaggatctacattaaaaaaaatcctgctgggctattgttttgcaagattaatcttgtgaattgataaaagtcattgaaactcaatgttggttagtgttgtttttaaacaataggaatagtattcaggacagattaaaatcagattaaaatattttaagtattgcttttaaaagattaaatacagagcacagactcaagcctgataagctcccagccaaacagtttttacatgtagttttccctgtgtatgtgtagtcagtgaagatgctgaacttgtcacaaaatgtggatgcatgaggcatattattgtaacttgaattcagatggccccaaaattaccccattcactcagcataattggttaaacttggtctgggtgatatctgtaagtcatcaaaggaaggaattttaggacaaggaaaggatggtttgattgttccaggggggaaaaaaccataaaattttaagaaaatcattgttcagggaaggctgcaagcactggtaaggaaacagagttttccaataagttaactgaaatcgggagtaacagacctctgaagagtctatctttgggaaaatctctgacttcattcttgacatgattgaggacttcatgtacaatgaattagcaatgcgaatcatctaggcatataaactggaaggaaataagaaggtttgtagagcaagcaacaccagatactcatgcttgctccagagaagttttccaggaaaagcaaatgtcatcttctctctctgcttcactaactttaaattttgagacctcaggcagtctagtccatgaagaaaacactccagaatgaccgagatacttaagtttttaacaacatttaaaataatatgaaaaataaaataaaatgttgttaaaaacttaagtatctcagtcataatttgtgtccttttttttcttttgatatttgttcagaaatagactcccaacttataatattaataatatacctgtagaaaatagggacggccttctttttttcacattgcacagtctcccccaggtggttctgcctaatctctaggcttaaaattcttccagcctggtaatgaatagaaaatccttacttccagctcacgttaccctctggaatgcccatcctctatttttgtctggtggacaaaaaacgcggcacttggtaagctgtgagtccttccagtatgatgccactcaaaactgaagtttatcagtctccaatcctcagccccctccctaccacccgtccaatttctttggctgttagccttgccattctcccagttgtcagaattagaaagctggactcattccaatccttccttcatgtcccctgtccaagtatttctcatctgtcactttcctattcacactgctcctgcctttgttcatcatcttttgcctggatgaatgcagtggcttcctaactggtctcctttctatacttcatctttcctgatcacaccctcctaccttccaaagtatgcatagcagggtcatgcacacgctggaagggagcccaagcacactttccttggagaagagttctgaaggctcagcccctcatcctccgtagctgtcgctctcctgtgccaagtccgtgcatgcctctgttacagctcttctcagttgcagcatgctcactgtctccatgtcctcacctcacattcacagcgtgcaccttacattgtaatcctgtttctctacatctggatcctgtctcagagtatatatgctccctaaatacacatgttgagtcttgtttacccagtgtgtttgtttgctagagctgctgtaacaaagatgccacaaatggagtgacttaagcaacagaaatttattgtttcacttttctggttttctggaggctagaagtcccagttcaaggtgttagcaggactggactccttctgaaggcactaacaaagggcctgttccaggcctcgctcttggcttttggcagcgtaactccatcttcacgtggcgctccctctgtgtgcatgcatgtctgtctgttcacatttcgccttctcagaaggacaccagtcatattggattaagggcccaccctgctccagtatgacctcctcccacttacatcagcagtgaccatatttccaaataaggtcacattcagaggtatttggggctaggatttcagtaaatgaaatttgaggccctattcaacctataagacccagtggctagtgtgttgactgacataactgtaaagtaatcaagtgaaatgatctttgaataaagggtcagaattttattttcttcaaagttatgtttatgacaaataaaagcttatgatcttgggaatactttcccatctctagttttccagtatattcatagtagctgttgaattgttgcgcgtcaaaagatgctggtggagtattctagttctagctctgtctttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacattttgcaccgcccttaatccatttaaccctgagtggacacagcacatgtttcagggagcacagggttgggggtaaggtcacagatcaacaggatcccaaggcagaggaatttttcttagtgcagaacaaaatgaaaagtctcccatgtctacttctttctacacagacacggcaaccatccgatttctcaatcccttccccacctttcctgcccctccactccacaaagccgccattgtcatcctggcccgctctcaatgagccgttgggcacacctcccagacggggtggtggccgggcagaggggctcctcacctcccagtaggggcggccgggcagaggcgcccctcacctcccggacggggcggttggccgggcgggggggctgaccccccccatctccctcccggacggggcggctggccgggcggggggccgacacccccacctccctcccggacggggcggctggccgggcggggggccgacccccccacctccctcccggacggggcggctggccgggcggggggccgacacccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggccgggcaggggggctgaccccccccacctccctcccgcacggggcggctggccgggcggggggctgacccccccacctccctcccggacggggcggctggccgggcggggggctgacacccccacctccctcccggacggggcggctggccgggcggggggccgacccccctacctccctcccggatggggcggctggccgggcagaggggctcctcacttcccagtaggggcggccgggcagaggcgcccctcacctcccagacggggcggctggccgggcggagggctgacccccccacctccctcccggacagggcggctggccgggcggggggctgacccccccacctccctcccggacggggcggctggccgggtgggggggctgacccccccatctccctcccagacggggtggctggccgggctgaggggctcctcacttcccagtaggggcggccgggcagaggcgcccctcacctcccggacggggcggctggccgggcggggggctgacccccccacctccctcccggacggcacggctggccaggcggggggctgaaccccccacctccctcccggatggggcggctggtcgggcggggggctgacccccccccacctccctcccggacggggtggctgccgggtggagacgctcctcacttcccagatggggtggctgccgggcggagaggctcctcacttctcagacggggcagctgccgggcggaggggctcctcacttctcagacggggcggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggcggggcagagacgctcctcacttcctagatgtgatggcggctgggaagaggcgctcctcacttcctagatgggatggcggctgggcggagacgctcctcactttccagactgggcagccaggcagaggggctcctcacatcccagatgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccccgtctccaccaaaaccagtcaggcgtggcggcgcgtgcctgcaatcgcaggcattgggcagactgaggcaggagaatcaggcagggaggttgcagtgagccgagatggcagcagtacagtccagcttcagctccgcatgagagggagaccgtggggggagggagggggagggggagggagagggagctctgtcttgatgatagaataccacttagtttgcaatacagttaacgtatgaataaactaacaaagaacaggaagggagagatgcctatgaaatcttgaagatggcaaacagactgagccagcaaatcagaaaaggctgagacctcatcttagccgggaggagccaagtaaaagcaacctcatttgcagagcaaactcagatctgagagatagaaagcaccagggcctctgaagacatgctgaggccccaggggacatagatgaaactaaatgtgagcatttagccccctgaatacccctccctacctggcagtctaggaaaagacttgaggtttacttggggagagtgggcccagcagaaggtgagggactgagcagtgaaagtctccctaaccaggcccggggcagagaactgactgaaggattcctccctggagaggcaaaggccgctcttgaccttgtgcatgtgcaggaaacttccagaaacttccaaccatcttcttagtgttcccttcttaaatgtgaattagatggcttaggatcaccaaagacttcaggaacaccttgaacatgaacgagaacaaaacaagaagaaaaagcaacttgaaggcaatgtagggaatagacaaagacaagttcttacctcaaaggagagaagagggggcataacatctatgaagtaattgtttgaaatttaaagacgttcagataacaaagggttcttggaaattagaaatgtggaagcagaactaagaccccagtagaaatcttccagaaggagaaaacaaaaagaaactagaaaagataagtagaaggtcaatctaggaggtctaagagataactaatgagaatttcagaaagagaatagcagaaacacaggactgtgtgtgtccaggccaacagggccactgagagctcaggccagtgagtgatgaaaagagcacaccaagacatgttaggttgaaagttcagaataccagagattgggaaaatcttggaacttttattttttatttatttttttttttgagacagggtctcactttgttgctcaggctggagtggagtggcatgatctcacgtcaccgcaacctccgcctccctggttcaagctatgctcctgcctcagcctcccgcgtagctggaattacaggcatgtgccaccacgtctggctaattttttttgtatttttagtagagacagggtttcaccatgttagccaggatgatcttgatctcctgacctcgtgatccgcctgccttggcctctcaaagtgctgggattacaggcgtgagccaccactcccggccgtatttttttttttttttttttttttgagacggagtttctctcttgtagcccaggctggagtgcaatggggcgatcttggctcaccacaacttctgcctcccgggtttaagcgattctccttcctcagcctcccaagtaactgggattacaggcatgcgccaccatgcccagctaattttgtagttttagtagagacggggtttctccatgttggtcaggctgttctcgaactcccaacctcaggtgatctgcctgccttggcctcccaaagtgctgggattacaggtgtgagccacagtgcctggcctaatttttgtatttttagtagagatgaggttttacgatgttggccaggctggtcttgaattcttgacctcaaatgatccactcacctcggcctcccaaagtgctgggattacagacgtgagccaccgcacctggccgggatttacttctatatgtaaaaaaacccagacctgcacaaaggattgggaagattggctttagatttatcaatagcagtgctgaaagctagaagacctcaaattctgagggaaattatttccagcctttaatttagcgttcatccaaattattgacaagacgtgtacataaaataaaaacctttttgggatctgtcatgtttgaattttccattcacacaccctttcttaggaagctatggagcactgtgagccactaaaacaggaagttgagaaagagggaagtactgagtcaaaaccaaagaaaggggaaggaattttcaggactcatgagagctgtgccgaggcagagagagtaactggtccagatgaagcagggaaatggagggccagaggagggatgcattctagaaaggagggactgaaaccagtgggtcagctagtgtgtctgactacactgaagggaattttactgatcttttctgacaatttcagggagaattggtagtcaatgcaatgcgtgtgaaaccaagcaagtaaaagaagatgcagttgcttactctaatggggaaatagatgcctagaaaggaattgtaatcacagtacgcttttatgttataatgagatagaccagatgcgtggttcacacctgtagtcccagctctttgggaggctgaggcggaaggattgcctaacaccagtaagattctgtctctacaaaaaagtaatgaaaattagctggatgtggtgtggcatgtctgtagttacaactactcgggaggctgaggccggaggattgcttgagtgcaggagtttgagactgcagtgacctatcattgcaccactgcactccagtttgggtgacagagagagacctttctttaaaagtaataattacaatggaaatgaagtattgatttgaccatgggacaagtgggtggatgggtgtagggtttggcagtttaagaattaaaaacattggaggataatatctggactgaaaagatacagaaataaaacatgttgtgtagaaatgtggagataaagagcaggtggaaggcctgatagctgtggaagcacagtctctgcagagcaggctccacttgggtggaagctgtccttctcgtgtgagctctagccttgtactgtgtggcttctcaaactgtgtgcttggagtcacttgacaaaaattaaaattaagagaatggaaacttgccatcttgcataagtttttttgtcatttaatttgtcaacttttagtaggtctccttgtatggagactagtacactgttgatttagaaatacctgcaggttgatactagtttagtgcagtatcttgaagaaaccaagagcatagactttagagtcagttgtttacttgggtataaatgatgagctactgcatgctaggggctgttcccagataacagtggttaggaaaatacatgaggcctctccccttgacgaagtcacattctagtgatgggagatggacactgcagatgaatgagcaaggtcgtttcagattgcttgagagagataaaacctggaatgggttggaggagaaggccttccacggaatgcccctttgagcagagtcctgagggtgagaccaccacacttgcttgggaacagcaggggaaggcttcgagttctgggagttcattagaattcaggacagtcatcctcaacaagagaggacagttggccttgaggtgagacagaccctggcttgtgacatcaagggtggtgctggactggagggatgctggagtgtggcaggggctgcatcatggtgggccttgcaagccacattagccactctgaattctctggaatagaagagcagtgtgttctgccttgaggtgattcagagtgctgggtagagactggatcctggagggctcccagtgcccacctgacaagtagtacaaaagtgctgttgaggctgggccctgtggctcatgcctgtaatcccaacaccttgggaggctgaggctggggaattgcatgagacttggagtttgagaccagcctgggcaatatagcgagacctcatctctgcaaaacatttaaaaattagccaggtgtggtgctgcacgtctgtggtctcagctcctcagaaggccaaggcaggaggatcacttgagcctggaagttcaaggttataatcagccgtgattgcaccactgaactccagcctgggtgacagagcaagaccctgtctctaaaaaataccaaaaaaggtgctgttgtattttacaccatgcaggttcatgtgtgcttacacacacgtttatattccttttattcattctttttactcgagggtagcttttcctgctgtcgtttatgcatttattagtagttaggtggtttgaaccccagaaggttaactaatagccagtgcagcaagcagtaaatatactgactagtggctcatacttgctttattacttcagttttttaaattgttgataattacaataatgcacatgggcatgggtccaagacaggaagaattattgtctgcaagcagatctgctgtaagctggtaatacagtctgatttacttttaaatttaaatgccacataaatcacaggaaagatgtcttttaacttgctttgaatttggaaagggtagagcactttcgtatttttgttattttcatggttttaatgggcattagaagttaaattgatttgttatatccagattgatatctgagtgttgtgtgcacctaataaaatgtttagcggaatgactatagaaatttgtatttaaagtgtaaagtttctctctccctgccctgtgaaaatcattttggcaaattgtcagattttcttgttataagcaaagatatgggttattcacccaagaatttcatgcctttcagcatagcagaaccttagaaatttaaggaccaggtatggcgactcatgcctgtaattctaacactttgggaggccaaggagggaggattgtttgaggctgggagtacaagaccagcctgggcaatatagtgggaccccgtctctgcaaaaaatgtttgtttaattagccgggtgtagtggtgtgtgactgtagtccctgctacttgtggggctgaggtgggaggattgcttgatcctgggaggttgaggctgcagtgagctccagcctgggcgacagagtgaaactctggctcagaaacaacaacaacaaaatacccacaagaaaaacctaaacctgtgatttccagtgtttggtttttatggaataatggaactaagaaaaatgttttaaatagataaggttgttcttggttaatattacagaagaataatttttaaaaagcagctacctgttgattgttgccatcattttatgaaaccattttaataacaaaaggtagaagataatgttagaattcaggacagttattcttcagcaaggaccattagcagttctgtacccttacgcgtggatgtgtgcacaacacatgcacactagacctttcttaggtttctcatttttcaggggggccactggaaaccttttgtagaccctgttagtcccctagtggatgctggggacccctccctgctttaaaacactggcaaaaatcatcatatatattaaaacatggatatttggccgggcgcggtggctcacgcctgtaatcccagcactttgggaggctgaggtgggcggatcatgaggtcaggagatggagaccatcctggccaacacggtgaaaccccatctctactaaaaatacaaaaattagccgggtgtggtggcacgtgcctgtaatcccagctacttgggaggctgaggcaggagaattgctagaacccgggagtcggaggttgcagtgagctgagatcacaccgctgcattccagcctggtgacagagggagactccgtctcaaaaaaaaaaaaaaagatgttttcagttgcatgaatttgttttcttattttttcccagatacgttaaaggaaaagagatctagtgaagtcaatttcagatctctgacattggttattcatgtttgtggttttaacctcttgaagtcagttacagcatttcagccaaagctggcatgttggatagtttctcaacttagccttggtaaaatcactaattcaagtgtttatttagtgaaatagttggtcagaaaaatggaatattttaaaaagaagtgtaattttttacaagtacatgaaatactcaaactatgcttaatctgatttttagtgactggcttaatgcatataaaaacaaagtatatatcatagagtaccaggtcagccagaggaagcttataatttctgagagtattgccaggtttgtgcttggatattctacagaaaacccttcatcatttgtattatttctgtcatctgaatcaataagaatgatttagaataaacatattttattattaatatttaatgagtagtacttctgagtgttacttgaaatcatttcactcttttaaggtttagaaaacatatccttctacatccccccacccctgctctgcacgtactagtcagcacactcttaataactgcctaagtaatgctggccagtgagttcaaatgttaagcccaacttcacaccatttagatcatcttatattaattctgaggcctcctgccttcctgacctctgcagttagcatgcctgacaaagtatgagaaatgtctggtttgctttggagtcacagtgaattctgacttagtgagggaggccatcttcatttctaagccatgtttctcctgcatggggagttttaggaaaatagagttccatctgttatagtgtgaaaaaaagttaatattgtaggtgtctcatttaataactaaactttgagtagcaccctatttatgttgcacaaaagtgaaaactaaggtcaagagagattaaataacttccatgagattacatagcaaggaagcagaatgtccatcaggaaaaccagtttagaaaaataatttacatagtgctcttctgatcacagaagtgttttgatagttgcagattcatcttgacttcacttccaagtcccggaagctgggctagagccaggaagtcagcaactcttggccattttcttttaaatgtattaaatcattcatctaaacgtttggtgactgaattcccacaaaatatgaagcattaatgcaacctgctttcctcatgtccatagttaatgtgtgaagaaggaatgtgcactcttttaaacccatttcatgccatcctggatttgggaaggatggccagtcatgtggggactttgtggcctcttcccttgtgcacctcgggttcaagccccagttctgcgcaattgcagccagagagtggaaagagccagcctgatgatgatggtgatgctaacgtgcttgctctgcggcaggcattgtgctcagtggttctgcgtgttattttaatcgaatcctcacaacaggcctgagccgtcggtatgttaataaccctgttttgtagattaaaaaattaaaacctggtaataatgaaagctcccaatgcttgaagagcgcttctatgtgacaaacacttttcaaacacttaacatatattaactcatttaaacgtcagagcagcactgatgtgtagttattattgtcattaccttatagatgacgaaagtgaagcccagagaggctaggtgacctgccagagttggcacagccagtcagtgatggaggtggaactctgtcatggtgtgtctgcgccttaaagccacactcttggtctttctcccaggtcagtagtacagtgagtagaagagtaatggttggccgaggccagtccctagtgtctccataccccctggaaataagtttcatggacttcctattttataatgggcaatcagaaaaaaaacacagggactgatgaagaacctgttcatttgagaatttcaggtgtgtaaacactgttctgcgtggttttttttttacatgaaagtattttatgtatttgtatattttgaaaaaacttcccttagctctcatgtcagagacacatactgaaagacagacctctattaaatcatgatgtttggctccttaccactataatccagatggacaaattaccatgtttccataaaaagcgttggagacagcctaaaccattttcaatcttggaaatgatacctcatttatactttaatatttaaagctctaataaaagctggagttatttgtataaattactgtctgtgaaaataatacctaacagccggcatatgtcactgtaagaataatgtctttttacacttggagttttccccctacacccagttcaccagtttctaattagaattaagtttaaatgttaaaaaatcaaaagaccaagaattttccattcatgtaatgcaaactctaaataataggttttttcattttactgctatacaaccggaaaatgcttaacaagaatcctgctattttattagatagtggtttgaagcttcacttctctgctgctgaaaaagatactcttaaagtttcaaactgtggtcactgtttggacagtaaaaaaaaaatgtggcatttcttacacattaggctctgggtcagaatcgtgatagtcttccaattgcagaaaaatagaatttaatatgtgtacaatggggctttactgtattaggatgtgtacccgtgtgttttgttgttgttgttgttttttgagatggagtctcgctctgtcgcccaggcggaatgcagtggcgtgatctcggctcactgcaagctccgcctcctggtgggttcatgccattctcctgcctcagcctcccgagtagctgggactacaggtgcccgccaccgcgcccagctaattttttgtatttttttttttttagtagagacagggtttcaccgtgttagccaggatggtctcggtctcctgacctcgtgatccgcccacctcggcctcccaaagtgctgagattataggcgtgagccatcgcgcccagcccgtgtgtttagaataatacacttttcaggtattgagcctgttccgattttacttactagttgtgctacctcaaattgtgtgttctctttttgacagatgagactcttaatattgaaacgatgcattccagattgaaatctaggcatataataagcagaattcaaaaacactgtattttgaacaaattttagactttaaaaaaagttgcaaaaatactacaagagttcccctatactgtaaccctgtttcccttaatgttgacatcttgcataactcgtaatgcgatgatcaaaaccaggaggtttgcactggcacagcactgttaactgacttacagaccttattcaaataattgctgcagtttttccactaatgtccttttcctgttccgggatcctgtccaggcgcctgcattgcatttacttgtcatttctgcttagtcttctcagatctgttgcagtccccggtctttcctgatcagcaccctcaaatgtctcattgtggatgagattaatgtaggtgtctgatgtgtgtctctgctctcaagtaattgttttcccttttgtagctaatatctttggggagataccttgaaaggatactgagaacagaatttttttttttcacttcgttcagtttagtaaatctttggtgaaggttcatgaacataaatttgttctaatttgtgaaccttgaagtacttcagcgcttgaacaaatatgaatgaaaataatatataggattttcgtatcttttaacagatggtccttttttactgacttttccttaaaaaaggtttttgaacaagagcgtcgtacctttcgctatcagtagtttgctagtggtaactagatgcctcgaaggcctgcttcattccgcgtttattagaactagaactgtgttacattgccttcgcagggtgaaacttgaatactcgtgtgtctcataaagccggattcctttcaaagagacctgattcttccactagtgggatcaaaccatgttcatgggaagatgctccctctatggcaggcaccttcagaagccctgcagccagatttgatcctggaatagtagcttcaatgagggcagagataactgggtgtgcacgtttgctttggagtgagaggactgcctggtcctgagggctttgtgaagggaggtaggcttagatgagcccaggagttgcatcacttgaggtgattaaaggccctgatttaaagtaggttgagacttagatttatttagatttacatatttatttccttaagccatttcaggttttcgaccaagttactagaagcactttttaccaagttgaatttctgtccttggattgctaaactgttccccaagccaaattaataaaatggaatttcttattaagaatgaattattaagcaaaatggaagtgctgggctagggaagcagttgatgcaatttgttttccaagccttaaaagtgctgcagtatgcatagatcacaaggactggcttcagtgccaacacatggggcattaatttttttggtagaggattccaggtttacaggatatcagaagtgctgacttggcagcaaaatcccatttgtaacatgttagattaggaaacagattgatttatatgttgatgtaatggatcaaggcacagtctgtgcttaaggaaatggacagcacattaaataagggcattttcaaggtagaagtacaaacattacagaaaaaattagccttttacaccctaggtagggttggggtatgtttgattagttgactcctaaaacatggtccacagaggctttttatatttccgatgataccttcttgagagtctcttaagaccacaaggattaatctttctgaactcaaaagtgaatcactacagcatattagctgtctggattgattccagtttctctgctttttcttggtggtaactgatgtgaggatctgttggtgcttagctgcctcttcctgttgctttaacctctggtattttaagattctctttagggaagatagtactgaccatctcagcacagagccgaaatgcacttagcgctgatgtgttgaccttagtggttgacccataaactgaacatttatacagttggaactcttgcggtcttttagccaacaaccataatgagtaacatgtggaacataatctttggtgctgataaatggctttttacgatgaaattgaccattccacgctgtggcttgggtgacctcatgtaactaattactgtttcttagctatattcacttttggaatttaaggggtaaatggtttctccttctgcaggctgaactgctgacagattaaataccacctgaaatctgatttgtttagtagctgtctttaatgtaaaaatatagaaggccagagggaatctaggaaacactgctcagaagctttcagacttaactataggagttcattcgtagcaggtttaggaagcacattccttccgacctgtagattgggcttttcatatacgtatttatcatgtcttcttggattttcttcatttaattctatctgaactttcgaagtgggaagcaaaggattcgggggagagcactggtttcagtacacgaaaatatccctggggtttccttacctttatctttggatatccccatttttctcgacacacaatccaagtttctagccataatccttagattacaaaagaacaggacttttggtacacatctttttttttttttttttttttttttttgagacagattctctgtctctgttgcccagtctggagtgcagtggcgcaatctcggcttcactgcaacctctgcctcctgggttcaagcgattctagtgtctcagcctcccaagtagctaggaccataggcacgcgcccccatgcctggctaatttttgtatttttagtagagacagggtttcaccatgttggccaggctggtctcgagctcctgacctcagatatccacctgcctcagcctcccaaagtgctgggattacaggtgtgagccaccgtgccgggcttggtatgcatcttgaactaagtgtgaagattaagcacatctgtcttgtgcatcctttataccttttaatgatttgtttgaattaagcaccactagagtattacctatgaataggtgtgtgttccttcctacacatatctttaggtgttttttccttctttgggggaagcaggaactcatattagtctgtagcttcacgtgcattcatactgaaggcatagggccttctactttaataaatgaatattcgttccagcagggtaaagtcaattctagttaataaaggtgctaattgtttgttgggtttaactgaggtgtttttcagccctgatagatattggcaacattttaattccaaattagctttctcccagctgtccaacaagggttggtgcttccttctcttatactagtagaaagcaggttcattttaataagcttcgaagcaaaacatatgtcagatggtaaattggtcctggaaaaagaccataatatatttcacaatcaaatttaagttactgattagaaggattgttcatgtctgtgtagttcatcagcataaataaattaaagtttcctagaaaatcatacattttccacatattttaaaagtcagctaggcgtagtatctcatgcttaggatcccagtcctttgggaggtcaaggcagaaggatcacttgagcccaagagtttgagaccagcgtgggcaacacaatgagaccccatctctaccaaaatataaatacgtgtatactgggtgtgatggcgcatgcctgtggtccctgctactcaggagattaaggctggaggatggcttgagcccagggggtcgagactgtaatgagctgagattgccccattgcactccacgtgggtgacagagcaagaccctgtctcaaaaaaaaaagggtgggggcatcaaagctaccctttcttgttagtaggaaaaccatgtcatgtatatgctgtttttgaaaagaacaacatggtagaccatataatctaaccctcctcctctacaagttttaacttaagaactgttatttgtttatttattttaattttgaagaaagttttgcagttggggactcttatggctataaccacgagtaatggatgtttttagagagatgcctgtgcttgtctctctctttctctctctctctccctgtctttctgtctgctttttttttttttttttttgagatggagtttcgctcttgttgcccaggctggagtgcaatggtgtgatctctgctcaccgcaacatctgcctcccgggtccaggcagttctcctgcctcagcctcctgagtagctgggactacaggcatgtgccaccacacccggctaattttgtatttttagtagagatggggtttgtccatgttggtcagtctggtctcgaactcccgacctcaggtgatctgcctgccttggcctcccaaagtgctgagattacagatgtgagcccccacgcccggccgatgcctgtgcttttctcgtgcatgtctgcaggagccttgctgttgtaatgttacttctcagctatagcttctgagctgttaatggttagactgcacataaaaggatatgggccaaagacagatcttatggaatagttgattatttttacccaacatgagagaaaattgttcatgaaatcccctttagtgttctgtgtttatgaatgatgccatcacattttgaatcatgggagccaaacttgaaccttcctcttcctcatccctcatatcagttatcacacctaggcctattttaggctctgtggtttcttgaatctctctatccaccactccaccttagcccaagctaccatttattcctctcttggaatgtgcacctccagtgtcctgaatgatttccctgcatacactcatttcctttcagtcggttcttcaccgtgcaactagagaaagcatcagagctttgttatgaaaatagtaactttctgcttaaagcctctcaacacttcagtggtaaggactgaagtcctttcttggtctgcagactcttgtcccggcatgcctctcccaccatctctctgcctcaaaatcaacattgcctccatatgggatgcttaaagcgctactcagctgtcactctctttaggaagcttccttgatcagcttcctacccaagcttaggtcagattcctttttttttttgagatttgagtcttgctctcttgcctaggctggagtgcaattgtgcaatctcggctcactgcaacctctgcctcccgggttcaagcagttttcctgcctcagccccctgagtagctgtgattaccggcatccgccaccacgcctggctaatttgtgtatttttagtagggacggggttttgccatgttggacaggctggtctcgaactctcgacctcgtgatctgcctgccttggcctcccaaaatggtaggattacaggtgtgagccaccgcgcccggcccagattccttttttatgtgctttctcaacactgtgttcttttccttcttaagacatttgggaatgtggtcacactttttgtgagttttaactcttgcattagagccccaagaaagcaggtcatgacttttttgcccactcttatatcctaaacacttagcatgttgctttgcgaaatagtagttgctcagaaaattttcttttgtgggtaaattaagtaaaattattggaattttagtaattctccactttcatgatttggtgtgtgcaaaggattagaaagtagattagcttttacgaggacagactgcagttggattatatgttctaaagttagaagtatcccagatggggattgagggttagatttttcctttgcctaagtctcaggatacaaaatcaatgtgcaaaaatcacaagcattcctatacaccaataacagacagagagccaaatcgtgagtgaactcccattcacaattgcttcaaagagaacaaaatacctgggaatccaacttacaagggatgtgaaggacctcttcaaggagaactagaaaccactgctcaatgaaataaaagaggacacaaacaaatggaagaacattccatgctcatggataggaagaatcaatattgtgaaaatggccatactgcccaaggtaatttgtagattcagtgccatccccatcaagctaccaatgactttcttcacagaattggaaaaaactactttaaagttcatatggaaccaaaaaagagcccgcgttgccaagtcaatcctaagccaaaagaacaaagctggaggcatcacgctacctgacttcaaactatacttcaatgctacagtaagcaaaacagcatggtactggtaccaaagcagaaatacagaccgatggaacagaacagagccctcagaaataacaccacacatctaaaaccatctgatctttgacaaacctgacaaaaacaagaaattgggaaaggattccctatttaataaatggtgctgggaaaactggctagccatatgtagaaagctgaaactggattccttccttacaccttatacaaaaattaattcaagatggattaaagacttaaatgttagacttaaaaccataaaaaccccagaagaaaacctaggcaataccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaaccttgggagaaaatttttacagtctacccatctgacaaagggctaatatccagaatctacaaataacttaaacaaatttacaagaaaaaatcaaccccatcaacaagtgggctaaggatatgaacagacacttctcaaaagaagacatttatgcagccaacagacacatgaagaaatgctcatcatcactggccatcagagaaatgcaaatcaaaaccacaatgagataccatctcataccagttagaatggcagtcattaaaaagtcaggaaacaacaggtgctggagaggatgtggagaaataggaacacttttacactgttggtgggactctaaactagttcaaccattgtagaagacagtgtggtgattcctcaaggatctagaactagaaataccatttggcccagccatcccattactcggtatgtacccaatggattataaatcatgctgctataaagacacatgcacacatatgttcattgcagcactattcacaatagcaaagacttggaaccaacccaaatgtccatcaatgatagactggattaaggagatggcacataccatggaatactatgcagccataaaaaggttgagttcatgtcctttgtagggacctggatgaagctggaaagcatcattctgagcaaactatcgcaaggacagaagaccaaacaccgcatgttctcactcataggtgggaattgaacaatgagaacacttggacacagggtggggaacatcacacactggggcctgtcgtggggtggggagaggggggagggatagcattaggagatatacctaatgtaaatgacaagttaatgggtgcagcacaccaacatggcacatgtctacctgtgtaacaaacctgcacgttgtgcacatgttccctagaacttaaaatataataaataaaataaataaaaaagttttttcctttgcctttcactttgatcatacacatccagaagtcactttttattctgttctagctcctgggaaaaggatttgtttgtgaagatacaaatagtaaataattaaggtttttaaaagatgcattctgtcacatagacctgaatgactgttgcctctgtgctagccttcttggagtaaacctgcaatttttttccctttggtaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggaggtaagagtgttgccagtaagttgaaagtgttatttttctggggcagggttgaatctgtttaccttagaaatagatattctgtcattctcttttgacctaagaccaagatgctaatgactggagccccaagccttttgtttctaaatgtgtggcatgactgagacctctcaaaggctttgcctgcgtgttctgtgagctctcagttctttaaggaagggatactgcagaagcctggcaagtgccatgggagtgcagcctgcttctcatcctcccacttgtcttggaagatggaaaacaaaacatgtctccttactgacagaaagccaccagtattgtaaaggatcatctcaggtctgattcaactctgtgttaaagagaaaatgataggagatgttataacttgtatttattttttctgatagagacagggtcttgctacattggccagggtactctcaaactcctggcctcaagccatcctccccagcctcccaaagtgctgggattataggcatcagccaccacttcttaccaagatgagcagacagggccagggtcaagttctgtaatttcattgacagatgtttccatagacttgcctcacggagccatcagttcaacagctaccctacaagcaaacttgacatctcatgaatttgttttgggctaaaagcgtgctgcttttgtttgtccttaaatacatatcccttttgaaaacagaatgcgtggaagtgttcagaaatctaacctgtcaaaactaatacagtatctttttgtttgatgacttcagttagagccagggataatggagtggaactttagatgtatgtaggataagggtggaggctgaataaacttagacactccatccttacttgcaagtgtgtgtctgtctgcagattgatttattgtgtgtgtgtttgttttcttaacagatgtatccagagctacagatcacaaatgtgatggaggcaaaccagcgggttagtattgacaactggtgccggagggacaaaaagcaatgcaagagtcgctttgttacacctttcaagtgtctcggtgagtgttcttggttacttttcaggaagtgccagccccctcccattttaaatttaattttctcttggctcacagtgaaatatttacacctgttaagaagctgagtgtgacatgaatttattggggaggatttctcttaggggtgtttgctggcttcgagtgtcagtggttgacctcctctcagtgatggctaactctgccttcccattgtagacatccttcctcaggactgaataagggtgctacccacagagcaattgcacttacgccctcacattgtttgatatcagtggtttatggtgatagtgctgagtagtattaaagcaagcagccccaggagaagagtcttctgtttcccttactttcatcccacacacgtttgcaccatttgaccaaatttctgctagttttcaggagaaagaaaagtgacttatggcagcctgtggacagtcaagggtaccggggccagggcttataggacctgccattctgaagggtttggggctggtaggggtgttcgtgactctgtgttgctggtgtcaacattcagagccaatttgagtaaaacggtaactgtttgttatgcagaaacagagttgttgcttcaaatgctcagggaatatattcattttaactatttgtgcctgatacattggaattacactcacatatctgtggtctggtgattcaggaacagatttggtcacagaaacttcaaagggcaaaaaaaaatcaattttagattagccctgatgggattaaagtagatacagcattaatgtagacatcctgagtggttctgtagctatatgtaattggaactattaacttattctcctctctcccttctgtaaaacctttccttctgcttctgatggcagcaaaatggaatgtgatactttttctcattctcacgtgtagccaagccacaggaagaagcggtgcccctgaacaacagtgtttaaaatgtgtggcagttaactttcttttaaaatattcgtgaggagcaagaggggcgtcatgtgtgcttaccaccgtttactttaaacctgggcatctcaaggctgggaggcttgttaaaaatgttgtgtggtgtggtttaaggacgctttctgttctgtttggctctgagaaatctctaggtatgaggcttcatttgctcgttaaaaaagttctcaaactaaaagtgaaatgagattatcctggaatatttgtagacagtggatagaaagtgcttgaaatcgttccttctgcattgctccccctaaagactttgcagcctgattatctcctcttgtttgtccttgtcaccttccagcttcactccccacccagacatctgagtgggacctgggagactcttcgattcttttgttatcctttatctccctgtatgcggtcagtttctgagccagcctcatacttacttcttaaataggcttatagtcatgattttcaaactgtgcgccgaggcacctcggggcattgaagcaaaactcacagggcattccgggatgtttctgatttttcaagggaaatgtaatgacatctgtcaggcattctgcaaactactagctggaagtaatttacagtttcatcatgacatcatttcatttattttgatgacttcatatctctgtgaagctgtttttagttattcctgtgataaaaagcaagtatcttttgaaaatcgctgaaaaagaaatgagggtgatggtgttcagtctgattgcagttgggggagatgtgcagggcccactgggcactaaggtgacaggacacagtacttattaagttgttgggtctaaggtgacaggacacagtacttattaagttgttgggtctaactacttaacttttcggtactttttttagcctaggaatcctgtgaaaaagttcctaagacactcagggtgctgtgagtcgaaaatgtggttatcgctggcttgtgtcctcttcctgcatcagattcccactgccctagctcagcctgtggtcagttcttgtctgggccgagagcagcctccatgctgtttctcagtgctggctgtccaatctgttgcctgcagattgaaaatgaagaccaaatcatgtctctcatgcacaaaatcttaaaaaagaatgttgaaactccttagcgtggcttcaaaactccatgatctggcccttgctcaactctcccctgttctctgtgatgtcatgctttaggttttatcagcatcgaccaccccagggtggtcgtgcaccatccagctctcagcatttggaatggctttcctctgctgactttgcttgggaagttcttcctgcaaggcttacctcaggagttgcctcctttaaagggagcctttcctggtcttattttctatccattcatccaggtttctgtaatactccttgctgttgccatcgcacttatcacactgtaccatgattgttcatagacctttctccaactatgctgtgaacaccttgccagcagcgaccctgttttagtcttttttgtcaacctcagcaccatggtagtgcctagaatatcggatatactgtttacgataattacaacacaaaaatactactatagttggtacacaacagaaattttattttattgctttatttcccaaatgatagagtttaaatttgttagcatgttacagaaccaagcaatagtattgtcgttaatgaaatgcataaaagacagtttaaccataatccatttggtaccttctttgcattgtggtcactgaataaagcattatacaatctttggtgttacttcagacggttattcatgtttaccccagcatccatttggacaacttagtaaccagtcggtagagctatccattgatatttttacataagcacagttgcctgagcctaaacgaataaggggtgacatgactggagtttaagggagggagtaggaaagacatattgcagttctcccttatcagttagattttgatgtctccctgccccttccgctgtcacctccacttcgagcacccaggcagaactgacatcattcagttaataatggccaccaccttttccccccatagactccttagaaagccttttgatgatagtcttttagagttgctattgcttttttaaattaaaaaataatagtttaaaaataatttcaaatttacagaatggttacaaaaatggcacagagttcctctgtgtacccttcacccagatttcagattttccaactgttaacatttgatcaatgtggtaaaaaatcttattctcccttcccagtacccctcacacacatactcgaggtttgttgttttttgaatcatttggcaataaggcaaacatggtatccttatgccttaatactacagtgtgtatttttaaaaagcaaggaaattctcctacgtaaccgtggtataatcatcaaaaatcaagattttgtagacaatatctagttgatccaatatctcatctacagaccctactcaggtttcacctgttgttctaataacatccaggatctaatctaagattacatgttgcatatttccttgtcctttgtgacattgatttttttttttttaactacagaccagttcctttatagaaaagttttcaattagcagtgatcacgcctccgataaacctcactggctacgatactgccactgcacaaagctcagttcctttatagaatgccttgcaatttgtgtttttctgtgatccttttgatttattcatttttgaggggagtatcacagaagggttctcactgcatcatagcaggagtagtgcgataccagtttgtttcatcacctggctaagatggtatctacattcatttgtcttactatgtacacattgtctgcatttggccagtgggggccccgttatgctggttcctgtgtccttataacatgtccctatcattctttgagaactttactttctgatacaaaagattctccaagtccattctgtattttccctactccactcctggagtctgttttctctgagacaccatggtttcttttagtggggaatgctattttgaaacccagatctgggccttaggtgatttgttttttgtttttggttatttttggacagagatttggacaggtagtgttattgcgatatgaaaactactaaagttctgatttaatatctactttgaaaacaaaactggtctcggcagctttgaggtgctgtcttctgcatttgtaccttggtctgttggcatagctcacttttccattgcaggtgtccttttgcaagtcttctagcctttgagttcatgacagccactgacagttcaccctgttcctggtgtggacccctgtgcaaggtgaatgttccactctcgagaggtagcgtggatccttcacttctctgaaccctgttttccctgaaacatacctggggtgaccaccagacctcattacataaggctgttttctcccacctgggtacagcttttaccagctccctaaattacatggttttcctgtttgcacctggagtgtacttttgtagtatatttattattatttttttaatttttaatttttgtgggtatatagtaggtgtctgtatttatggagtacacgagatattttgatacaggcatatagtgtgtaatagtcatgtcagggtatgtagtagatttacttatatgcatgggtgttggtgttggaggcttcctcaagtaggtaaacaacctttgttatttattctgaaaggaatttcagcaactctgaaaaagctctaaaacctggatggctgccatagcactgctggagagaagtagtaggaaagaaaagctgaatcacagggatgattagaaattggcgataaatcctaactgcagcttaaatgaatattgtataggttaggttttgctatattgccatattcattgatcagcaaaaacagtagagctttatgtttgtccagtgacttaggaaattgtggcaattatattatactccgctgataaaattgaggatgttaccagcttgaatataaattactaaagtgagagcaaaccattttcaatgttctgtaaaacagagtaatactgatctgcctaggtaaatttttttccctaggagcttctgatgaaaaattgtagcaaaggcagagagtagcaatgaaatgatagagcggatgctgggattgaaatgtgtttcctctttcagtctactttttaaaaaggggtttatttttcaataaaagaagtttgcattgggggaaggggacaaaaacaattattttcagtttctgtactaagttaactgtgattaacattttggggtatagatgaacatttttttctttggatacacatggaaatgtatatacttttaaatgttttttccctaactgtgatgatacaacgtatgctcctctgtttaaagttctgtttatttttatttggcatttattgagcttttattatcatgtgctacttttagggatacatacatctttgaataaaagataaggttgggagaaaaaaaaaagataaagttggccttaagtaactagcctgaagaaggggttagagatacgcagtgggtttccttttgtttgtttgttcaatgattttaaaaattattaaaccaccatggaaaaatgtccatgttaaatatacacataagccatatttcttgtaaccccatactattctgttgtatatatgtatcatcatttaattaattccctctcgatggacatttaggtttgttctagttttttgatattaataacactaatgaatattttaattcacttgcctagttatttccttagggtgtgtatctttttctttttttctttttctttttaagacagggtcgccgtcacccaggctggagtgcagtggcgcgatcttggctgactgcggccttggtcctgcgtgtccccctttccaccctgcagctgagattacaggcattcgccaccacgcctggctcatttttactatttctagtagagatggggtttccccatgttggccaggctggtcttgaactcctaacctcaagtgatccacctgcctcagcctcataaagtgctgggattacaggcatgagcccctgcgtccagacatccttagggtatctttttagaactggaattgttgaatcaaagagtactgttaaaagatatatatatatatttttaggccaggcctggtggcttatgcctgtaatcacagcactttgggaggctgggatgggaggatcatttgagatcaggagttcaagaccagcctgaccaacacggtgaaaccccgtctctactaaaaatagtaaaaattagctgggtgtggtggcgaacgcctgtaatgtcagttactcaggaggctgaagcagaagaattgcttgaacctgggaggcagaggatgcagtgagccaagattgtgccactgtactccagcctgggtgatggtgtgagactccatcttaaaaaaaaaagttaaattttagaatttagtttgttttcaaattcagtggtgttcttttttgatttttagagatcgaacagattgattcagtcatggaatagctgaagattagtggcatttaattttatggtttagcatggaattaattattttattaaatttttggcatttccgaaaaggttttgattttaaactttaattctgaaatattacaccaagcatcctgaagagatgagacataatgtgatggttgctcatatgctcaccctcctgatttcagttcttcagtgttctgtcatgtttgcttcatctccatctttttttttttctgagacggagtctcttgcccaggctggagtgcagtggcatgatctcggctcactgcaacctcagcctcctgagtagctggaattacaggtgcatgccaccatgcctggctaatttttgtatttttagtagaggtggggtgtcaccatgctggccaggctggtctcagttcttttgcaacatttacatgcatctataaacaatgtttttgtgttttaaaatttacattaatggcatcatactgtacctgaccttttacagcttgcttttactttacatcattttttagtttatccaaggtgttgtatagattgagttaaaggttgtatttctgaccaggcgcagtggctcacgcctgtaatcccaacacttggggaggccgaggccggggtggatcacaaggtcagtagatcgagaccatcctggctaacatggtgaaaacccgtctctctactaaaaatacaaaaaaattagacgggcgtggtggcacgtgcctgtagtcccagctacttgggaggctgaggcaggagaatcacttgaacccgggaggcagagtttgtagtgagctgagattgcgccactgcactccagcctgggcagcagagcgagactccatctcaaaaaaaaaaaaaaaaatagttgttgtgtttctatagaatatagattagtagtgaaattgctgctttaaatttttttgatgttgcagttgcacatttaaaagtgaggttttacaaattaaagtgcattaactgttgcttaaatatacattgctttatgagtatggttgaatagttcgtataaaactagttcctcaagacttcactaacattaacatcaatagtgcctaccaggtgtcagtttctgtttttattttaaacaacaaacccacatgtggaacaatagtttctgttctaagcttttcttgttgtatagattatgtcatttagtccccacaagataaagaaaccgagggacagaaaggttaagtaacttggctaaggttactctgctagtaaatgacagtgctgagattgaaccctagcattcaaccctgcatatacttttcctttagcatccacttttgttgctttttgtcataaatgaacaaaaacagcctagttaattcagaataatcacattaaaccatgtgagttggtggttggatgtcagaattgaagtaatttctacttagattgagtatcagggttgttcattctcgtagaggcagattctagcttactgttggtatttttgctatttttaagcaatgcttttaagtctcgttgattgctaaagcctgtttgcaggtactgcctcccctagagcctttggggtcctcaagggtaagcagcatgtcaggctcactttcgcaatcctgcttcagtgtcacattgagctgtgtgatcccaaagtccctgtgctagcagtgctgagaaacctgactgccatttgtaatgcagttttcatgtggggggactgttacactgctacagcttgtcatgtcaggagcccatcttcccctacttacacatcagcaactccctttctcttaccactggggcggtagaaagactgacttcagtgcttgcgcccgaggcccaaggcagaggatcctgagagactcatccatgatggcgaggctgggtgggtctgtgtagacttcccactagctgggccctaagccctttcttagaccacattactttctcatgatattttcagggttttccccccttaacctcagaggttagtctgccagctgcatcttcctgccactgcttcctgcatctcttcctgggctaagcacccttctcgccctctcttcctctccctctacactgtgtggagcacatggcagacgtatgcccagtgtagattactgagccttaccttacactactgatcagagtcttggggtgatcatccagtgatgtgttgtatatttctaactttttattgtggcaaattacaaacatggccaaacaagagacgatgataccgttcaccctcacgtactggttgcccagctttgtaaccaccatcagttcatgagccactcttccaccttctataggcccactccctcacaaccctgattatttggaaacaaatcacataccatcttttccctgtaaataaacagctatgtgtatctttctcccgactttttgggacaagttttagaaaatgtaatagtgaatatctctgtaccctttacctagattctccagttttacctgatgtttttctctctctgcatcttatatgtatatttttgtgttgctaaaccatttgaaagtaagttgggatatcacgacagttcatttctaagtatttcagctggtttctcctaagagccagggacattcttctatatataatgacaatacagttgtcatgtttggaaattttcctaagtgtccaactagtgttttttatagcttcctttttaaaaggatcacatactacatttcatctaggatagttccctagtctttctttagaaacaaaaactttcatgacaatgatattttttaagagtccatgccatttgtttaatgtaatgtccctgagtttggatttgtcttagtgttttagcatgattagattcaaatgataatatattttggcagaaatactgtgtaggtgatatattatttttaggacatcacacacaccagtttgctcgttatcagtggtgttaaattggttatctggctgaggtagtttgccaaggcttcccaccgtaaagacacctttgcccctttgtaattaatcattgattattcttactggattcaattattacatcatgttttgtctaaagattcatctgtacttgagtagaacacctggttttagtttcttgggcatttgattacagaggtgtgggcaggaataaggaaggcagagccatgtggggagagtagctgtgtgtgtctgaggcgggcatggaggtgatcctattatattccccgtcacgtgttgctgtagccctgcagtgggactgcagtcagggggcttttaaaaggtccctggcatcatggctctgacagattggtgagttcttgtggctgcttggctagaactgtaccatccagtcagcctttgaaggtacgagatgtgcatctgctcgtatacatgagactgctcctggctgtgtagactatcatcataaacttcagtgaggggcattttcaccttgaaatcatggtcagatccgctctgacaaagattctcttttccagtgggtgaatttgtaagtgatgtcctgctagttccagaaaagtgccagtttttccacaaagagcggatggaggtgtgtgagaatcaccagcactggcacacggtagtcaaagaggtaagagaactcggggggaaagtcagctgctgttgtatctgttaggagggaagtagcacttttctccaaatctcaccatgcttttaagttagttatgtttcccccattatctccttaaggtttacaattacttctgtcttataagttagaaatatttgggagagaagtaggtatttgtgtaggagagctcagtgttgacagtcagctcctgaagttgaggatgttaaggaggtggctgagcgagaatactgtatgctgctggtgaggctcccaggaaaccatcctaaccctaaggccggcatggaaatcgccagtgatagaaaatataggtctggacatatgcacaggcaggactgcatgccatctcacttttctggtggcaagaagtaccctttcttgtcttctgtaattaggctggctctgctctttggtcagtaatcttcctttggtcaaatactgaagtagtgcttgcaccagtggtgagtatctattaacattgaccaccttatctggctttagtcattattagaaaaaaatgctctcttcctgacttttttccacatttgggatttcagtatttttggaccagatcatgtttccccattgtaaattaaaatttataaatcttacaataatattattacaatttttttttgacagaaaatgtatgtgttcataagagaaagcattgctaagtgatttgataagggtttattttggagggtagagatcggagtgtatttgaccacgtttactctggagtatgttctgatgtggcctgtgggtttcttttaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaaggtaactcttctactttgaactgtgaagtcgttttgcctttttgttagcccttctgtaaagacggctgttggctgctagtccctcacttctggataaactgggcattcctttgttctgctagagttgattaagcttgcatttcattctagccattgccaatcacaggagtacctgtgatttttgtgtttacatcattctgagctgttattttctgcaggttactatgatattttttaagagtccgtgtcatttgtttaacataatatccctgaatttggatttgtcttattgttgtatcatgattagattcaaatgttcacaaatacttcccgtttgctgatgtagctgggccccagggcttagtggcacggtgaaatgtgcgttgagcttatttcctgcctctgtttttgtgtttcagaatagagaagggacccattgttgtgctttgcacataggagctattaaccttcctttttttctattttggccttcagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaaggtaaccccatgtagagccatggctttgaaatccatgtggtaattattcacttagacttttgcattgcgtctgtcacaggtaagtcagtcacagaaggaaaggtgtggtacctctgcactgaaggtgagttcagctctccagtgcagtgatgggatggtgccgtcttaacaaagtgggcaggcaggcacatccagggagagatgtaggattgaattagagaacggggactagagagtaagagagacaacgtagtccgcccttcagcaggattcttccacattcatcctaaaatgttccctccccaaggggagctcccctcttcgataccactcaagttctggcctcctagaatagaaatggttttcttggtttttcttttcctgcttgtcttctaatctgtaggctgccctatttgtccagatgttttagttgggagggtgaaatttattgacctgctggtaacagattggggcctgcagttttttttttttctcatcttgccaattaaaacacgaaaaggttgcagtagttccagagccattaacatgcagcctcctgctgatcgtatatttgaaaccaattaagatgcgaagaattatttaggacccaagttgggggaaattacttaaccagttgagaagtttgtgatttgccttagagaacataaaagtgggaaacaattgtccgttctaggtgcttgtctttactacgggtatcaccacttaaagcagcctttccactcacactgtctcctgaatagacaaactaggcagatacctccactgaacagatcagaaatgtgaggctctcgcagctgtgagacaaaggaattgctctacgtcaatctaaactcagatctagactccagagggtgccaaaaaaatatttatcccagttcctaaatgtctctactctgtggggaagcaacttgtcctcagcaaggctggcctgagctggagctttcggccaccgggcctccaggctccgtccagtctcaggcctcccccagcccatcccccagctcgccagcctgtagcattttgaagcatttgacgtcactgcctctgtcctgctgacactctgaccattttcacacagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgagtaagtcctgcctcgcgctggtcccgtgcggcagcaccgtcctgtctggcgtccgtctccctgccgtcttcgtggctgcatctgtgtggtgtccctgcccactcgggtgtttgctgtcggtcgtcttcccctcatctttgtgctttctagatctaggctttgctctcctgccggcagtggtaagctcagttctcgtgtcctgtgctcaccgtgtgtctggtggtgcttggtggtgatggtgcgtacccaccttggtatagcgggcagcacagccaggggcttgttctttcttgtctggctttggagtctgcaggtccccaggccactgtagtattggtggggaaggcagctgtcccctgggctggctctagcttagaggcactgaacattcctgtctttgaactgccctgtcactgacccctgtgatgcatgccagctcatggggcgcctcctctcgaaaggagtgacagtgaagtactttgggcagtctagaatattgaaatatcttgcataatgcactctagagagagctagcagccaagtggtagtgactcactctgtttcttcaatattttgcaaccgggtcacacagctttaggaagtgagaggatttcagttggtgtgtgctttggtgtgacaggaaggtcagtggttcagttgagttgggtttatgctggacgttggtagaaagagtttctaccaagagttttcccttttctccatggctactcctttttctcgttaagaccttcagtctctcaccttgcagcactaacctacacattaggaaaatcctcaggccagacagtttttcttggttcctactctggaatttgttggagtaataatttgctatgaagaatttggctatagcttctgacggtttttcattcacatgccttcatgttccctcttccttccttctaccaaaagatctttcaaatcttaatgtaatatggcagtgccttgagtgcttcccttccagctccaggaaagctgtttttattcggtaacagttgaaaggtgaaagaaaaggaggccttagggaaccttggtgaataaactttgcgttttcaggaaagatttagaaatagaaattattgtgatacttactgctttgtaaaacttggactgaagcctgaggaatcccactgagtgtggaggtggtgatctctacccgaagggtcagctgggtggtgctgtgagacatgatggagtggcaggtctgtaaaactcccgtttgctgtggcttggatgagatttgcctcggagaagctttgtgttcatgttcttgtggggcctctgcctggagggctttgcaggttgagaagcatcaagtttacttccagtgggagcgtttttgttcttctttgaaggggctgaggctggcggatgtgccggcttcatgagtgggtgattccacagggaccgagggtgtcttcagaaaaaagcatttcggcccgctgtcctctccactctggtcccagggaggctggaagcagcctgtgtttgctgttccctttttccagtccagcaatgtgaaccaaaggctccgtctccagcgctcaggcctttatagcacaggcatgtgtcactgatccgcatgatggactgcagtgcttgaaattctcctccactgaacttgcgagtgtcttggggaatggcatttaccaagttatcgattctaatttagttaatctgaaagtgggatattgacacccttttaaaacttatgtagggctcatattcttcatgactttagttgtcgtttttaggtctgttaaatgggcaaataaaagatgcttccgacagaaaaaagttgaactggctggctaatttgtagctgtattcatcaattatatggttgttttaatgtattaaaatgatacaattctagaaattaggtgaatttgcttctgaattaaaaatcagttgaaccttggcattcactctccacttagctctgaaattgtgtcataatctatcaagcaagtccacaccagcttgggaaatcttgcatgaattaggctagtaagtgttaccttaggtatgtcttgagaggctgactgagtaaacttgtcatctcagtcctttcccttatcaggctaaattccatcgtgcagagacttgcttgggccccatgagagattatgcccatccagcagtcgggggtgctccaatgggcctgtgctctggggaacgcttgggaagccctattggtcagtgtcatggatcaaaaagccctatcttcatatcggtgaaaggtgtccttgtcaaatagagcaactcagttttatccttgttggttctgtcactgatggtggggctaagagtccttcactgatactgaaaactcaaaattatagctggagtgatggggactttctctacccagcgtatatgcaaagaacattcacttgagcctgttttctgttgtaaattaagactcaaagatagccagaagagcagaggtacctgagtaataaatttctttaaaaataaggaattgcataaaagtgcctctacagggtctgattcctgcccttgtctctgttcagatgctcagttacgagcaataaggtagctattgtttaggtttccagggttcgagcactgaagggaaggtatagaagaaaccacctctttttcagccctgaggtcttaagtagatgcctcactggtgctgaagctgccaataaattgctgtattagcgtgggctgacatggttgatgaatattgtgtaaggaagattgcccactgtaatctaaccaagtgaagtcttggcagatagcagcaccctgcacttagagaatgccacaaaacaaattgagtccatcctgcaggtcctgagctgggttttcttcctagagcacagtgcatctgatcccaaagagaactccctctgtaattttgtttcagttcctccaactcctctgccaaccaatgatgttgatgtgtatttcgagacctctgcagatgataatgagcatgctcgcttccagaaggctaaggagcagctggagattcggcaccgcaaccgaatggacagggtaaaccttgacaatttcttcatcttcatggtacttggctttgggtagcatggttctcatagctgaagaaaagtaatagcttctccctagattgtcatgctgatgtataaggactggtgagtcaggagagagttaccagtggagctgccttctgggtggacttcttcaccacctgcatccagataatatataatataattatcctctgagcacttcctataccattatctgccctttttttttttttttttgccattaacttgctttaaaatttctttattttaaagaaggaaactttatatcactgttatcaataaaaagctagtaccatttgccgtgagaagaaagtgaccaaccatacaaatatattagatgaaagcaaacatgtactaatacatgctagctagatactgctgtctctggaaggttctgagtctcagagatgtttcttttcctttaaaagggttataagagagcagcaggaacaccaaagtgcaacttttcttctggatttactcaggattgaagagaattgaaaagggaatgccttgctaggcctaagctccaccccaaatcccacacagtcccatgttgggcttacagtttgcaaaatgcttattgttttatccacatcagctctgaaaagtaggtattaacctcaatttttttggtgaggagactaaggcacagagacttttaaataacttactcaaggttatgtaacaaagaggtcatggaattgaggctccatctggggatagttgaggcctggaaccttctgaggcagtaacaatgctaagctcctaagagattgtgtgattggtttccttttgcagtttcctgtgagatttagcatctgacagtgtttttagcaaatggaggagttgtttcggggtattaatcactgctgacggcgtttttgacctttgttctaggtaaagaaggaatgggaagaggcagagcttcaagctaagaacctccccaaagcagagaggcagactctgattcaggtaagatgccttctctggggacatagctttcagcctgaccattggaaaatacggtcagagccccattcccaacgaaattaggattggacaccacctccttttaggtgagggcttacaaggaagttgtaactggcctgtttttctttttcacctcaagtattgctaacctatggtagaaggaaaccaaacccccaccagagcacacctaattcatgccagaaggtaaccttagctcagctgcctttcgttaattctgctttcctggcaaaagtcctctgccattttcagtcttagactgtgacttgtttttcagcagtactgaattttttttaagactaattgaaagtcaaaggatagaaaataaagatctctgatacaattcatctctaactttgtagactataactaaaatcatagcagcaaactgcattccccttcagtagaagagtgttgctaggaatagggatagcaatttccaggactgatttggtttttacaaaactgattttgtaaattttaaatcattttatgtttagctgaaatgcctttcctcctaatgtaacactttaataaagtgttaaaaataatcttaaaaggcttttttattgatcacttagaaaatctaacagttttaattcctacagaagtcagtgcatcttgttcagggaaatgtagttcagcaggcttaaactgtacctgtaaacctggctggatacctcacggataacttgcccttcatgactttattgatagtaatggcaaaaatcacaattacttttgcactaacctaatgacaggaatacttcaacagaacttaccacataactcccattggtcagtggtctcagagtttggaagttagtgccttgctgcaatgtgggaaggacagtgttctttttttatagtgcatattgagaaaccaggccttgggcttgcaggcactagcacttgtagttacacagatactaaggaggccctttgacactgaggtttaacttgctctctttaaagaaggaagtaattctcctgatagaagtagaatgaaggtaggatgaagtagactttggatcttacccttgctccactctccgaacctgttactgtctcgcatgggcactgacaggagaagcactggggtctcagggtgcttgcttaggcttcctctgggtgccacaaatcatgtgtggttcctgctttcttggtttagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacgggtgagtcctgcccctagcactgcctgccctgaggtggtatatgtaggggaccaatgtatgacactcaggtcagtaaaagtgacatttgtatgacaagttctggcaaagctgaagctaaggaaagatgatgagggaggaaaaggtattacattctaatatctgtgtatataagctaagcatgacatcgctttatgcctgcgtataccacctgtgatgtgaaagtgttttacgctggaaaagtataacctcgcgaaattgatgggtaattatccagttattgaacttcctttcaaagaatgaaaacatgctattcatgaagacttttgaacaagttacattataaataagattatgaagaaaggggtaaagtaatttcttctgaaactcttgtgtgagtggtctcaaatgattttgtcccttaacactaacctgccttgctttgggggatggaaagtattgggaggatatttgtgtccttaagtaagccggttaaagtcttctctctttgggtgacacaggagactatctagcttataggtgtcagaggctgagccaggaaaaaggacagatcagaagagaacgggagtgggcaggagattctggaaaatactgtatgttaaggagccagtataactttggaacttagttttgctattttacctagacagtttttttgttacttggtaagctaaaaaagccttccagttacagctttcattcttgtgcctagctgagctttacattcttaagtgaactttttaagcttttgttttcctgcctattttcaattctctagtctctggatattaaaacaactgttctctcttgcagcctcatcgcattctccaggccttacggcgttatgtccgtgctgagaacaaagatcgcttacataccatccgtcattaccagcatgtgttggctgttgacccagaaaaggcggcccagatgaaatcccaggtacagtagatgtagtagaaattgctgccgtgagggcatttccagtggggaacataatgccttgactaatggttgaccagcactgctagttgcatttgctactagtccttagaaaatgagttttgatttccgaagacattcggtacgtgaactggtttttgcaaggtcactgtttttaaaacatctttttaaatacttttttatattaactgctttatacttaaacaatttctgaattttttatatcatttatttctgatttagggtattgccagaaccaatattcaagatccttttctaggtatatttatcaagcagatcttaaaaattggtctcttgttttgtgcagtatagtttttgtttagacagacacttttacattcctaggttttgtccagctttactttcatctacagaggtttgtttctggttcctacttctaatattggtgttgttcatatattaacttgagttttacttttttgtattcataaaaatgagcttgcctacaagactgctagcttccgtttaaaccaggaagtctcctagctcagccttagttttcctagagggccttatagtaacaacgctgatcttacttgatttcctctcatattgtaaatacagtgctgtgctgattgtgagtgtcagggtacatgggctcacttactgcacgggtgctggcctgtcagcccagaaaccctccttccccacagctgctatgagtgtgaagatgaaaaggtaatgtgcctaaaggcctaaaggcctttggagtattggagctgagctgctccatttgtggagctgggggtctgtctcagtgccagactccacactggcattcagtgctgccgggttgactcccttgagtgcccttgagcagctcacacgctagtgtagagataataactgtaaaggtgaagagcaggtgtttttttgtctgtttgtttgagatggagtcccactctgtcactcaggctgggttgcaatggcaccatctcagctcactgcaacttctgcctcccgggttcaaatgattctcttgcttcagcctcccaagtagctgggattacaggtgcccaccacagtacctggttaagttttgtagtttcagtagagacggggtttcaccatattggccaggctggtcttgggctcctggcctcaggtaatccgcccacctctgcctcccaaagttctaggattacaggtgtgagccaccactcccagcctagagcaggtgttcttagatatacagagttcacttcagaagctggttgttttggggaataaaagaactcaggcttctaaagagtgggaagaacgtggaaaggggctgggttggagaccctaaggggcatctggtgtgggcctggagctcaggactttgcttcacgctggatgtagcagaagaggagaaagtccaagaggcctggatggaaaacgcatgcatcttgacagggcctaggctcttggggtctacttgattttttgaaaagacttaatcactttccaaactttctggtttaaaattaaattatcgtgttgtattctagccagttttgtgtgagagtagaagggaaggagagattttgatcagtatattaaattaatagagaattcctgcaagtgagatcaagcttccacaccaagtaatgtgggaagtagaatgctcccatttaaacacctttggggagaaaacccagctctcctgtctgctacttactacctgctcttagctttaattctggcaaagcttaccttctgccttgttccctattctgttatctaaacaccagaaaaatttgcagatattcagcctgttgtaacttgtgccatgtctgcttgtctggatatgagtgagatggtgcttttacccccatactatagccaatggtttgctgtagagacactaatttgcagtctcccgctctgtggttcttgtcctctgtgagtgtatgaaccttcctgtctcacacggctcccggttcctctgggaggtgtagcaggacaacacttgctgaacccgtgggtgttgcattttggcttcatttgcattttttcttcaaggcactcactcttgtgctttccttgattgacagaatggcaaatataaaattaaattgctttcatccttgctttgaaaggtcagagagatgtcagtctacaataaaagcatctttccatttagctttttttttcattttgatccttcatgttaatggcttcaggcccacataattaatccactggtttccagcaccctctttaggaaaagcttggtaattgcaggtctaaccaggcggggatgacttagcttgaaaagcttgtgggagctacagcaacacacctcgccgtgtcattggggtggatgctagcccgtcacctttcacttccatcctggaaaactgtaaaaatagtgaccacttctaatggcctttttttttttttttaaataatgaataaccttagaacttttgcattcagaaaaggcagtgagctacggtagatgagtcttcctttatcacccccttaaaatcaggtttatttatacctcagcatgagtttttcaaaaaatagcaatttagttaaataggaataaactaattctttatttaccacaataatcatttaagcaattgcttcactaagcaaaatccataatggttccctctgttgccaagtctgcttttcagccagtaatttcagtcttttttaatcccatctaatctgaccagtggtagaaatcaactgactcttctttcactcagcaaaaccttactgaacattcggcattgtacaaattagagttcttttttttttttttggctcaatataattagtagtaagtgccttgtatgaaaatccagtagctagtggccatttttaaataaattgtctcttaatttggagcactttccagataaattctcatgtcagctgggggaattatacagtctttttttttttttttaagacaggatcttgctctgttgcctaggttggagtgcagtagcacagtcatagctcactgtagcctaaacctcctgggctccagtgatcctccagccttagcctcccaggtagccgtgactgcaggcacacagtactatgcctggctaatttttgtatttttggtggagacagggtttcatcatgttgaccaggctggtctcaaactccttcgctcaagtgatcctgctgtctcaccctcccaaagtgctggaattacaggtgtgagccaccacgcccaggctgaacacgttcttatactttagcagtcagtaaatatggcgtgaggattaatacatttcccctgaccagttgctttgctagactctgtagagaatatgctttgtaaagtggtttttccagaagttgtgtcgatgttccagctgcaagttccctcctggcctagttgttttcagtcacaacacctctccaccataactctgcttccaggtgatgacacatctccacgtgattgaagaaaggaggaaccaaagcctctctctgctctacaaagtaccttatgtagcccaagaaattcaagaggaaattggtgggtaccagctctttgtgtcaaggtcatacgggacttcttgcagaggctcaggagtgaaagctgggcaagagtagagagagatgagcaagcaaggccggtgaagtggggcattagcacatcctggcttcagaagcctggagtccactggagctttcatggcaaggtgaaggaggaaccaaggacaggtgcactggctgtgagccatggagcctcgggcttcactgaccttcactctgttagcggaagaatatctggggtgtgaaattgcaagagactacgagtttcctgttcccgttttcctccttcgttctgattatttcaagcacctgattttatataaattctcacctcctcctctcccggtctttatcttcttcatttattcaacaagttttattatggctgctgcgtgcgtgtcacagagtaaaatggtccacgagcagatggtacctgctggagttgatgtgttgataagagaaaaacagatagtaaaacaagaaaataagtgtcagctggtgataggtgctgtgcagtgtgaaaactcgggcagagtgctagagagtggccagtcggggcggctgcctctggggacggtggcctgagatccgaatggtaagatcacagcgggagagcacgttggtagcagagggagcggcagctacaaaggccccaggtggaagtcaggcatcacatttgagtagatcagtgtggctacaacatagcaaaggggatgtggccaaagtatgcagggaccagatgaggaagaaatttcagcaaaatcaaggagtttggattttattctaggataatgggaagccgttagaggattttcagctagggaaagactagatctggattatgaatttttaaaagctcacttggctgctgtgtgtagtcgattaaaattagaaaccagccaggaagcgattttagaaattcaggagagagctgttgggagtatgcactgaaggggtgacggggtaggagaaggagcaccccagggacagctggggatggtctgtaggatgtgttctggtgggagtgtgtggggctgcgcccagggctgcgtgtggggttgggggagcggcatcaagaagtgcacttagggttccactgggagcagctcggggatggtggtaccatggctgactgaggtggagaaggaaatccggagctctcttgatacatgttaagatagaaatttctgttggatgttatgtggggatgtaggatttaggtgaggcagaggtcaggcagtaggtccaggattcgggcctgggagtcatggtatatggtcagtatttaaaactggcgtcggggagaagtaggtcagagggtatgaagtggtagttgtagttacgtggggtggatacgtctagagatgggatggacagcatgaggactgtagttagtaatatcgtactatatactaaaaatttgccgagagtagatttgaggtattcttatttttaaaaaaaagtaattctggaaggtgatgtgtgtgtttgcttgactatggaaatcatttcatggtgtatatgtatatcaaagcattatattttagaccttaaatatgtacaattttttaaacccccaaaatctgtggagttgtggataccacttaactggagtgtggaggtggatgcaggggtgcctgggacggcgccctggggtccctggtgttggggctctgtggtgccacagaatcaaggaaggtgtttcaggcaggaactgggagccacagtggggtcttggagctctagagcatcctgtgcctggacaccaggcccttctgaagcctgctttctgtcccctgccctgtcttcatcagatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggtgtgtatgggcgacggtgccacttctgggcagcagggggaggacaaaatgagagaattgaagtcagtttttcgaaaaccaaattgagttgggagatggtgttcctgcgagagtcaggggaagggagactggattcattgagcgcctactgtgtgcaaggaccctgctagatgctttcaaatcattggtgtcaatgtcaccatgaagttaagactaattctcccatttcaagatgggtggcttcaaacccccacttcttccaacttgtgcacttccttacatgggggaggcacttggcagttgaaacagcgccttcctgttatggtgttacctttgcccagccgtcttgggaggtaggtgctggagaggctgaggaggtgacagggctggcgtgggtcatatctctgacatgaggtggggataagaagctgttcctctgggtcctaggcagacgttctttcctctattcccctgctggttctcagtgtctaagaggatctctaaaagctgtgagtctgctccagaaataaacaagttgctgagaccagtgccctgagagccgtccccctcatcagttctgtttgttgctgttgctgctgacagggtaatgataagaatggcccacagctatgccgtagtccttgttatatgccagctttagctaagcatctcagcggatgctctccatcctcacagtaaccctcgcaggtgggtagtcgagtgtccccatgtggggattctgaggtataaagagattaagtaacttgcccgaggtcatgtagcttataagtggagagtcaggggtcgaatccaagctgatctggtcctgcagtcacagacctgactggatatagcactggaacagaggcctcaggaaggcatcaaattaggggtggggggatggaggtacatccagcttagccttcagaccttaatggaaatgctttctaaactagcgatcccagagcagttgactctccagaaataaaacaggatctgaggaagtggcagatagatgaaaaggcgccatgccacccgcaaatctccgtgggtttttggggtggtagatgaagaggcaccatgctatccccaaatctctgtgggtttgtcgggtggccatgcttggacaacttcttatgtgcttgttgggggtcggggcagcttggatatacctgaactaggaccttatctccctgtcagcaaaccacaaccaacacttaacttcaattttcacttttttctaagaaaaataattatgtgggctaagctaaatagtgcaggcatctcccagtttccctaaaaaggcacaagacagacctacttttttctctcttatcaaggataccctccagtgatttgctgtggctcatactgctggtttgtttatgggatatttcaggcagggtgtttttaaggaggaatactttttgttcacattatagagaaattctaagatagaaattttaaaagaagccattttcttttttaatctccttttgtgctattttattttgttttttattgttttcctttctgctagacactcagccggagttgtaccacccaatgaaaaaaggttggtttgtccaagatgttccctttaagaccttcattcctctccactccctagtgtgtccgaagcttcatgttctgtttcatgccatcacctggctttccccacctcattccttctgacacggctgtgagtggggtcagagcagccccacctccatgttgctgacaagctgacctgactccagcactctgaggccagtttccatggtgttggttacctcgtggtcatgctaagctttccctctgggatgtcagagaatgcacagcaaccaaaatagatttcatgacccttttaatctgggtagatttttagaagtatatccaacttaggttggttgtgaactgctgtctccgtataaatatgccttatttacagtcaggtggagagtcgttctcttttccctctttttctctgcaattcccatttacatcttttctttttggctctcctcgccctttgtctgtgccagttgtctcatgtcccctgagttgtatattcctcagaacatcggaagccaatggatcaaacagctggagacaacccagctcactgtactgagtctccagttttcaaaaagagttaacgttccgtaaagcactatgtggaatgctttgcattcttgtccccatcttagtccactgaacgtccctgtaggatgagtagtgtttttagctctattttctagattagacaattgaagaagtttctgagatgacgtgacttgctctaagaagtggaggaaccaggatttgaacccagttctctgttccccaagcccatgtgatttcattacctgagttgtcggtgtcacgggatcccccaggtgggtgggtggcccagtcattgtgaatcatttcaacatttcttgttcataatgtgttgtatgagcccacccttggctttggcagacttcctgttgatgggccaaacggtgttgcccggctaagaaggtggtgttctggtttacgccacaggttattctcagaacacaaaagtgtgatttcaatcttctgaaaatgacttcgtgtagatgctttattttattctacttggatatgcctgttcgtggggatgactgtgccgacattcctttcaacagcacaactgagatgtttatagagaaagatgagttttctagaagtttaactggcttttgcttttgtactgaactgttatgagttgggacaatttaaacattaactttggtgtcttgaagtcacttgtttatgttaagaaacgtgggggctataccaccaaaaatctattataacagtctggactggtggtaggttttttttttttttttttttttttgagatggggtcttgctgttgcccaggctggagtgcagtggtgcggtcttggctcactgcagcctcctcctctggggctcaagcagtcctcctacctcagcctcccaagtaggtgggaccacaggtgcatgccaccaccctcggctaaatttttttttttttttttttttttaacgtagagacagggttttgccatgttgcccaggctggtctcgaactcctggactcaagtgatcctcccaccttggcctcccaaaatgctgggattataggcatgagccactgtatccagtgacagtagacctttagtttgctcagtgccacattgctttttgaataattcctgcctgtgtgacctttaaaattctgggagagagaaacatatatatggaaggagctcagaattacagttgattgggcttggtcataagcatccttgctgaggcaatacccttccagatccctctttctcaaatagttggagtgcagtattgctatttcatgggcactttgagacaaaagctagctctgatttaactagaatctagtcgtgcaagtctttaaagttgaagctttagaaaaattgcatcatttttggctgcattgcatgagctagcctgcatgttcagcagctgtggaagctgttacaagttgctatgtgttaagaacaagtctagttgtgaggcagaagctctgctgtggttgtgccttgtgccattacctgcctttgacaagcccagggacagcagtgctttgcatgtcctcatgttgaagtctcacttgcaggtagttaccttagaatgccagatacgctgtcgggttgatccagttataaaaggctcatatcacagacgtttatattgaactgtatgttattatgaataaggaattcttatgatagctagaaatcacatgctttggaactaaaaatagaggacttcctctcacgttccctccctgggcctgtgctgcgtcgtcgtgctgcgtatttggatactatccttcggagcgccacactcgagtgatgttgctcaggcagtgtctgaccttggtgagaggagagttgctgttcttgctgctctgtttagagaaaggtgccttccatgctgatattagaatgcttcctataggtggaatgcacgcttcctgtttatcttctaatagccacttaggatatgagcatctaggatctcggcacagagggattcagcgtggtgggagatgcgggaagaaatccgtaatgacagactgttgtcattactgttggaacctccccaggaccaactgaaacttgaagggaaaataagagtttaggttggggagggtatttgaggcagaatgaattccctgtgggctaacctactatgtccaaggcaaacgtgcaggttattgtgaggatgggtgctgtggcagccgggtgtgggtagtaggtgctcagtaatttctcctacgatggtgtgtatttcccatgctaggatgcccctcggctccgcttctatgtgtcttacaataaacattttctctgaaggcttgcatttcattttcccaagttggagacaagtaagcactccctcctcctccattatacccattggtctctgcaaatgcctgtctcattcatctttagagagcacagggcaccctcagacttgtgaacatggtggcagatgagtcgcgtggggaggtgcgtgttgaggggctcactggccctcaggagggagtttgctgcttctgtgcaatgggtgtgagatgggccatccttgggaactcagccatgatctctctccacacaggatctggagtgggagagcaggatgggggactgatcggtgccgaagagaaagtgattaacagtaagaataaagtggatgaaaacatggtgagcctgttctttcttctgcccaacacgctttacttttgagactcattagagcgagtgacctgatgtcagatgcttccaggtgcacgtctctgtgttcgttttccgcacagtagaaggttggagggctccaacggctcccacagactggctgtggtgtttagcatctgggtatgaaaaggattaaaaagcccttttcagcagtagctcatctcttgctatagagtaggaaaatatatttacaactaaagatatgaataacctgttagaggccattttcaagtgagtagagagttaataacttggattagagttgggttttgttcttatactgccttaggtttatacccccttttattcacctagtattttctgtcatttatagttctggattatcttcaactgagtttgatatttcaatgtggctttttttttttttttgaaatggagtcttgctttgtcaccgaggctggagtgcagtggcatgatctctgctcactgcaagctccacctcccgggttcacgccattctcctgcctcagcctcccaagtagctgggactacaggcgtccgccaccacgcctggctaattttttgtatttttagtagagacgaggtttcactgtgttagccaggatggtctcgatctcctgaccttgtgatccacctgcctcggcctcccaaagtgctgggattacaggcgtgagccaccgcgcctggtgtaaacggggctttttggcagtctgttctgagatacgtctccacaacggttacttgaaggaaaatgcatacgggaccagctgccataatatagtcttccctccatacctgccccttcattaggggtttggggagtggatttggaaggctgtgacagaactggttggttaatgggggtcccacaggtacctgcttccttccatcaagcagcaggtagcagaggaaggaggcagtaaataccaaactccccgttcacccagttgcttgctgccgacattctcatgactgtttcaggtcattgacgagactctggatgttaaggaaatgattttcaatgccgagagagttggaggcctcgaggaagagcgggtacgtgtttagctccagaacctaaggtttcctgccaatcttaggtatttctcctctggaccttctcagttcaagtagaaaacgggagagatgcctgagctaataagggtccctcatccccagctttccgtacttttggataagaaagctaaaattaaaatctccatggagattgggaagagtgggcgttctccacctgtgggtggttccctgcaaagcaggatcttggtgctactttgggttttaggggctcgaccttccaggagcgtggccctcagtgagttacttgcctcacggctgccagatggtcactgggacttttttccacgtctgctttattacgtaggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggtgaggagctgggctgctgagggcctgctctgcactgtgggctgggttgggggtgggaacctgtggaattaataggcatcttcactcctcgagtactggacatgctgctgttatcagttcagttactcactggattcctaggtcgtgtttttggaaatcagcccctgccacaaggggctgttgccaactttcaacattagtttgggccttggctatgaatgtcagaaagtcatgtgaacattttatgctacagagggtgaaaactcttttctcagattatttccttagtgttcctttttccaggtatttttttttttaatgggggaaaggagcaacaggaaatttagaaagtgctgaagcagactgtttctgttctgtcttctgctggttactgaacttgtcttgccactcactccttagtgaacagtgggaatgtccagagtcccttgatccccaaatataaatacagtaaggaccttaatgagccctgggaaattagtgcagatgctggtcttagttatttgtgtttttttgtttgttttggttttttggttttttggagacagtctcgctgtgtcgcccaggctggagtgcagtggcgcgatctcagcgcactgcaacctctgtctcccgggttcaggtgattcttgtgcctcagcctcccacctagctgagactacaggtgtgtgccaccacgcccagctagtctttgtatttttattagagataggatttccccatattgaccagggtgatctcaaatcctgacctcaagtgatccacccgcctcagcctcccaaagtgctgggattacaagcatgagctactgcacctggccagttacttggttttatctcctgctggagactggcctagctgtagaatttcagaactgaaaaagaccagagatcccctggtcccaccgtctgcttgctagcctactgctgactggcttgccttggctggcccaggtagtaagcagtggcgccgagccttgcttgtcaccacggtgctaggaaatccagttgactgtcatcttccgtgagggctaagctttcagggctctcgtttcgaaagcattgcctctttgatccccttattttctttctcctgtgtttcaccaccggttctcatttggcctgtccggtgggaacgggctgctggctgcatttggtcctcaggggattgtgcagcaaatggctcaggtctcccagcaccctgtgcaggtctcttcccagacaccacaatgaccctcaggttttgttcttccaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaccgaga

SEQ ID NO: 1006 - DNA, 74991 bp, Homo sapiens; identical to SEQ ID NO: 1005

SEQ ID NO: 1007 - DNA, 74991 bp, Homo sapiens; identical to SEQ ID NO: 1005

SEQ ID NO: 1008 - DNA, 74991 bp, Homo sapiens; identical to SEQ ID NO: 1005

SEQ ID NO: 1009 - DNA, 74991 bp, Homo sapiens; identical to SEQ ID NO: 1005

SEQ ID NO: 1010 - DNA, 74991 bp, Homo sapiens; identical to SEQ ID NO: 1005

SEQ ID NO: 1011 - DNA, 74244 bp, Homo sapiens
tttgttgccaggtggacgcggccccggccttcgcgcgcggcagggatgctgcgagccccgggggagctcccgcgccaggccgcccgctgctccctctgccgcctggggccgggtcgcggacgcgcattttttaagtggcgctgtttgcctgcgtccgtagaccgaggaaacccgctctgggtgcgttgaccgctttcgtgagggtttcagtgagtagggaaggtgcccgcgaaggcgtgtaaactgttggaaaaatcgtcctcttcgggtgtcagaattccatcagtggttgtgcttcgaggtcgcaccctgagcatccccgctgcgagaaaggcgaagcggcagggccgggggttggggaggccgcgggagggggcgggggcggcggggtccgcggtgcgggccggagcgggcagccttggaggagccctgctgtggccgagggagacggcgagcttgatctttacttcccttctcgaagtggtgcttgaactgctggtctggaatgtgtagttctggtgtcgtttatttcttctccctcttcgctcttttaaaaattacaactggtttctgcatacttagctaatttcagagagacctgaagactggatttgattgggcattaattgagagctttcttttaaagacctcaggtttagaatatatttacttctacagaatgttcaagtatttccacgggtaaaaataaatctaataaaaagcctctctgatggaacggcttaacacctttgtattcatccagtttaaagctttgtgactgtgagggtaagaaaggagttcagctttaaagagaaatagttaacgtttatctacagaggattttggattgcgattgtttcagtgtgtccacacaatggtcagagttgtatctgtgatccctgatatgtcgcatgaaaacagctaggtgagtgagatgggaagaaaaaataaaggctttcgtatggaagatgggacttcactagtgggtcgggtgtcagaaaccatcgttcacactcgcactccacttcccactgctatgactaatttgaggcattagtgaattcacagtagaagactcagcagttttaaagaattcgttaatacttgtgtagcgggaaaaaataatatgagaattcattgttgtgtgttaaatttgattgttagccacagcgttgttcagttgaaaagtatggttgaagaaagtaggaattaaacatttctgaaaaatggttttatggtaactcctgttctttggagctgtatttttgctcacacttactaaatgatctttcaaggggccttttgtcaagctatcagaattttattcatatgaatataatttgattttgtttatttgctgtcaggcaagggactgtcgaagcttaatttagatgagagtggcctaaatcaggatgtctttgggaaggccctgattgagattagcgaaagggattctggccaaatccctgatcaagttgcttggcacagaattattgattggcaaatctttagtgttgcttggtgttgactgaattaatctcttacacctgtttaaaaagaaaaagctcacctctggactcagggtcacttcctctcttaaatccgagacaagttctcctgtgtgcatgctcccatttgggactgagacagtattgtgctgaaaccccgcatactgtgcagtggatgactaggctcctgagaaccggaacttgagtttgttctgtcacatttgaaagaaagaaggccatttgattgccagttttctggaaactcaaacccaaattaaaggatgtcaactgaggcagagtagagaaggctttgtgttggtgtttctgacaggtggtatgggagatgtgtaattgtaccttggagagaaaccttggtgtgcttctgataggaatatcgtcttttttttttttttttttttgatacggagtctcgctctgtcccaggctggagtgcaatggtgggatctctgggctcactgcaacttccgccttccgagttcaagcgattctcctgcctcagactcccaagtagctgggattgcaggcgcctgccaccacgcccagctaatttttgtatttttagtagagacagggtttcaccatgttggccaggctggtctggaacacctgatctcaggtgatccacctgcctcggcctcccaaagtgctgggattacaggcgtgagccacagcgcccggcccgttatttttatcataactatgttttaaaaatcttttgataaatacgataaacttcagttttatcaattagttcctccttttgtagagggaatttgttttaccatctaaagccaggctttcccagggtgtagccacaagccacatgtggttattgagtctgtagggtgactagtgtgaatgaggagtgaatttttcattttatttaattttaattaatttaagtttacatttaaaatctgattcagtggttggaaaacttttaactgaaataatttggttatgcgaatttacttttaaactgtacattttatgaaatctaaatgtagatcaagtatttcctatgaaaatttagcttctgaattgagatgtactggaagtgtaacatacacatcagattttgaagatttaatacagaagaattaaaatctcaatttttgtattgactaaattgaaacaatactttagacatgggctaaataaaacattaaaattaatttcacttgtttcttttcactctaatatggttcctagaaaatttaatactatgtatgtggctcacattgtatttctgttagatggtgctgatttaaaattttgcttaaagttggtcctgcatatgtttttattagcagaattttttaatatgttcctatatttttccacataaagtcttgctggaagttggcccaacatgctcttaagtatttttgttagaacaattttgaatgtgttgatttttaaactttttcaattaaaaatgttttacttagaaataactttaatcaccaggcgcggtggctcacgcctgtaatcctagcactttgggaggccgaggtgggtggatcacgaggtcaggagttcgagaccagcctgagcaacatggtgaaactccgtctctactaaaaatacaaaaattagctgggcgagatggcgtgcgcctgtaatcccagctactcaggaggctgaggcaggagaatctgggaggtggaggttacagtgagccgagatcacaccactgcactccagcctgggcaacagagcgagactccatctcaagaaaacaagaataaaaaaaagaaataactttaatcttataaaaaatgcaaaaattgtacaattttcttaccctttactcagattcaccaattgttaacatttcttctagtcacatttgctttactactgcattttttgccaaattatttgagagtaagttgcatacgtcgtcccccatcccctttacccctgagaacttcagtatatattttctaagagccaaagacattgtcttacataggcttagtacagccatcaacctaatgaaatttaacattgatacaatacttggatcttatctgctgtcggttttctagttagtttgttgacccaatcatgttctttatagcatttgaaaacatgttttgttgttgttgttgttgttttgtttttcttttttgagttggagtctcactctgtcgcccaggctggagtgcactggcatgatctcggcttactgcaacctccgtttttcaggttcaagcgactctcctgcctcagcctccagagtagctgggactacaggagcccaccaccatgcctggctcatttttatatttttagtagagacagggtttcaccatattggccaggctggttccaaacttctgaccttgtgatctgcctgccttggccttccaaagtgctgggattacaggcgtgagcctccacacctggcccctttcaagattgtttaattctgtttacccttactaaattttgaggcttttggattttctttctaaaataacagaagaagaattctataggtagtacatattcattgtaagaaatttaaaagtacagataaccaataagaagtgaaaaatgacctaaaatcttattccccagggaaaccttactgtaatattgtatatacccttctgttaatagataggtcatgtacataaattttataaaaatggcacatactgcatattgaagccagcacctaacaatgattatttcgaattatgctaacatgaactactcaaagaaaataatgttttccgtgtgacaaaaagtaggggtaaatctttgtacagtaattgtagtttccatggaggggccagttgagagagaattctaaattgcctataattcaattttcatgggttgatttttaatgagataaactagattaccttgaagtttaattaaatttagtgtattgtaccttgatttatggcctaagatggaaagtggactatgtaggcacattcaagcagaaatgagttccagtcctttgtgtcaagtacaactaataattgcttttgctgagggaatttttcttacctaagcatcgtgaagtctttatttttattttttattttttgagacagggtctcactcttaccaaggctggagtgcagtggcgcagccatggctcactgcggcctcaaactcctgggctcaagtgatcctcctgcctcagcctcccgagtatctaggagtacagtgcataccaccacattcggccaagatctgtttttcaaaatgagatcttttaaaacataactaatctatttttttaaagatgaagattagaaaattagctgactttcatttgtaattcatcctactagtatttattaaacctgttacatggttctgtgctagatgctaaacagtacagtagtaaaaccaaatgtggatagtgctttttactttgcgaaacacactcgtgtatgatttctaggccctaaccccagagattgtcgttgagtacctctgggatgctcagtttcaaaagctccccggatgattctaatgtgcaaggagagaaaaacaaaacaaagtctttgggtaatttatctccataagtccctaacagtctcgtgaatttggtattcttatccctacctaaaaagggagtcagtagaggccgagggttgaacatcacccagctcgaccaggggaaggagtctgcccatcctatctaagcctactgctctgtcctgtcagtgtggttcatatttcccttttggatgcagatttctttttactcatgtctacctgtctttcccattaccaaaacctggtatgagtgtttcccttaaaaggaactaatttcatacaagttgtgatatattatgaaccattgtaaaccatatggttaatagtgaccctttgaagtatgtaattacaggggactttgatgttttacattttccattgatttatttttttctttcgcatcattcaaatgatattcactgatttttaaaaactttttgggcctttctgtttgtttgttttgagaccgagtctcactctgtcatccaggctggagtgcagtggtgccatcttggctcactgcaacttccgcctcctgggttcaagcgattctcgtgcctcatcctcctgagtagctgggattacaggtgtgcgccaccatgcccggctaatttttatatttttagtagagacaaggtttcaccatgttggccaggctggtctcgaactcctgacctcaagcgatccagccgcctcagcctcccaaagtgctgggattacaggcatgagccactgcgggcccagctcttttgtgtctttttatattatgtgcaagttctctttttttagtagtaagttgtgtcatttttgtattctgacctaaagttttaagaaaagaagttacggttccctgtagagatttttatcaaaatcaaggtgcgggattatttggaagagagaaggctgccagcaccagatactcaatcagtggccagtgaccagtgtgatgggggtaagattgtggtccagaaaaaaactacttcgtgtgtggagtggggcacctaaaaggttgcttaattgagctgtccccaccgccttcctaccctgccttccttgggcacactccccagtggttgtggaattaactccaggggacatgctctgataggataatgtccagaggaggaagagatagtctcttcctgtatatctccttttaagagtgaagaaacctttctcaaagcccaccagcataagacccctcaggtgtcactggatagaagtgtatcagatgcttctagccaaagcaagccttggcaaggggaatggtactgcctccacaggctttgacttctcagggcctgcttttggaagcatgtggccaggaggaggagggtgcagcctctaatcaggttgggcttatcagatggtgatacctcttactaaaaagaaaaagttgggcttggttggaaaagaaagctgtggatgttggtgagaacccagtgtctgctacaggggcattccctgtctgggaagttatgtagctgggatggctgaaagagaaagaagtaatttcttctgaagaaattatctgtgggttaaaagttagctggcaaaatggagacatctgagacatcacaatgcgtttgttagatctgggataatgctatcattttaaagggataatgctatccagaagagaatggctggaatggtgaagaatgtgaaaaatttgacatgacaggtgagtggactgtgagggagatatttcgcctagataagaaaatgtgacattagtggtggtagtaaggatcgttagtattttcacatattttatgctttgtctctggaaggctaagcatgtaacttgcttaggctgaagcaggctttttacccggagaggtgaactattagagcttttattttactctctttaattatgagcattccccacataggatagttaaacatgtaaaacagacccttatgtccagcccccagttttgttgaatcttaacatttctcatgtatgttttagccttaaaaaaaaaaacaaaaaaccactggatacggaaatataacattaccaataaaagcctcatttgaactttccagaagtaactcttgagttaggaatttacatttccattcatattttcattacatttgcttaggctgttattagagttgtaacacatatttatcaacacatagtgttaattatttgtgcatactgtgatgattttagaaggtaagaatgtcaagctgtttgagctgaaagtaaagatagccccttatcaggaaagtgccagccacccttgctgcttctacccactattgaaagcccttgagtatttttgagcttttcaaaatttaaaagtacacaaaagaaaaaaaaagctcagtgtgtttttgtaaatgaaacacttgtgtaactaccactgaggtcaagaaataaaacatggccagtatctcctttccttccttgctcaggagtaactgctcctctgactttatggtatcactttttgtatttccttatagtattacctcccatgcattcgtccctaaacactgtagttcagtttttctttctttttttttttttttagcttcatataagtggaatcattccgtatatatttttatgcatttggtctcattcactagacacatttttgacagccacgtgtattgagtgtagctgtggctcactcatttccgttgctgcatagtactccattatatgaataaaccacgcagtttgttctgctgttgatggacgtttgagttgtttccactttgaggttattaagataatgctgttctctgtgtggtttgccttttcactcttagtgatgtcttttgaagaagttcttaattttaatgtctaattttttagtcttgtcttttctttttctttttttgttatggtaggtgctttttgtatcctgtttgagaagtcttttcctaccctgaggatataacgatagtctcctatattgtcaatggggaactttatttttttgcctttcgcttttggagctataatttatctggatttttgtgtagaggtgaagttaagggccatttcatttctgtttttttccttatggatatctggcctgcaccatttattgtcaaggtcatcctttcccttctgctcggctctgtcacccttgtaatcaagtatctccctgtgcgtgaatctgttcctgggttctcccttctattccattgttctctttgtttatccttgcaccaactccacattgtcttaattattatataataagattttatatttactagatcaagcccttccttgcttgtcttgaatagcatcttagctcttcccttaacctttttcttttcacataaatttgccacattttaccaaaacagcttcttgttagaattttgcttttgctttgggtctatagtttaattgggggaaaattgacatttttcaaatacctagttttccaatccgggaacatgacatgtattttttttatttatttatttatttatttatttatttttgagacaggttgttgctctgtcacccaggctggagtgcagtggtgcagtctctgctcactgcaacctttgtctcccgggttcaagcgattcttctgcctcagccttctgagtagctgggattacaggcacccaccaccatgccaggctaatttttgtatttatagtagagatggggtttcaccatgttggtcaggctggtctcaaactcctgacctcagatgatcctcccgccttggcctaccaaagtgctgagattataggtgtgagccactacgcccggcccatgacatgtgttttatttaggccctctataattctgccttcaatgtttggtagatttctgcatagagatcttgtgtatcttttgttagatttattcatagtcatttgatcttttttatgctattataaatggcatctttaagattttttgttgttggtttgtgtgtttgtgaaaaatacaattgatatttttcagattgaccttgtatccagtaatcttgctaaacatgtatactaattataataatttatctgtaactttaaatttttctgagtatattctgtgaattgtgacagttctatttctttccattcaatccttgtaacttttatttctttttcttgctttgctgccccagctaaaatgttcagatagaaaagacaatagctagtgtcttagtctgacttctctcagagggaaactgtttttgcaatttatatgatactcgtagttttttggtagataccagaccctttatcggataaggaagagtttatattctaagtttgccaaagattcttgtcatgaatgaatgttgagtttttttcaaacatctttttttgccaagtataagatgatgatatgaatttaattttgagagtgcagtatgtaggaaactttgcattcctgaaatgaaccaaacttggtttattttctgcatttggtttgcaaaaattttgttcaggagttttgcctctttgctaataagtgagtttgacctgtaatttttctctttttgtaatatacttgtcaagttctgatttcaaagttaatagcctcctaagttttgggggaagagagcattgcctttattactattataattttttgagacggaatcttaccctgttgaccaggctggagtgcagtggtgtggtcttgtctcaacctttgcctcctgggttcaggtgcctcctgcctcagcctcctgagtagctgggattacaggcgccagccaccatgcctggctaatttttgtatttttagttgagatggggtttcaccatgttggccaggctggtctcaaactcctgacctcaagtgatccacccaccttggcctcccaaagtgctaggattacaggcatgagccaccgtgcccggccagacattttatttatacaggtgcttacagactgattaatttgaggtctaggctaatgtgtgttccagacaaaaattttcattctacctggagcctgaggacactagcaatccaggatcttactgtaagttcctggactgtgatgactgtaagctgaactctgtggagtcctgtcagtttctgatttatctttctttttttttttttttttgagatggagtcttgctttgttgcccaggctggagtgcagtggcgtgatctcggctcactgcaagctccgcctcccgggttcacgccattctcctgactcagcctcccaagtagctgggactacaggtgcccgccaccgtgcctggctaattttttttaatttttagtagagatggggtttcactgtgttagccaggatggtctcaatctcctgatccacctgcctcggcctcccaaagtgctgggattacaggcgtgagccaccacgtccggtcgttggatttatctttctagattcatatgctttgagctacaaactccaaacctttaagttctccaagttattacaaaaaatttagaaaatacagttttgaccaaaacaaaaaacaaacccccccaaaaacaaaagagtagattcccccttatgtgtgtataacccgttttttccttcatttaacatattgaataatttccaggtcattacatattttgtaacgtgtatagctttttttgggatcacacttgatggtttggggcttttgaacactctgcaattttaaatgtacaacattcatccctctaaataggtattcatgctgtgaatttggatttgagtaactaaactattgtatgaacattttgagttattgcatagggatgttgcctactagccagtgattggatatttgcagtagtattgaactgttacttgactattttaccctcattttataagggtgataaaaaggagggaaaatgtttattttattgataagcacatggtgataactggtgcttttttggtgtttttctaggtagtttctttgaacttatataaatgctcagtgggttcaattatgtggaaaaaaattaaggaatgcctataaaatgctggaaattttcaagggtgttttcccccctaaaacactggaagtaattgggatctgataaattattagcttgctagtagcagaatccccaaataacatgcatatgtttgtaacttgttcatgtttacagaaatataccttatgtgaaagtagaggactgcctattttgtaatttatttgattcttttataactgaacatgtatgtttctcattcttctctaatgtaaacagcatactgtggatatcttttaaaaaaaaatcattgtagctatatcccaaattggcatttaaaagaacctctggaaaggacttgatctaaaatggaagactttatggtaattggttcgtttgaggcttttcatagtcatcattattagcaaacatttatggaattgccatatgtagggcaccgtgacagaacaaataacaccatagctgaaggcactgtatggttcttaagatgatataataactagaaacttcttctgttggagagatggtagtcaacacttttccagtcttctcatacagattttattaatttagccttttaatttttattactcaaaacttcatttttttttttgtttgtttctgaggtggagttctgctcttgtcgcccaggctggagtacagtggcacgattttggctcactacaacctctgcctcccaggttcaagcgattctcctgcctcagcctcctgagcagctgggattacaggtgcccgccatcacgcccagctgatttttgtatttttagtagagacggggtttcaccatgttggccaggctggtcttgaactcttgacctcaggtgatccacccgcctcggcctcccaaagtgctgggattacaggcgtgagccacctcatccggtctcagtttttaatttaattttctgactctgtgcttgtgcttttaatactttcacactgattttctgcttctcaataaggaaagcacgtttgatctggtcacaaacacaaaacaaatggaaccactgtaggccccgatgccatgtgttttgttttgaataacctcataagaactcctggtctcccagcatgaagccctctaagtcagcctgggcacacgccactgcaggtgttggtgcatttgggacagcctagttttgttagaggctgtattgtaggaaagcctgtgacagtatgtcagactcattgcctatagacagcatccccagaaagagagaggggggaagcttttcatatacagatttttaaaatctaggttatctgttttcttactgatttatagtgtttccttccagatgttttacacatgtcagccacaagacataagcattttctaaattgaacagcctaaagtccacagatctttttgtgtatatggtaaaatgtacataacaaaatatattaaccactgaaacttttcttttctttttttttttttttttttttttttttgagacacggtctcacactgttgtccaggccagagtgcagtggcacaatcatagctcactagagcttcaacctcctgggctcaaatgactctcccacctcagcctcccaagtagctgggatcacaggcgttgagccatcatgcctgggtaattaaacattttttttgtggagatggggacttgctctcttgcccaagctggtcctgaactcgtggcctcaagcagtcctgccttggcctccccaagtgctgtgattgcaggtgtgggccaccaagccctgccttaaaacattttttttttgtggtaagaacacttaacatgagatctaaattttaagtgcacaatgcagtattgttaactgtagagaaaatgttatacagcaaatctctagaacttatgcatcttgcaaaacggaaactttatacctgttgaatagcaactgttttttcctcccttcagcctgtgtcagtgacagttctgtgaatttgattatgttagatatcccatataaggggaatcatgcagtacttgtctttttgtgacttgtttattttacttagcataatgtcctccaggttcatccatgttgttgaatgtggcagaatttacattttttttaaggctgaacaatattccattttatgtatatatcatattttccttatccattcatctctcgatggacatttaggttgtttccatgtcttggctattgtcagtaattctgcagtgaacatgggaatgcatatatctgtctgggataatgagtttaattcttttgctgtatacccaggtgtgagattgatagatcatatgataattctacttttaattttttaagaaccttcatactattttctatagtggctgcaccattttttcaccagcggcatacaggagttccgatttctcggccgggcgcggtgcctcacgcctgtaatcccagcactttgggaggccgaggcaggcggatcacgaggtcaggggatcgagaccatcctggctaacacggtgaaaccctgtctctactaaaaatacaaaaaattagccaggcgtggtggcgggtgcctgtagtcccagctactcgggaggctgaggcaggagaatggcgtgaacctgggaggtggagcttgcagtgagccgagattgcaccactgcactccagcctgggcgatagagcgagactccgtctcaaaaaaaaaaaaatgctttttctgcatcttttgagggtatcatattatttttgtccttcattctgttaatgtgatatgccacattttttggtttgtatgtgttaaaccattcttgcatcccagggataaatcccacttgatccaggtgtatgatcttattaatgtgttgtctgattcagtttgctagtattttgttgacatcctttgcgtctgtgattatcagggatattggcttatagtgttcttttttttgtagtgtcttaatcctattttgttattagggtaatgctggcttcatgggtggaaattaaacacacccttggtaaacagcagtcttaaccattgagccaaagaagaaatcaaatgggaaattagatgatgttttgaacgaatgaaaacacaacataccaaaacccttgggatgcagcaaaagcaccactgagagggaagtttatagcagtaaatgcctacattaaaaaaataagaaagatctcaaacagcctaattgtacacctcaaactagaaaaagaataagctaatcccaaagtgagcagaaggaggaaaataatttgcaacagaataaatgaaaacagaatagaaaaaaacaatagaaaaaaatcaaagaaagagttgggtttttgaaaagataagcaaaattgacaaacccttggctagactaagaaaaacagaagacacaaaatcagatatgaaagaggagacattacaattgataccatgaaaataaaaagtatcgtgagactattatgagcagttgtatgccaaaaaattggataacctagaagaaatgggtaaatttctaaaaacgtgcaaactaccaagactgaatcatgaagaaatagaaaacttgagcagatcagtaacaaataagaagattgagtcagtaatcaaaaacctcccaacaggctgagtgcggtggcttatgcctgtaatcccagcactttgggaggccgaggtgggttgatcacctgaggtcaggagtttgagaccagcttggccaacatggcgaaacgccgtctctactaaaaatacaaaaaaattagccaagcatggtggtaggtgtgtgtaatcccagctactccggaggctgaggcaggagaattgcttgaacctgggaggcagaggttgcagtgagctgagattgtgccagtgaactccagtctgggcaacagagcgagactccatctcaaaaaaaaaaccaaaaaacaaaacaaaacaaaaaaaacttcgaactaaggaaagctcaggaccagatgacttcactggagaattctactaaacattaaggaagaattaacactaatccttctcatagtcttccaaaatattgaagagggaacattttcattttaactgtttttaagtgtacaattcggtggcattaaggacatccacaacattgtgcaaccatccccgctgtccatttccagtactttttcatccaaacagaaaccctgtacccattagacactaactttctattcccctggatcccccagcccctggtgatctatgaatttgcctattctggggctcaagtaagtgaaatcataaaatatgtccttttgagtttggtgtatttagtatattttcaaggcttgtgcatcagaattccattccttttcgagactgagtaatattccattgtgcatatataccacattttgttcattcatctgttaatgggcacttgggatgtttctacctttggctactgtaaacaatgctgctatgaaaattggcgtacatgtagatatgggagtccctgctttcagttctttcggatatttactaagaagtgaaactgctggatcatatagtaattctgtgcttaaatttttgagaaattgccaaactgttttccacagtgactttactgttctccagtcccactgacagtggacaaaggttccaatttctccacatccttgccaacagttactttcctttttcaaataatagctatcctaatgggcgtggagcggtgtcttattgttttgatttgcatttctctaatagctagtgatgttgagtatcttttcatgttgaccatttttatatctttggaaaaatgtccgttgaagtctttggcccattttcgaattagattgttttgttgctattgttgaattgttggagttctttatatattctggatgttaattagatatgtgatttgtagatattttctgtcattctgcagtttgtgttttcactctcaatagtgtcctttgatgcacaaaagtttaactttgatgaattccagtttatctatttttttcttttgttgcctgtagttttggtgtcatttttaagaaatcgttgtgaaatataatgttatgaagcttttctcctaagtcttcttctaagctaagagttttatagtcttagctcttaagcttaggtctttgatccattttgagttcagttttgtatatggtttaaggtaagggtccagcttcactcttctgcaagttgctatccagtctctgcaacatttgttgcatccccattcaattgtcctggcagatcaattgaccaaacatgtgaggatttatttctgggctctctattccaaatgtctgtctttatgccaatatcacactgtttgattactgtagcttcgtagtaagttttgaaatcaggaagtatgagtcttccgtctcaagattgtgtgatttcatatgaattttaagatggatttttctgtttctgtgaaaaaacaaaacaaaaccctgttgggctattaagtattgcattgaatctgtagattgttttaggtagtcttgtcataacagtattgtcttctaaccctcaaatgccatagagctttaaagttaattattgtaaattagtaattaacagaatacaattacttttagtttacactatggcttttgagtgtaaggtgtttggtgaattttattcttttagagtaactgtcatcagcgtcctcactgtgatacctagtacgtaacctaaagttgaggttgaagacctgcagtctgcaggcagaatgtgacctgtccttgtgttttatttggctgttaccatttgaccttccttgtgtcttaaattcaaagtaaatatattcatttccaaagatcatgggttttaatataaaaattccgctctggttttaaagaaattagaacatctggcagcaggggctaagtagtggcagccccgcttcagttggtgaagagagcctgtggtctcttcgagggggctgagtatgggtctccattttggtcttaccctctagctccccattccctgtctgtgatgtagaggcagttgagttttcaacctttgttgaaaacgaggaaaagagaacattggtttgaaatgatcttttgtagtaaatatttaacaccatggcaggtttcaagtgaaccaaaaaccacatttcatagcagaatggccctgcgattggttggactccaccctgccccttatcctcttctgaagaggctttctgtgtaatactgtagaatgtttttccgtctagccacttcctattagaagaatgattatttgcggcttgattagcttcctcaggatctacattaaaaaaaatcctgctgggctattgttttgcaagattaatcttgtgaattgataaaagtcattgaaactcaatgttggttagtgttgtttttaaacaataggaatagtattcaggacagattaaaatcagattaaaatattttaagtattgcttttaaaagattaaatacagagcacagactcaagcctgataagctcccagccaaacagtttttacatgtagttttccctgtgtatgtgtagtcagtgaagatgctgaacttgtcacaaaatgtggatgcatgaggcatattattgtaacttgaattcagatggccccaaaattaccccattcactcagcataattggttaaacttggtctgggtgatatctgtaagtcatcaaaggaaggaattttaggacaaggaaaggatggtttgattgttccaggggggaaaaaaccataaaattttaagaaaatcattgttcagggaaggctgcaagcactggtaaggaaacagagttttccaataagttaactgaaatcgggagtaacagacctctgaagagtctatctttgggaaaatctctgacttcattcttgacatgattgaggacttcatgtacaatgaattagcaatgcgaatcatctaggcatataaactggaaggaaataagaaggtttgtagagcaagcaacaccagatactcatgcttgctccagagaagttttccaggaaaagcaaatgtcatcttctctctctgcttcactaactttaaattttgagacctcaggcagtctagtccatgaagaaaacactccagaatgaccgagatacttaagtttttaacaacatttaaaataatatgaaaaataaaataaaatgttgttaaaaacttaagtatctcagtcataatttgtgtccttttttttcttttgatatttgttcagaaatagactcccaacttataatattaataatatacctgtagaaaatagggacggccttctttttttcacattgcacagtctcccccaggtggttctgcctaatctctaggcttaaaattcttccagcctggtaatgaatagaaaatccttacttccagctcacgttaccctctggaatgcccatcctctatttttgtctggtggacaaaaaacgcggcacttggtaagctgtgagtccttccagtatgatgccactcaaaactgaagtttatcagtctccaatcctcagccccctccctaccacccgtccaatttctttggctgttagccttgccattctcccagttgtcagaattagaaagctggactcattccaatccttccttcatgtcccctgtccaagtatttctcatctgtcactttcctattcacactgctcctgcctttgttcatcatcttttgcctggatgaatgcagtggcttcctaactggtctcctttctatacttcatctttcctgatcacaccctcctaccttccaaagtatgcatagcagggtcatgcacacgctggaagggagcccaagcacactttccttggagaagagttctgaaggctcagcccctcatcctccgtagctgtcgctctcctgtgccaagtccgtgcatgcctctgttacagctcttctcagttgcagcatgctcactgtctccatgtcctcacctcacattcacagcgtgcaccttacattgtaatcctgtttctctacatctggatcctgtctcagagtatatatgctccctaaatacacatgttgagtcttgtttacccagtgtgtttgtttgctagagctgctgtaacaaagatgccacaaatggagtgacttaagcaacagaaatttattgtttcacttttctggttttctggaggctagaagtcccagttcaaggtgttagcaggactggactccttctgaaggcactaacaaagggcctgttccaggcctcgctcttggcttttggcagcgtaactccatcttcacgtggcgctccctctgtgtgcatgcatgtctgtctgttcacatttcgccttctcagaaggacaccagtcatattggattaagggcccaccctgctccagtatgacctcctcccacttacatcagcagtgaccatatttccaaataaggtcacattcagaggtatttggggctaggatttcagtaaatgaaatttgaggccctattcaacctataagacccagtggctagtgtgttgactgacataactgtaaagtaatcaagtgaaatgatctttgaataaagggtcagaattttattttcttcaaagttatgtttatgacaaataaaagcttatgatcttgggaatactttcccatctctagttttccagtatattcatagtagctgttgaattgttgcgcgtcaaaagatgctggtggagtattctagttctagctctgtctttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacattttgcaccgcccttaatccatttaaccctgagtggacacagcacatgtttcagggagcacagggttgggggtaaggtcacagatcaacaggatcccaaggcagaggaatttttcttagtgcagaacaaaatgaaaagtctcccatgtctacttctttctacacagacacggcaaccatccgatttctcaatcccttccccacctttcctgcccctccactccacaaagccgccattgtcatcctggcccgctctcaatgagccgttgggcacacctcccagacggggtggtggccgggcagaggggctcctcacctcccagtaggggcggccgggcagaggcgcccctcacctcccggacggggcggttggccgggcgggggggctgaccccccccatctccctcccggacggggcggctggccgggcggggggccgacacccccacctccctcccggacggggcggctggccgggcggggggccgacccccccacctccctcccggacggggcggctggccgggcggggggccgacacccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggccgggcaggggggctgaccccccccacctccctcccgcacggggcggctggccgggcggggggctgacccccccacctccctcccggacggggcggctggccgggcggggggctgacacccccacctccctcccggacggggcggctggccgggcggggggccgacccccctacctccctcccggatggggcggctggccgggcagaggggctcctcacttcccagtaggggcggccgggcagaggcgcccctcacctcccagacggggcggctggccgggcggagggctgacccccccacctccctcccggacagggcggctggccgggcggggggctgacccccccacctccctcccggacggggcggctggccgggtgggggggctgacccccccatctccctcccagacggggtggctggccgggctgaggggctcctcacttcccagtaggggcggccgggcagaggcgcccctcacctcccggacggggcggctggccgggcggggggctgacccccccacctccctcccggacggcacggctggccaggcggggggctgaaccccccacctccctcccggatggggcggctggtcgggcggggggctgacccccccccacctccctcccggacggggtggctgccgggtggagacgctcctcacttcccagatggggtggctgccgggcggagaggctcctcacttctcagacggggcagctgccgggcggaggggctcctcacttctcagacggggcggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggcggggcagagacgctcctcacttcctagatgtgatggcggctgggaagaggcgctcctcacttcctagatgggatggcggctgggcggagacgctcctcactttccagactgggcagccaggcagaggggctcctcacatcccagatgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccccgtctccaccaaaaccagtcaggcgtggcggcgcgtgcctgcaatcgcaggcattgggcagactgaggcaggagaatcaggcagggaggttgcagtgagccgagatggcagcagtacagtccagcttcagctccgcatgagagggagaccgtggggggagggagggggagggggagggagagggagctctgtcttgatgatagaataccacttagtttgcaatacagttaacgtatgaataaactaacaaagaacaggaagggagagatgcctatgaaatcttgaagatggcaaacagactgagccagcaaatcagaaaaggctgagacctcatcttagccgggaggagccaagtaaaagcaacctcatttgcagagcaaactcagatctgagagatagaaagcaccagggcctctgaagacatgctgaggccccaggggacatagatgaaactaaatgtgagcatttagccccctgaatacccctccctacctggcagtctaggaaaagacttgaggtttacttggggagagtgggcccagcagaaggtgagggactgagcagtgaaagtctccctaaccaggcccggggcagagaactgactgaaggattcctccctggagaggcaaaggccgctcttgaccttgtgcatgtgcaggaaacttccagaaacttccaaccatcttcttagtgttcccttcttaaatgtgaattagatggcttaggatcaccaaagacttcaggaacaccttgaacatgaacgagaacaaaacaagaagaaaaagcaacttgaaggcaatgtagggaatagacaaagacaagttcttacctcaaaggagagaagagggggcataacatctatgaagtaattgtttgaaatttaaagacgttcagataacaaagggttcttggaaattagaaatgtggaagcagaactaagaccccagtagaaatcttccagaaggagaaaacaaaaagaaactagaaaagataagtagaaggtcaatctaggaggtctaagagataactaatgagaatttcagaaagagaatagcagaaacacaggactgtgtgtgtccaggccaacagggccactgagagctcaggccagtgagtgatgaaaagagcacaccaagacatgttaggttgaaagttcagaataccagagattgggaaaatcttggaacttttattttttatttatttttttttttgagacagggtctcactttgttgctcaggctggagtggagtggcatgatctcacgtcaccgcaacctccgcctccctggttcaagctatgctcctgcctcagcctcccgcgtagctggaattacaggcatgtgccaccacgtctggctaattttttttgtatttttagtagagacagggtttcaccatgttagccaggatgatcttgatctcctgacctcgtgatccgcctgccttggcctctcaaagtgctgggattacaggcgtgagccaccactcccggccgtatttttttttttttttttttttttgagacggagtttctctcttgtagcccaggctggagtgcaatggggcgatcttggctcaccacaacttctgcctcccgggtttaagcgattctccttcctcagcctcccaagtaactgggattacaggcatgcgccaccatgcccagctaattttgtagttttagtagagacggggtttctccatgttggtcaggctgttctcgaactcccaacctcaggtgatctgcctgccttggcctcccaaagtgctgggattacaggtgtgagccacagtgcctggcctaatttttgtatttttagtagagatgaggttttacgatgttggccaggctggtcttgaattcttgacctcaaatgatccactcacctcggcctcccaaagtgctgggattacagacgtgagccaccgcacctggccgggatttacttctatatgtaaaaaaacccagacctgcacaaaggattgggaagattggctttagatttatcaatagcagtgctgaaagctagaagacctcaaattctgagggaaattatttccagcctttaatttagcgttcatccaaattattgacaagacgtgtacataaaataaaaacctttttgggatctgtcatgtttgaattttccattcacacaccctttcttaggaagctatggagcactgtgagccactaaaacaggaagttgagaaagagggaagtactgagtcaaaaccaaagaaaggggaaggaattttcaggactcatgagagctgtgccgaggcagagagagtaactggtccagatgaagcagggaaatggagggccagaggagggatgcattctagaaaggagggactgaaaccagtgggtcagctagtgtgtctgactacactgaagggaattttactgatcttttctgacaatttcagggagaattggtagtcaatgcaatgcgtgtgaaaccaagcaagtaaaagaagatgcagttgcttactctaatggggaaatagatgcctagaaaggaattgtaatcacagtacgcttttatgttataatgagatagaccagatgcgtggttcacacctgtagtcccagctctttgggaggctgaggcggaaggattgcctaacaccagtaagattctgtctctacaaaaaagtaatgaaaattagctggatgtggtgtggcatgtctgtagttacaactactcgggaggctgaggccggaggattgcttgagtgcaggagtttgagactgcagtgacctatcattgcaccactgcactccagtttgggtgacagagagagacctttctttaaaagtaataattacaatggaaatgaagtattgatttgaccatgggacaagtgggtggatgggtgtagggtttggcagtttaagaattaaaaacattggaggataatatctggactgaaaagatacagaaataaaacatgttgtgtagaaatgtggagataaagagcaggtggaaggcctgatagctgtggaagcacagtctctgcagagcaggctccacttgggtggaagctgtccttctcgtgtgagctctagccttgtactgtgtggcttctcaaactgtgtgcttggagtcacttgacaaaaattaaaattaagagaatggaaacttgccatcttgcataagtttttttgtcatttaatttgtcaacttttagtaggtctccttgtatggagactagtacactgttgatttagaaatacctgcaggttgatactagtttagtgcagtatcttgaagaaaccaagagcatagactttagagtcagttgtttacttgggtataaatgatgagctactgcatgctaggggctgttcccagataacagtggttaggaaaatacatgaggcctctccccttgacgaagtcacattctagtgatgggagatggacactgcagatgaatgagcaaggtcgtttcagattgcttgagagagataaaacctggaatgggttggaggagaaggccttccacggaatgcccctttgagcagagtcctgagggtgagaccaccacacttgcttgggaacagcaggggaaggcttcgagttctgggagttcattagaattcaggacagtcatcctcaacaagagaggacagttggccttgaggtgagacagaccctggcttgtgacatcaagggtggtgctggactggagggatgctggagtgtggcaggggctgcatcatggtgggccttgcaagccacattagccactctgaattctctggaatagaagagcagtgtgttctgccttgaggtgattcagagtgctgggtagagactggatcctggagggctcccagtgcccacctgacaagtagtacaaaagtgctgttgaggctgggccctgtggctcatgcctgtaatcccaacaccttgggaggctgaggctggggaattgcatgagacttggagtttgagaccagcctgggcaatatagcgagacctcatctctgcaaaacatttaaaaattagccaggtgtggtgctgcacgtctgtggtctcagctcctcagaaggccaaggcaggaggatcacttgagcctggaagttcaaggttataatcagccgtgattgcaccactgaactccagcctgggtgacagagcaagaccctgtctctaaaaaataccaaaaaaggtgctgttgtattttacaccatgcaggttcatgtgtgcttacacacacgtttatattccttttattcattctttttactcgagggtagcttttcctgctgtcgtttatgcatttattagtagttaggtggtttgaaccccagaaggttaactaatagccagtgcagcaagcagtaaatatactgactagtggctcatacttgctttattacttcagttttttaaattgttgataattacaataatgcacatgggcatgggtccaagacaggaagaattattgtctgcaagcagatctgctgtaagctggtaatacagtctgatttacttttaaatttaaatgccacataaatcacaggaaagatgtcttttaacttgctttgaatttggaaagggtagagcactttcgtatttttgttattttcatggttttaatgggcattagaagttaaattgatttgttatatccagattgatatctgagtgttgtgtgcacctaataaaatgtttagcggaatgactatagaaatttgtatttaaagtgtaaagtttctctctccctgccctgtgaaaatcattttggcaaattgtcagattttcttgttataagcaaagatatgggttattcacccaagaatttcatgcctttcagcatagcagaaccttagaaatttaaggaccaggtatggcgactcatgcctgtaattctaacactttgggaggccaaggagggaggattgtttgaggctgggagtacaagaccagcctgggcaatatagtgggaccccgtctctgcaaaaaatgtttgtttaattagccgggtgtagtggtgtgtgactgtagtccctgctacttgtggggctgaggtgggaggattgcttgatcctgggaggttgaggctgcagtgagctccagcctgggcgacagagtgaaactctggctcagaaacaacaacaacaaaatacccacaagaaaaacctaaacctgtgatttccagtgtttggtttttatggaataatggaactaagaaaaatgttttaaatagataaggttgttcttggttaatattacagaagaataatttttaaaaagcagctacctgttgattgttgccatcattttatgaaaccattttaataacaaaaggtagaagataatgttagaattcaggacagttattcttcagcaaggaccattagcagttctgtacccttacgcgtggatgtgtgcacaacacatgcacactagacctttcttaggtttctcatttttcaggggggccactggaaaccttttgtagaccctgttagtcccctagtggatgctggggacccctccctgctttaaaacactggcaaaaatcatcatatatattaaaacatggatatttggccgggcgcggtggctcacgcctgtaatcccagcactttgggaggctgaggtgggcggatcatgaggtcaggagatggagaccatcctggccaacacggtgaaaccccatctctactaaaaatacaaaaattagccgggtgtggtggcacgtgcctgtaatcccagctacttgggaggctgaggcaggagaattgctagaacccgggagtcggaggttgcagtgagctgagatcacaccgctgcattccagcctggtgacagagggagactccgtctcaaaaaaaaaaaaaaagatgttttcagttgcatgaatttgttttcttattttttcccagatacgttaaaggaaaagagatctagtgaagtcaatttcagatctctgacattggttattcatgtttgtggttttaacctcttgaagtcagttacagcatttcagccaaagctggcatgttggatagtttctcaacttagccttggtaaaatcactaattcaagtgtttatttagtgaaatagttggtcagaaaaatggaatattttaaaaagaagtgtaattttttacaagtacatgaaatactcaaactatgcttaatctgatttttagtgactggcttaatgcatataaaaacaaagtatatatcatagagtaccaggtcagccagaggaagcttataatttctgagagtattgccaggtttgtgcttggatattctacagaaaacccttcatcatttgtattatttctgtcatctgaatcaataagaatgatttagaataaacatattttattattaatatttaatgagtagtacttctgagtgttacttgaaatcatttcactcttttaaggtttagaaaacatatccttctacatccccccacccctgctctgcacgtactagtcagcacactcttaataactgcctaagtaatgctggccagtgagttcaaatgttaagcccaacttcacaccatttagatcatcttatattaattctgaggcctcctgccttcctgacctctgcagttagcatgcctgacaaagtatgagaaatgtctggtttgctttggagtcacagtgaattctgacttagtgagggaggccatcttcatttctaagccatgtttctcctgcatggggagttttaggaaaatagagttccatctgttatagtgtgaaaaaaagttaatattgtaggtgtctcatttaataactaaactttgagtagcaccctatttatgttgcacaaaagtgaaaactaaggtcaagagagattaaataacttccatgagattacatagcaaggaagcagaatgtccatcaggaaaaccagtttagaaaaataatttacatagtgctcttctgatcacagaagtgttttgatagttgcagattcatcttgacttcacttccaagtcccggaagctgggctagagccaggaagtcagcaactcttggccattttcttttaaatgtattaaatcattcatctaaacgtttggtgactgaattcccacaaaatatgaagcattaatgcaacctgctttcctcatgtccatagttaatgtgtgaagaaggaatgtgcactcttttaaacccatttcatgccatcctggatttgggaaggatggccagtcatgtggggactttgtggcctcttcccttgtgcacctcgggttcaagccccagttctgcgcaattgcagccagagagtggaaagagccagcctgatgatgatggtgatgctaacgtgcttgctctgcggcaggcattgtgctcagtggttctgcgtgttattttaatcgaatcctcacaacaggcctgagccgtcggtatgttaataaccctgttttgtagattaaaaaattaaaacctggtaataatgaaagctcccaatgcttgaagagcgcttctatgtgacaaacacttttcaaacacttaacatatattaactcatttaaacgtcagagcagcactgatgtgtagttattattgtcattaccttatagatgacgaaagtgaagcccagagaggctaggtgacctgccagagttggcacagccagtcagtgatggaggtggaactctgtcatggtgtgtctgcgccttaaagccacactcttggtctttctcccaggtcagtagtacagtgagtagaagagtaatggttggccgaggccagtccctagtgtctccataccccctggaaataagtttcatggacttcctattttataatgggcaatcagaaaaaaaacacagggactgatgaagaacctgttcatttgagaatttcaggtgtgtaaacactgttctgcgtggttttttttttacatgaaagtattttatgtatttgtatattttgaaaaaacttcccttagctctcatgtcagagacacatactgaaagacagacctctattaaatcatgatgtttggctccttaccactataatccagatggacaaattaccatgtttccataaaaagcgttggagacagcctaaaccattttcaatcttggaaatgatacctcatttatactttaatatttaaagctctaataaaagctggagttatttgtataaattactgtctgtgaaaataatacctaacagccggcatatgtcactgtaagaataatgtctttttacacttggagttttccccctacacccagttcaccagtttctaattagaattaagtttaaatgttaaaaaatcaaaagaccaagaattttccattcatgtaatgcaaactctaaataataggttttttcattttactgctatacaaccggaaaatgcttaacaagaatcctgctattttattagatagtggtttgaagcttcacttctctgctgctgaaaaagatactcttaaagtttcaaactgtggtcactgtttggacagtaaaaaaaaaatgtggcatttcttacacattaggctctgggtcagaatcgtgatagtcttccaattgcagaaaaatagaatttaatatgtgtacaatggggctttactgtattaggatgtgtacccgtgtgttttgttgttgttgttgttttttgagatggagtctcgctctgtcgcccaggcggaatgcagtggcgtgatctcggctcactgcaagctccgcctcctggtgggttcatgccattctcctgcctcagcctcccgagtagctgggactacaggtgcccgccaccgcgcccagctaattttttgtatttttttttttttagtagagacagggtttcaccgtgttagccaggatggtctcggtctcctgacctcgtgatccgcccacctcggcctcccaaagtgctgagattataggcgtgagccatcgcgcccagcccgtgtgtttagaataatacacttttcaggtattgagcctgttccgattttacttactagttgtgctacctcaaattgtgtgttctctttttgacagatgagactcttaatattgaaacgatgcattccagattgaaatctaggcatataataagcagaattcaaaaacactgtattttgaacaaattttagactttaaaaaaagttgcaaaaatactacaagagttcccctatactgtaaccctgtttcccttaatgttgacatcttgcataactcgtaatgcgatgatcaaaaccaggaggtttgcactggcacagcactgttaactgacttacagaccttattcaaataattgctgcagtttttccactaatgtccttttcctgttccgggatcctgtccaggcgcctgcattgcatttacttgtcatttctgcttagtcttctcagatctgttgcagtccccggtctttcctgatcagcaccctcaaatgtctcattgtggatgagattaatgtaggtgtctgatgtgtgtctctgctctcaagtaattgttttcccttttgtagctaatatctttggggagataccttgaaaggatactgagaacagaatttttttttttcacttcgttcagtttagtaaatctttggtgaaggttcatgaacataaatttgttctaatttgtgaaccttgaagtacttcagcgcttgaacaaatatgaatgaaaataatatataggattttcgtatcttttaacagatggtccttttttactgacttttccttaaaaaaggtttttgaacaagagcgtcgtacctttcgctatcagtagtttgctagtggtaactagatgcctcgaaggcctgcttcattccgcgtttattagaactagaactgtgttacattgccttcgcagggtgaaacttgaatactcgtgtgtctcataaagccggattcctttcaaagagacctgattcttccactagtgggatcaaaccatgttcatgggaagatgctccctctatggcaggcaccttcagaagccctgcagccagatttgatcctggaatagtagcttcaatgagggcagagataactgggtgtgcacgtttgctttggagtgagaggactgcctggtcctgagggctttgtgaagggaggtaggcttagatgagcccaggagttgcatcacttgaggtgattaaaggccctgatttaaagtaggttgagacttagatttatttagatttacatatttatttccttaagccatttcaggttttcgaccaagttactagaagcactttttaccaagttgaatttctgtccttggattgctaaactgttccccaagccaaattaataaaatggaatttcttattaagaatgaattattaagcaaaatggaagtgctgggctagggaagcagttgatgcaatttgttttccaagccttaaaagtgctgcagtatgcatagatcacaaggactggcttcagtgccaacacatggggcattaatttttttggtagaggattccaggtttacaggatatcagaagtgctgacttggcagcaaaatcccatttgtaacatgttagattaggaaacagattgatttatatgttgatgtaatggatcaaggcacagtctgtgcttaaggaaatggacagcacattaaataagggcattttcaaggtagaagtacaaacattacagaaaaaattagccttttacaccctaggtagggttggggtatgtttgattagttgactcctaaaacatggtccacagaggctttttatatttccgatgataccttcttgagagtctcttaagaccacaaggattaatctttctgaactcaaaagtgaatcactacagcatattagctgtctggattgattccagtttctctgctttttcttggtggtaactgatgtgaggatctgttggtgcttagctgcctcttcctgttgctttaacctctggtattttaagattctctttagggaagatagtactgaccatctcagcacagagccgaaatgcacttagcgctgatgtgttgaccttagtggttgacccataaactgaacatttatacagttggaactcttgcggtcttttagccaacaaccataatgagtaacatgtggaacataatctttggtgctgataaatggctttttacgatgaaattgaccattccacgctgtggcttgggtgacctcatgtaactaattactgtttcttagctatattcacttttggaatttaaggggtaaatggtttctccttctgcaggctgaactgctgacagattaaataccacctgaaatctgatttgtttagtagctgtctttaatgtaaaaatatagaaggccagagggaatctaggaaacactgctcagaagctttcagacttaactataggagttcattcgtagcaggtttaggaagcacattccttccgacctgtagattgggcttttcatatacgtatttatcatgtcttcttggattttcttcatttaattctatctgaactttcgaagtgggaagcaaaggattcgggggagagcactggtttcagtacacgaaaatatccctggggtttccttacctttatctttggatatccccatttttctcgacacacaatccaagtttctagccataatccttagattacaaaagaacaggacttttggtacacatctttttttttttttttttttttttttttgagacagattctctgtctctgttgcccagtctggagtgcagtggcgcaatctcggcttcactgcaacctctgcctcctgggttcaagcgattctagtgtctcagcctcccaagtagctaggaccataggcacgcgcccccatgcctggctaatttttgtatttttagtagagacagggtttcaccatgttggccaggctggtctcgagctcctgacctcagatatccacctgcctcagcctcccaaagtgctgggattacaggtgtgagccaccgtgccgggcttggtatgcatcttgaactaagtgtgaagattaagcacatctgtcttgtgcatcctttataccttttaatgatttgtttgaattaagcaccactagagtattacctatgaataggtgtgtgttccttcctacacatatctttaggtgttttttccttctttgggggaagcaggaactcatattagtctgtagcttcacgtgcattcatactgaaggcatagggccttctactttaataaatgaatattcgttccagcagggtaaagtcaattctagttaataaaggtgctaattgtttgttgggtttaactgaggtgtttttcagccctgatagatattggcaacattttaattccaaattagctttctcccagctgtccaacaagggttggtgcttccttctcttatactagtagaaagcaggttcattttaataagcttcgaagcaaaacatatgtcagatggtaaattggtcctggaaaaagaccataatatatttcacaatcaaatttaagttactgattagaaggattgttcatgtctgtgtagttcatcagcataaataaattaaagtttcctagaaaatcatacattttccacatattttaaaagtcagctaggcgtagtatctcatgcttaggatcccagtcctttgggaggtcaaggcagaaggatcacttgagcccaagagtttgagaccagcgtgggcaacacaatgagaccccatctctaccaaaatataaatacgtgtatactgggtgtgatggcgcatgcctgtggtccctgctactcaggagattaaggctggaggatggcttgagcccagggggtcgagactgtaatgagctgagattgccccattgcactccacgtgggtgacagagcaagaccctgtctcaaaaaaaaaagggtgggggcatcaaagctaccctttcttgttagtaggaaaaccatgtcatgtatatgctgtttttgaaaagaacaacatggtagaccatataatctaaccctcctcctctacaagttttaacttaagaactgttatttgtttatttattttaattttgaagaaagttttgcagttggggactcttatggctataaccacgagtaatggatgtttttagagagatgcctgtgcttgtctctctctttctctctctctctccctgtctttctgtctgctttttttttttttttttttgagatggagtttcgctcttgttgcccaggctggagtgcaatggtgtgatctctgctcaccgcaacatctgcctcccgggtccaggcagttctcctgcctcagcctcctgagtagctgggactacaggcatgtgccaccacacccggctaattttgtatttttagtagagatggggtttgtccatgttggtcagtctggtctcgaactcccgacctcaggtgatctgcctgccttggcctcccaaagtgctgagattacagatgtgagcccccacgcccggccgatgcctgtgcttttctcgtgcatgtctgcaggagccttgctgttgtaatgttacttctcagctatagcttctgagctgttaatggttagactgcacataaaaggatatgggccaaagacagatcttatggaatagttgattatttttacccaacatgagagaaaattgttcatgaaatcccctttagtgttctgtgtttatgaatgatgccatcacattttgaatcatgggagccaaacttgaaccttcctcttcctcatccctcatatcagttatcacacctaggcctattttaggctctgtggtttcttgaatctctctatccaccactccaccttagcccaagctaccatttattcctctcttggaatgtgcacctccagtgtcctgaatgatttccctgcatacactcatttcctttcagtcggttcttcaccgtgcaactagagaaagcatcagagctttgttatgaaaatagtaactttctgcttaaagcctctcaacacttcagtggtaaggactgaagtcctttcttggtctgcagactcttgtcccggcatgcctctcccaccatctctctgcctcaaaatcaacattgcctccatatgggatgcttaaagcgctactcagctgtcactctctttaggaagcttccttgatcagcttcctacccaagcttaggtcagattcctttttttttttgagatttgagtcttgctctcttgcctaggctggagtgcaattgtgcaatctcggctcactgcaacctctgcctcccgggttcaagcagttttcctgcctcagccccctgagtagctgtgattaccggcatccgccaccacgcctggctaatttgtgtatttttagtagggacggggttttgccatgttggacaggctggtctcgaactctcgacctcgtgatctgcctgccttggcctcccaaaatggtaggattacaggtgtgagccaccgcgcccggcccagattccttttttatgtgctttctcaacactgtgttcttttccttcttaagacatttgggaatgtggtcacactttttgtgagttttaactcttgcattagagccccaagaaagcaggtcatgacttttttgcccactcttatatcctaaacacttagcatgttgctttgcgaaatagtagttgctcagaaaattttcttttgtgggtaaattaagtaaaattattggaattttagtaattctccactttcatgatttggtgtgtgcaaaggattagaaagtagattagcttttacgaggacagactgcagttggattatatgttctaaagttagaagtatcccagatggggattgagggttagatttttcctttgcctaagtctcaggatacaaaatcaatgtgcaaaaatcacaagcattcctatacaccaataacagacagagagccaaatcgtgagtgaactcccattcacaattgcttcaaagagaacaaaatacctgggaatccaacttacaagggatgtgaaggacctcttcaaggagaactagaaaccactgctcaatgaaataaaagaggacacaaacaaatggaagaacattccatgctcatggataggaagaatcaatattgtgaaaatggccatactgcccaaggtaatttgtagattcagtgccatccccatcaagctaccaatgactttcttcacagaattggaaaaaactactttaaagttcatatggaaccaaaaaagagcccgcgttgccaagtcaatcctaagccaaaagaacaaagctggaggcatcacgctacctgacttcaaactatacttcaatgctacagtaagcaaaacagcatggtactggtaccaaagcagaaatacagaccgatggaacagaacagagccctcagaaataacaccacacatctaaaaccatctgatctttgacaaacctgacaaaaacaagaaattgggaaaggattccctatttaataaatggtgctgggaaaactggctagccatatgtagaaagctgaaactggattccttccttacaccttatacaaaaattaattcaagatggattaaagacttaaatgttagacttaaaaccataaaaaccccagaagaaaacctaggcaataccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaaccttgggagaaaatttttacagtctacccatctgacaaagggctaatatccagaatctacaaataacttaaacaaatttacaagaaaaaatcaaccccatcaacaagtgggctaaggatatgaacagacacttctcaaaagaagacatttatgcagccaacagacacatgaagaaatgctcatcatcactggccatcagagaaatgcaaatcaaaaccacaatgagataccatctcataccagttagaatggcagtcattaaaaagtcaggaaacaacaggtgctggagaggatgtggagaaataggaacacttttacactgttggtgggactctaaactagttcaaccattgtagaagacagtgtggtgattcctcaaggatctagaactagaaataccatttggcccagccatcccattactcggtatgtacccaatggattataaatcatgctgctataaagacacatgcacacatatgttcattgcagcactattcacaatagcaaagacttggaaccaacccaaatgtccatcaatgatagactggattaaggagatggcacataccatggaatactatgcagccataaaaaggttgagttcatgtcctttgtagggacctggatgaagctggaaagcatcattctgagcaaactatcgcaaggacagaagaccaaacaccgcatgttctcactcataggtgggaattgaacaatgagaacacttggacacagggtggggaacatcacacactggggcctgtcgtggggtggggagaggggggagggatagcattaggagatatacctaatgtaaatgacaagttaatgggtgcagcacaccaacatggcacatgtctacctgtgtaacaaacctgcacgttgtgcacatgttccctagaacttaaaatataataaataaaataaataaaaaagttttttcctttgcctttcactttgatcatacacatccagaagtcactttttattctgttctagctcctgggaaaaggatttgtttgtgaagatacaaatagtaaataattaaggtttttaaaagatgcattctgtcacatagacctgaatgactgttgcctctgtgctagccttcttggagtaaacctgcaatttttttccctttggtaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggaggtaagagtgttgccagtaagttgaaagtgttatttttctggggcagggttgaatctgtttaccttagaaatagatattctgtcattctcttttgacctaagaccaagatgctaatgactggagccccaagccttttgtttctaaatgtgtggcatgactgagacctctcaaaggctttgcctgcgtgttctgtgagctctcagttctttaaggaagggatactgcagaagcctggcaagtgccatgggagtgcagcctgcttctcatcctcccacttgtcttggaagatggaaaacaaaacatgtctccttactgacagaaagccaccagtattgtaaaggatcatctcaggtctgattcaactctgtgttaaagagaaaatgataggagatgttataacttgtatttattttttctgatagagacagggtcttgctacattggccagggtactctcaaactcctggcctcaagccatcctccccagcctcccaaagtgctgggattataggcatcagccaccacttcttaccaagatgagcagacagggccagggtcaagttctgtaatttcattgacagatgtttccatagacttgcctcacggagccatcagttcaacagctaccctacaagcaaacttgacatctcatgaatttgttttgggctaaaagcgtgctgcttttgtttgtccttaaatacatatcccttttgaaaacagaatgcgtggaagtgttcagaaatctaacctgtcaaaactaatacagtatctttttgtttgatgacttcagttagagccagggataatggagtggaactttagatgtatgtaggataagggtggaggctgaataaacttagacactccatccttacttgcaagtgtgtgtctgtctgcagattgatttattgtgtgtgtgtttgttttcttaacagatgtatccagagctacagatcacaaatgtgatggaggcaaaccagcgggttagtattgacaactggtgccggagggacaaaaagcaatgcaagagtcgctttgttacacctttcaagtgtctcggtgagtgttcttggttacttttcaggaagtgccagccccctcccattttaaatttaattttctcttggctcacagtgaaatatttacacctgttaagaagctgagtgtgacatgaatttattggggaggatttctcttaggggtgtttgctggcttcgagtgtcagtggttgacctcctctcagtgatggctaactctgccttcccattgtagacatccttcctcaggactgaataagggtgctacccacagagcaattgcacttacgccctcacattgtttgatatcagtggtttatggtgatagtgctgagtagtattaaagcaagcagccccaggagaagagtcttctgtttcccttactttcatcccacacacgtttgcaccatttgaccaaatttctgctagttttcaggagaaagaaaagtgacttatggcagcctgtggacagtcaagggtaccggggccagggcttataggacctgccattctgaagggtttggggctggtaggggtgttcgtgactctgtgttgctggtgtcaacattcagagccaatttgagtaaaacggtaactgtttgttatgcagaaacagagttgttgcttcaaatgctcagggaatatattcattttaactatttgtgcctgatacattggaattacactcacatatctgtggtctggtgattcaggaacagatttggtcacagaaacttcaaagggcaaaaaaaaatcaattttagattagccctgatgggattaaagtagatacagcattaatgtagacatcctgagtggttctgtagctatatgtaattggaactattaacttattctcctctctcccttctgtaaaacctttccttctgcttctgatggcagcaaaatggaatgtgatactttttctcattctcacgtgtagccaagccacaggaagaagcggtgcccctgaacaacagtgtttaaaatgtgtggcagttaactttcttttaaaatattcgtgaggagcaagaggggcgtcatgtgtgcttaccaccgtttactttaaacctgggcatctcaaggctgggaggcttgttaaaaatgttgtgtggtgtggtttaaggacgctttctgttctgtttggctctgagaaatctctaggtatgaggcttcatttgctcgttaaaaaagttctcaaactaaaagtgaaatgagattatcctggaatatttgtagacagtggatagaaagtgcttgaaatcgttccttctgcattgctccccctaaagactttgcagcctgattatctcctcttgtttgtccttgtcaccttccagcttcactccccacccagacatctgagtgggacctgggagactcttcgattcttttgttatcctttatctccctgtatgcggtcagtttctgagccagcctcatacttacttcttaaataggcttatagtcatgattttcaaactgtgcgccgaggcacctcggggcattgaagcaaaactcacagggcattccgggatgtttctgatttttcaagggaaatgtaatgacatctgtcaggcattctgcaaactactagctggaagtaatttacagtttcatcatgacatcatttcatttattttgatgacttcatatctctgtgaagctgtttttagttattcctgtgataaaaagcaagtatcttttgaaaatcgctgaaaaagaaatgagggtgatggtgttcagtctgattgcagttgggggagatgtgcagggcccactgggcactaaggtgacaggacacagtacttattaagttgttgggtctaaggtgacaggacacagtacttattaagttgttgggtctaactacttaacttttcggtactttttttagcctaggaatcctgtgaaaaagttcctaagacactcagggtgctgtgagtcgaaaatgtggttatcgctggcttgtgtcctcttcctgcatcagattcccactgccctagctcagcctgtggtcagttcttgtctgggccgagagcagcctccatgctgtttctcagtgctggctgtccaatctgttgcctgcagattgaaaatgaagaccaaatcatgtctctcatgcacaaaatcttaaaaaagaatgttgaaactccttagcgtggcttcaaaactccatgatctggcccttgctcaactctcccctgttctctgtgatgtcatgctttaggttttatcagcatcgaccaccccagggtggtcgtgcaccatccagctctcagcatttggaatggctttcctctgctgactttgcttgggaagttcttcctgcaaggcttacctcaggagttgcctcctttaaagggagcctttcctggtcttattttctatccattcatccaggtttctgtaatactccttgctgttgccatcgcacttatcacactgtaccatgattgttcatagacctttctccaactatgctgtgaacaccttgccagcagcgaccctgttttagtcttttttgtcaacctcagcaccatggtagtgcctagaatatcggatatactgtttacgataattacaacacaaaaatactactatagttggtacacaacagaaattttattttattgctttatttcccaaatgatagagtttaaatttgttagcatgttacagaaccaagcaatagtattgtcgttaatgaaatgcataaaagacagtttaaccataatccatttggtaccttctttgcattgtggtcactgaataaagcattatacaatctttggtgttacttcagacggttattcatgtttaccccagcatccatttggacaacttagtaaccagtcggtagagctatccattgatatttttacataagcacagttgcctgagcctaaacgaataaggggtgacatgactggagtttaagggagggagtaggaaagacatattgcagttctcccttatcagttagattttgatgtctccctgccccttccgctgtcacctccacttcgagcacccaggcagaactgacatcattcagttaataatggccaccaccttttccccccatagactccttagaaagccttttgatgatagtcttttagagttgctattgcttttttaaattaaaaaataatagtttaaaaataatttcaaatttacagaatggttacaaaaatggcacagagttcctctgtgtacccttcacccagatttcagattttccaactgttaacatttgatcaatgtggtaaaaaatcttattctcccttcccagtacccctcacacacatactcgaggtttgttgttttttgaatcatttggcaataaggcaaacatggtatccttatgccttaatactacagtgtgtatttttaaaaagcaaggaaattctcctacgtaaccgtggtataatcatcaaaaatcaagattttgtagacaatatctagttgatccaatatctcatctacagaccctactcaggtttcacctgttgttctaataacatccaggatctaatctaagattacatgttgcatatttccttgtcctttgtgacattgatttttttttttttaactacagaccagttcctttatagaaaagttttcaattagcagtgatcacgcctccgataaacctcactggctacgatactgccactgcacaaagctcagttcctttatagaatgccttgcaatttgtgtttttctgtgatccttttgatttattcatttttgaggggagtatcacagaagggttctcactgcatcatagcaggagtagtgcgataccagtttgtttcatcacctggctaagatggtatctacattcatttgtcttactatgtacacattgtctgcatttggccagtgggggccccgttatgctggttcctgtgtccttataacatgtccctatcattctttgagaactttactttctgatacaaaagattctccaagtccattctgtattttccctactccactcctggagtctgttttctctgagacaccatggtttcttttagtggggaatgctattttgaaacccagatctgggccttaggtgatttgttttttgtttttggttatttttggacagagatttggacaggtagtgttattgcgatatgaaaactactaaagttctgatttaatatctactttgaaaacaaaactggtctcggcagctttgaggtgctgtcttctgcatttgtaccttggtctgttggcatagctcacttttccattgcaggtgtccttttgcaagtcttctagcctttgagttcatgacagccactgacagttcaccctgttcctggtgtggacccctgtgcaaggtgaatgttccactctcgagaggtagcgtggatccttcacttctctgaaccctgttttccctgaaacatacctggggtgaccaccagacctcattacataaggctgttttctcccacctgggtacagcttttaccagctccctaaattacatggttttcctgtttgcacctggagtgtacttttgtagtatatttattattatttttttaatttttaatttttgtgggtatatagtaggtgtctgtatttatggagtacacgagatattttgatacaggcatatagtgtgtaatagtcatgtcagggtatgtagtagatttacttatatgcatgggtgttggtgttggaggcttcctcaagtaggtaaacaacctttgttatttattctgaaaggaatttcagcaactctgaaaaagctctaaaacctggatggctgccatagcactgctggagagaagtagtaggaaagaaaagctgaatcacagggatgattagaaattggcgataaatcctaactgcagcttaaatgaatattgtataggttaggttttgctatattgccatattcattgatcagcaaaaacagtagagctttatgtttgtccagtgacttaggaaattgtggcaattatattatactccgctgataaaattgaggatgttaccagcttgaatataaattactaaagtgagagcaaaccattttcaatgttctgtaaaacagagtaatactgatctgcctaggtaaatttttttccctaggagcttctgatgaaaaattgtagcaaaggcagagagtagcaatgaaatgatagagcggatgctgggattgaaatgtgtttcctctttcagtctactttttaaaaaggggtttatttttcaataaaagaagtttgcattgggggaaggggacaaaaacaattattttcagtttctgtactaagttaactgtgattaacattttggggtatagatgaacatttttttctttggatacacatggaaatgtatatacttttaaatgttttttccctaactgtgatgatacaacgtatgctcctctgtttaaagttctgtttatttttatttggcatttattgagcttttattatcatgtgctacttttagggatacatacatctttgaataaaagataaggttgggagaaaaaaaaaagataaagttggccttaagtaactagcctgaagaaggggttagagatacgcagtgggtttccttttgtttgtttgttcaatgattttaaaaattattaaaccaccatggaaaaatgtccatgttaaatatacacataagccatatttcttgtaaccccatactattctgttgtatatatgtatcatcatttaattaattccctctcgatggacatttaggtttgttctagttttttgatattaataacactaatgaatattttaattcacttgcctagttatttccttagggtgtgtatctttttctttttttctttttctttttaagacagggtcgccgtcacccaggctggagtgcagtggcgcgatcttggctgactgcggccttggtcctgcgtgtccccctttccaccctgcagctgagattacaggcattcgccaccacgcctggctcatttttactatttctagtagagatggggtttccccatgttggccaggctggtcttgaactcctaacctcaagtgatccacctgcctcagcctcataaagtgctgggattacaggcatgagcccctgcgtccagacatccttagggtatctttttagaactggaattgttgaatcaaagagtactgttaaaagatatatatatatatttttaggccaggcctggtggcttatgcctgtaatcacagcactttgggaggctgggatgggaggatcatttgagatcaggagttcaagaccagcctgaccaacacggtgaaaccccgtctctactaaaaatagtaaaaattagctgggtgtggtggcgaacgcctgtaatgtcagttactcaggaggctgaagcagaagaattgcttgaacctgggaggcagaggatgcagtgagccaagattgtgccactgtactccagcctgggtgatggtgtgagactccatcttaaaaaaaaaagttaaattttagaatttagtttgttttcaaattcagtggtgttcttttttgatttttagagatcgaacagattgattcagtcatggaatagctgaagattagtggcatttaattttatggtttagcatggaattaattattttattaaatttttggcatttccgaaaaggttttgattttaaactttaattctgaaatattacaccaagcatcctgaagagatgagacataatgtgatggttgctcatatgctcaccctcctgatttcagttcttcagtgttctgtcatgtttgcttcatctccatctttttttttttctgagacggagtctcttgcccaggctggagtgcagtggcatgatctcggctcactgcaacctcagcctcctgagtagctggaattacaggtgcatgccaccatgcctggctaatttttgtatttttagtagaggtggggtgtcaccatgctggccaggctggtctcagttcttttgcaacatttacatgcatctataaacaatgtttttgtgttttaaaatttacattaatggcatcatactgtacctgaccttttacagcttgcttttactttacatcattttttagtttatccaaggtgttgtatagattgagttaaaggttgtatttctgaccaggcgcagtggctcacgcctgtaatcccaacacttggggaggccgaggccggggtggatcacaaggtcagtagatcgagaccatcctggctaacatggtgaaaacccgtctctctactaaaaatacaaaaaaattagacgggcgtggtggcacgtgcctgtagtcccagctacttgggaggctgaggcaggagaatcacttgaacccgggaggcagagtttgtagtgagctgagattgcgccactgcactccagcctgggcagcagagcgagactccatctcaaaaaaaaaaaaaaaaatagttgttgtgtttctatagaatatagattagtagtgaaattgctgctttaaatttttttgatgttgcagttgcacatttaaaagtgaggttttacaaattaaagtgcattaactgttgcttaaatatacattgctttatgagtatggttgaatagttcgtataaaactagttcctcaagacttcactaacattaacatcaatagtgcctaccaggtgtcagtttctgtttttattttaaacaacaaacccacatgtggaacaatagtttctgttctaagcttttcttgttgtatagattatgtcatttagtccccacaagataaagaaaccgagggacagaaaggttaagtaacttggctaaggttactctgctagtaaatgacagtgctgagattgaaccctagcattcaaccctgcatatacttttcctttagcatccacttttgttgctttttgtcataaatgaacaaaaacagcctagttaattcagaataatcacattaaaccatgtgagttggtggttggatgtcagaattgaagtaatttctacttagattgagtatcagggttgttcattctcgtagaggcagattctagcttactgttggtatttttgctatttttaagcaatgcttttaagtctcgttgattgctaaagcctgtttgcaggtactgcctcccctagagcctttggggtcctcaagggtaagcagcatgtcaggctcactttcgcaatcctgcttcagtgtcacattgagctgtgtgatcccaaagtccctgtgctagcagtgctgagaaacctgactgccatttgtaatgcagttttcatgtggggggactgttacactgctacagcttgtcatgtcaggagcccatcttcccctacttacacatcagcaactccctttctcttaccactggggcggtagaaagactgacttcagtgcttgcgcccgaggcccaaggcagaggatcctgagagactcatccatgatggcgaggctgggtgggtctgtgtagacttcccactagctgggccctaagccctttcttagaccacattactttctcatgatattttcagggttttccccccttaacctcagaggttagtctgccagctgcatcttcctgccactgcttcctgcatctcttcctgggctaagcacccttctcgccctctcttcctctccctctacactgtgtggagcacatggcagacgtatgcccagtgtagattactgagccttaccttacactactgatcagagtcttggggtgatcatccagtgatgtgttgtatatttctaactttttattgtggcaaattacaaacatggccaaacaagagacgatgataccgttcaccctcacgtactggttgcccagctttgtaaccaccatcagttcatgagccactcttccaccttctataggcccactccctcacaaccctgattatttggaaacaaatcacataccatcttttccctgtaaataaacagctatgtgtatctttctcccgactttttgggacaagttttagaaaatgtaatagtgaatatctctgtaccctttacctagattctccagttttacctgatgtttttctctctctgcatcttatatgtatatttttgtgttgctaaaccatttgaaagtaagttgggatatcacgacagttcatttctaagtatttcagctggtttctcctaagagccagggacattcttctatatataatgacaatacagttgtcatgtttggaaattttcctaagtgtccaactagtgttttttatagcttcctttttaaaaggatcacatactacatttcatctaggatagttccctagtctttctttagaaacaaaaactttcatgacaatgatattttttaagagtccatgccatttgtttaatgtaatgtccctgagtttggatttgtcttagtgttttagcatgattagattcaaatgataatatattttggcagaaatactgtgtaggtgatatattatttttaggacatcacacacaccagtttgctcgttatcagtggtgttaaattggttatctggctgaggtagtttgccaaggcttcccaccgtaaagacacctttgcccctttgtaattaatcattgattattcttactggattcaattattacatcatgttttgtctaaagattcatctgtacttgagtagaacacctggttttagtttcttgggcatttgattacagaggtgtgggcaggaataaggaaggcagagccatgtggggagagtagctgtgtgtgtctgaggcgggcatggaggtgatcctattatattccccgtcacgtgttgctgtagccctgcagtgggactgcagtcagggggcttttaaaaggtccctggcatcatggctctgacagattggtgagttcttgtggctgcttggctagaactgtaccatccagtcagcctttgaaggtacgagatgtgcatctgctcgtatacatgagactgctcctggctgtgtagactatcatcataaacttcagtgaggggcattttcaccttgaaatcatggtcagatccgctctgacaaagattctcttttccagtgggtgaatttgtaagtgatgtcctgctagttccagaaaagtgccagtttttccacaaagagcggatggaggtgtgtgagaatcaccagcactggcacacggtagtcaaagaggtaagagaactcggggggaaagtcagctgctgttgtatctgttaggagggaagtagcacttttctccaaatctcaccatgcttttaagttagttatgtttcccccattatctccttaaggtttacaattacttctgtcttataagttagaaatatttgggagagaagtaggtatttgtgtaggagagctcagtgttgacagtcagctcctgaagttgaggatgttaaggaggtggctgagcgagaatactgtatgctgctggtgaggctcccaggaaaccatcctaaccctaaggccggcatggaaatcgccagtgatagaaaatataggtctggacatatgcacaggcaggactgcatgccatctcacttttctggtggcaagaagtaccctttcttgtcttctgtaattaggctggctctgctctttggtcagtaatcttcctttggtcaaatactgaagtagtgcttgcaccagtggtgagtatctattaacattgaccaccttatctggctttagtcattattagaaaaaaatgctctcttcctgacttttttccacatttgggatttcagtatttttggaccagatcatgtttccccattgtaaattaaaatttataaatcttacaataatattattacaatttttttttgacagaaaatgtatgtgttcataagagaaagcattgctaagtgatttgataagggtttattttggagggtagagatcggagtgtatttgaccacgtttactctggagtatgttctgatgtggcctgtgggtttcttttaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaaggtaactcttctactttgaactgtgaagtcgttttgcctttttgttagcccttctgtaaagacggctgttggctgctagtccctcacttctggataaactgggcattcctttgttctgctagagttgattaagcttgcatttcattctagccattgccaatcacaggagtacctgtgatttttgtgtttacatcattctgagctgttattttctgcaggttactatgatattttttaagagtccgtgtcatttgtttaacataatatccctgaatttggatttgtcttattgttgtatcatgattagattcaaatgttcacaaatacttcccgtttgctgatgtagctgggccccagggcttagtggcacggtgaaatgtgcgttgagcttatttcctgcctctgtttttgtgtttcagaatagagaagggacccattgttgtgctttgcacataggagctattaaccttcctttttttctattttggccttcagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaaggtaaccccatgtagagccatggctttgaaatccatgtggtaattattcacttagacttttgcattgcgtctgtcacaggtaagtcagtcacagaaggaaaggtgtggtacctctgcactgaaggtgagttcagctctccagtgcagtgatgggatggtgccgtcttaacaaagtgggcaggcaggcacatccagggagagatgtaggattgaattagagaacggggactagagagtaagagagacaacgtagtccgcccttcagcaggattcttccacattcatcctaaaatgttccctccccaaggggagctcccctcttcgataccactcaagttctggcctcctagaatagaaatggttttcttggtttttcttttcctgcttgtcttctaatctgtaggctgccctatttgtccagatgttttagttgggagggtgaaatttattgacctgctggtaacagattggggcctgcagttttttttttttctcatcttgccaattaaaacacgaaaaggttgcagtagttccagagccattaacatgcagcctcctgctgatcgtatatttgaaaccaattaagatgcgaagaattatttaggacccaagttgggggaaattacttaaccagttgagaagtttgtgatttgccttagagaacataaaagtgggaaacaattgtccgttctaggtgcttgtctttactacgggtatcaccacttaaagcagcctttccactcacactgtctcctgaatagacaaactaggcagatacctccactgaacagatcagaaatgtgaggctctcgcagctgtgagacaaaggaattgctctacgtcaatctaaactcagatctagactccagagggtgccaaaaaaatatttatcccagttcctaaatgtctctactctgtggggaagcaacttgtcctcagcaaggctggcctgagctggagctttcggccaccgggcctccaggctccgtccagtctcaggcctcccccagcccatcccccagctcgccagcctgtagcattttgaagcatttgacgtcactgcctctgtcctgctgacactctgaccattttcacacagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgagtaagtcctgcctcgcgctggtcccgtgcggcagcaccgtcctgtctggcgtccgtctccctgccgtcttcgtggctgcatctgtgtggtgtccctgcccactcgggtgtttgctgtcggtcgtcttcccctcatctttgtgctttctagatctaggctttgctctcctgccggcagtggtaagctcagttctcgtgtcctgtgctcaccgtgtgtctggtggtgcttggtggtgatggtgcgtacccaccttggtatagcgggcagcacagccaggggcttgttctttcttgtctggctttggagtctgcaggtccccaggccactgtagtattggtggggaaggcagctgtcccctgggctggctctagcttagaggcactgaacattcctgtctttgaactgccctgtcactgacccctgtgatgcatgccagctcatggggcgcctcctctcgaaaggagtgacagtgaagtactttgggcagtctagaatattgaaatatcttgcataatgcactctagagagagctagcagccaagtggtagtgactcactctgtttcttcaatattttgcaaccgggtcacacagctttaggaagtgagaggatttcagttggtgtgtgctttggtgtgacaggaaggtcagtggttcagttgagttgggtttatgctggacgttggtagaaagagtttctaccaagagttttcccttttctccatggctactcctttttctcgttaagaccttcagtctctcaccttgcagcactaacctacacattaggaaaatcctcaggccagacagtttttcttggttcctactctggaatttgttggagtaataatttgctatgaagaatttggctatagcttctgacggtttttcattcacatgccttcatgttccctcttccttccttctaccaaaagatctttcaaatcttaatgtaatatggcagtgccttgagtgcttcccttccagctccaggaaagctgtttttattcggtaacagttgaaaggtgaaagaaaaggaggccttagggaaccttggtgaataaactttgcgttttcaggaaagatttagaaatagaaattattgtgatacttactgctttgtaaaacttggactgaagcctgaggaatcccactgagtgtggaggtggtgatctctacccgaagggtcagctgggtggtgctgtgagacatgatggagtggcaggtctgtaaaactcccgtttgctgtggcttggatgagatttgcctcggagaagctttgtgttcatgttcttgtggggcctctgcctggagggctttgcaggttgagaagcatcaagtttacttccagtgggagcgtttttgttcttctttgaaggggctgaggctggcggatgtgccggcttcatgagtgggtgattccacagggaccgagggtgtcttcagaaaaaagcatttcggcccgctgtcctctccactctggtcccagggaggctggaagcagcctgtgtttgctgttccctttttccagtccagcaatgtgaaccaaaggctccgtctccagcgctcaggcctttatagcacaggcatgtgtcactgatccgcatgatggactgcagtgcttgaaattctcctccactgaacttgcgagtgtcttggggaatggcatttaccaagttatcgattctaatttagttaatctgaaagtgggatattgacacccttttaaaacttatgtagggctcatattcttcatgactttagttgtcgtttttaggtctgttaaatgggcaaataaaagatgcttccgacagaaaaaagttgaactggctggctaatttgtagctgtattcatcaattatatggttgttttaatgtattaaaatgatacaattctagaaattaggtgaatttgcttctgaattaaaaatcagttgaaccttggcattcactctccacttagctctgaaattgtgtcataatctatcaagcaagtccacaccagcttgggaaatcttgcatgaattaggctagtaagtgttaccttaggtatgtcttgagaggctgactgagtaaacttgtcatctcagtcctttcccttatcaggctaaattccatcgtgcagagacttgcttgggccccatgagagattatgcccatccagcagtcgggggtgctccaatgggcctgtgctctggggaacgcttgggaagccctattggtcagtgtcatggatcaaaaagccctatcttcatatcggtgaaaggtgtccttgtcaaatagagcaactcagttttatccttgttggttctgtcactgatggtggggctaagagtccttcactgatactgaaaactcaaaattatagctggagtgatggggactttctctacccagcgtatatgcaaagaacattcacttgagcctgttttctgttgtaaattaagactcaaagatagccagaagagcagaggtacctgagtaataaatttctttaaaaataaggaattgcataaaagtgcctctacagggtctgattcctgcccttgtctctgttcagatgctcagttacgagcaataaggtagctattgtttaggtttccagggttcgagcactgaagggaaggtatagaagaaaccacctctttttcagccctgaggtcttaagtagatgcctcactggtgctgaagctgccaataaattgctgtattagcgtgggctgacatggttgatgaatattgtgtaaggaagattgcccactgtaatctaaccaagtgaagtcttggcagatagcagcaccctgcacttagagaatgccacaaaacaaattgagtccatcctgcaggtcctgagctgggttttcttcctagagcacagtgcatctgatcccaaagagaactccctctgtaattttgtttcagttcctccaactcctctgccaaccaatgatgttgatgtgtatttcgagacctctgcagatgataatgagcatgctcgcttccagaaggctaaggagcagctggagattcggcaccgcaaccgaatggacagggtaaaccttgacaatttcttcatcttcatggtacttggctttgggtagcatggttctcatagctgaagaaaagtaatagcttctccctagattgtcatgctgatgtataaggactggtgagtcaggagagagttaccagtggagctgccttctgggtggacttcttcaccacctgcatccagataatatataatataattatcctctgagcacttcctataccattatctgccctttttttttttttttttgccattaacttgctttaaaatttctttattttaaagaaggaaactttatatcactgttatcaataaaaagctagtaccatttgccgtgagaagaaagtgaccaaccatacaaatatattagatgaaagcaaacatgtactaatacatgctagctagatactgctgtctctggaaggttctgagtctcagagatgtttcttttcctttaaaagggttataagagagcagcaggaacaccaaagtgcaacttttcttctggatttactcaggattgaagagaattgaaaagggaatgccttgctaggcctaagctccaccccaaatcccacacagtcccatgttgggcttacagtttgcaaaatgcttattgttttatccacatcagctctgaaaagtaggtattaacctcaatttttttggtgaggagactaaggcacagagacttttaaataacttactcaaggttatgtaacaaagaggtcatggaattgaggctccatctggggatagttgaggcctggaaccttctgaggcagtaacaatgctaagctcctaagagattgtgtgattggtttccttttgcagtttcctgtgagatttagcatctgacagtgtttttagcaaatggaggagttgtttcggggtattaatcactgctgacggcgtttttgacctttgttctaggtaaagaaggaatgggaagaggcagagcttcaagctaagaacctccccaaagcagagaggcagactctgattcaggtaagatgccttctctggggacatagctttcagcctgaccattggaaaatacggtcagagccccattcccaacgaaattaggattggacaccacctccttttaggtgagggcttacaaggaagttgtaactggcctgtttttctttttcacctcaagtattgctaacctatggtagaaggaaaccaaacccccaccagagcacacctaattcatgccagaaggtaaccttagctcagctgcctttcgttaattctgctttcctggcaaaagtcctctgccattttcagtcttagactgtgacttgtttttcagcagtactgaattttttttaagactaattgaaagtcaaaggatagaaaataaagatctctgatacaattcatctctaactttgtagactataactaaaatcatagcagcaaactgcattccccttcagtagaagagtgttgctaggaatagggatagcaatttccaggactgatttggtttttacaaaactgattttgtaaattttaaatcattttatgtttagctgaaatgcctttcctcctaatgtaacactttaataaagtgttaaaaataatcttaaaaggcttttttattgatcacttagaaaatctaacagttttaattcctacagaagtcagtgcatcttgttcagggaaatgtagttcagcaggcttaaactgtacctgtaaacctggctggatacctcacggataacttgcccttcatgactttattgatagtaatggcaaaaatcacaattacttttgcactaacctaatgacaggaatacttcaacagaacttaccacataactcccattggtcagtggtctcagagtttggaagttagtgccttgctgcaatgtgggaaggacagtgttctttttttatagtgcatattgagaaaccaggccttgggcttgcaggcactagcacttgtagttacacagatactaaggaggccctttgacactgaggtttaacttgctctctttaaagaaggaagtaattctcctgatagaagtagaatgaaggtaggatgaagtagactttggatcttacccttgctccactctccgaacctgttactgtctcgcatgggcactgacaggagaagcactggggtctcagggtgcttgcttaggcttcctctgggtgccacaaatcatgtgtggttcctgctttcttggtttagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacgggtgagtcctgcccctagcactgcctgccctgaggtggtatatgtaggggaccaatgtatgacactcaggtcagtaaaagtgacatttgtatgacaagttctggcaaagctgaagctaaggaaagatgatgagggaggaaaaggtattacattctaatatctgtgtatataagctaagcatgacatcgctttatgcctgcgtataccacctgtgatgtgaaagtgttttacgctggaaaagtataacctcgcgaaattgatgggtaattatccagttattgaacttcctttcaaagaatgaaaacatgctattcatgaagacttttgaacaagttacattataaataagattatgaagaaaggggtaaagtaatttcttctgaaactcttgtgtgagtggtctcaaatgattttgtcccttaacactaacctgccttgctttgggggatggaaagtattgggaggatatttgtgtccttaagtaagccggttaaagtcttctctctttgggtgacacaggagactatctagcttataggtgtcagaggctgagccaggaaaaaggacagatcagaagagaacgggagtgggcaggagattctggaaaatactgtatgttaaggagccagtataactttggaacttagttttgctattttacctagacagtttttttgttacttggtaagctaaaaaagccttccagttacagctttcattcttgtgcctagctgagctttacattcttaagtgaactttttaagcttttgttttcctgcctattttcaattctctagtctctggatattaaaacaactgttctctcttgcagcctcatcgcattctccaggccttacggcgttatgtccgtgctgagaacaaagatcgcttacataccatccgtcattaccagcatgtgttggctgttgacccagaaaaggcggcccagatgaaatcccaggtacagtagatgtagtagaaattgctgccgtgagggcatttccagtggggaacataatgccttgactaatggttgaccagcactgctagttgcatttgctactagtccttagaaaatgagttttgatttccgaagacattcggtacgtgaactggtttttgcaaggtcactgtttttaaaacatctttttaaatacttttttatattaactgctttatacttaaacaatttctgaattttttatatcatttatttctgatttagggtattgccagaaccaatattcaagatccttttctaggtatatttatcaagcagatcttaaaaattggtctcttgttttgtgcagtatagtttttgtttagacagacacttttacattcctaggttttgtccagctttactttcatctacagaggtttgtttctggttcctacttctaatattggtgttgttcatatattaacttgagttttacttttttgtattcataaaaatgagcttgcctacaagactgctagcttccgtttaaaccaggaagtctcctagctcagccttagttttcctagagggccttatagtaacaacgctgatcttacttgatttcctctcatattgtaaatacagtgctgtgctgattgtgagtgtcagggtacatgggctcacttactgcacgggtgctggcctgtcagcccagaaaccctccttccccacagctgctatgagtgtgaagatgaaaaggtaatgtgcctaaaggcctaaaggcctttggagtattggagctgagctgctccatttgtggagctgggggtctgtctcagtgccagactccacactggcattcagtgctgccgggttgactcccttgagtgcccttgagcagctcacacgctagtgtagagataataactgtaaaggtgaagagcaggtgtttttttgtctgtttgtttgagatggagtcccactctgtcactcaggctgggttgcaatggcaccatctcagctcactgcaacttctgcctcccgggttcaaatgattctcttgcttcagcctcccaagtagctgggattacaggtgcccaccacagtacctggttaagttttgtagtttcagtagagacggggtttcaccatattggccaggctggtcttgggctcctggcctcaggtaatccgcccacctctgcctcccaaagttctaggattacaggtgtgagccaccactcccagcctagagcaggtgttcttagatatacagagttcacttcagaagctggttgttttggggaataaaagaactcaggcttctaaagagtgggaagaacgtggaaaggggctgggttggagaccctaaggggcatctggtgtgggcctggagctcaggactttgcttcacgctggatgtagcagaagaggagaaagtccaagaggcctggatggaaaacgcatgcatcttgacagggcctaggctcttggggtctacttgattttttgaaaagacttaatcactttccaaactttctggtttaaaattaaattatcgtgttgtattctagccagttttgtgtgagagtagaagggaaggagagattttgatcagtatattaaattaatagagaattcctgcaagtgagatcaagcttccacaccaagtaatgtgggaagtagaatgctcccatttaaacacctttggggagaaaacccagctctcctgtctgctacttactacctgctcttagctttaattctggcaaagcttaccttctgccttgttccctattctgttatctaaacaccagaaaaatttgcagatattcagcctgttgtaacttgtgccatgtctgcttgtctggatatgagtgagatggtgcttttacccccatactatagccaatggtttgctgtagagacactaatttgcagtctcccgctctgtggttcttgtcctctgtgagtgtatgaaccttcctgtctcacacggctcccggttcctctgggaggtgtagcaggacaacacttgctgaacccgtgggtgttgcattttggcttcatttgcattttttcttcaaggcactcactcttgtgctttccttgattgacagaatggcaaatataaaattaaattgctttcatccttgctttgaaaggtcagagagatgtcagtctacaataaaagcatctttccatttagctttttttttcattttgatccttcatgttaatggcttcaggcccacataattaatccactggtttccagcaccctctttaggaaaagcttggtaattgcaggtctaaccaggcggggatgacttagcttgaaaagcttgtgggagctacagcaacacacctcgccgtgtcattggggtggatgctagcccgtcacctttcacttccatcctggaaaactgtaaaaatagtgaccacttctaatggcctttttttttttttttaaataatgaataaccttagaacttttgcattcagaaaaggcagtgagctacggtagatgagtcttcctttatcacccccttaaaatcaggtttatttatacctcagcatgagtttttcaaaaaatagcaatttagttaaataggaataaactaattctttatttaccacaataatcatttaagcaattgcttcactaagcaaaatccataatggttccctctgttgccaagtctgcttttcagccagtaatttcagtcttttttaatcccatctaatctgaccagtggtagaaatcaactgactcttctttcactcagcaaaaccttactgaacattcggcattgtacaaattagagttcttttttttttttttggctcaatataattagtagtaagtgccttgtatgaaaatccagtagctagtggccatttttaaataaattgtctcttaatttggagcactttccagataaattctcatgtcagctgggggaattatacagtctttttttttttttttaagacaggatcttgctctgttgcctaggttggagtgcagtagcacagtcatagctcactgtagcctaaacctcctgggctccagtgatcctccagccttagcctcccaggtagccgtgactgcaggcacacagtactatgcctggctaatttttgtatttttggtggagacagggtttcatcatgttgaccaggctggtctcaaactccttcgctcaagtgatcctgctgtctcaccctcccaaagtgctggaattacaggtgtgagccaccacgcccaggctgaacacgttcttatactttagcagtcagtaaatatggcgtgaggattaatacatttcccctgaccagttgctttgctagactctgtagagaatatgctttgtaaagtggtttttccagaagttgtgtcgatgttccagctgcaagttccctcctggcctagttgttttcagtcacaacacctctccaccataactctgcttccaggtgatgacacatctccacgtgattgaagaaaggaggaaccaaagcctctctctgctctacaaagtaccttatgtagcccaagaaattcaagaggaaattggtgggtaccagctctttgtgtcaaggtcatacgggacttcttgcagaggctcaggagtgaaagctgggcaagagtagagagagatgagcaagcaaggccggtgaagtggggcattagcacatcctggcttcagaagcctggagtccactggagctttcatggcaaggtgaaggaggaaccaaggacaggtgcactggctgtgagccatggagcctcgggcttcactgaccttcactctgttagcggaagaatatctggggtgtgaaattgcaagagactacgagtttcctgttcccgttttcctccttcgttctgattatttcaagcacctgattttatataaattctcacctcctcctctcccggtctttatcttcttcatttattcaacaagttttattatggctgctgcgtgcgtgtcacagagtaaaatggtccacgagcagatggtacctgctggagttgatgtgttgataagagaaaaacagatagtaaaacaagaaaataagtgtcagctggtgataggtgctgtgcagtgtgaaaactcgggcagagtgctagagagtggccagtcggggcggctgcctctggggacggtggcctgagatccgaatggtaagatcacagcgggagagcacgttggtagcagagggagcggcagctacaaaggccccaggtggaagtcaggcatcacatttgagtagatcagtgtggctacaacatagcaaaggggatgtggccaaagtatgcagggaccagatgaggaagaaatttcagcaaaatcaaggagtttggattttattctaggataatgggaagccgttagaggattttcagctagggaaagactagatctggattatgaatttttaaaagctcacttggctgctgtgtgtagtcgattaaaattagaaaccagccaggaagcgattttagaaattcaggagagagctgttgggagtatgcactgaaggggtgacggggtaggagaaggagcaccccagggacagctggggatggtctgtaggatgtgttctggtgggagtgtgtggggctgcgcccagggctgcgtgtggggttgggggagcggcatcaagaagtgcacttagggttccactgggagcagctcggggatggtggtaccatggctgactgaggtggagaaggaaatccggagctctcttgatacatgttaagatagaaatttctgttggatgttatgtggggatgtaggatttaggtgaggcagaggtcaggcagtaggtccaggattcgggcctgggagtcatggtatatggtcagtatttaaaactggcgtcggggagaagtaggtcagagggtatgaagtggtagttgtagttacgtggggtggatacgtctagagatgggatggacagcatgaggactgtagttagtaatatcgtactatatactaaaaatttgccgagagtagatttgaggtattcttatttttaaaaaaaagtaattctggaaggtgatgtgtgtgtttgcttgactatggaaatcatttcatggtgtatatgtatatcaaagcattatattttagaccttaaatatgtacaattttttaaacccccaaaatctgtggagttgtggataccacttaactggagtgtggaggtggatgcaggggtgcctgggacggcgccctggggtccctggtgttggggctctgtggtgccacagaatcaaggaaggtgtttcaggcaggaactgggagccacagtggggtcttggagctctagagcatcctgtgcctggacaccaggcccttctgaagcctgctttctgtcccctgccctgtcttcatcagatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggtgtgtatgggcgacggtgccacttctgggcagcagggggaggacaaaatgagagaattgaagtcagtttttcgaaaaccaaattgagttgggagatggtgttcctgcgagagtcaggggaagggagactggattcattgagcgcctactgtgtgcaaggaccctgctagatgctttcaaatcattggtgtcaatgtcaccatgaagttaagactaattctcccatttcaagatgggtggcttcaaacccccacttcttccaacttgtgcacttccttacatgggggaggcacttggcagttgaaacagcgccttcctgttatggtgttacctttgcccagccgtcttgggaggtaggtgctggagaggctgaggaggtgacagggctggcgtgggtcatatctctgacatgaggtggggataagaagctgttcctctgggtcctaggcagacgttctttcctctattcccctgctggttctcagtgtctaagaggatctctaaaagctgtgagtctgctccagaaataaacaagttgctgagaccagtgccctgagagccgtccccctcatcagttctgtttgttgctgttgctgctgacagggtaatgataagaatggcccacagctatgccgtagtccttgttatatgccagctttagctaagcatctcagcggatgctctccatcctcacagtaaccctcgcaggtgggtagtcgagtgtccccatgtggggattctgaggtataaagagattaagtaacttgcccgaggtcatgtagcttataagtggagagtcaggggtcgaatccaagctgatctggtcctgcagtcacagacctgactggatatagcactggaacagaggcctcaggaaggcatcaaattaggggtggggggatggaggtacatccagcttagccttcagaccttaatggaaatgctttctaaactagcgatcccagagcagttgactctccagaaataaaacaggatctgaggaagtggcagatagatgaaaaggcgccatgccacccgcaaatctccgtgggtttttggggtggtagatgaagaggcaccatgctatccccaaatctctgtgggtttgtcgggtggccatgcttggacaacttcttatgtgcttgttgggggtcggggcagcttggatatacctgaactaggaccttatctccctgtcagcaaaccacaaccaacacttaacttcaattttcacttttttctaagaaaaataattatgtgggctaagctaaatagtgcaggcatctcccagtttccctaaaaaggcacaagacagacctacttttttctctcttatcaaggataccctccagtgatttgctgtggctcatactgctggtttgtttatgggatatttcaggcagggtgtttttaaggaggaatactttttgttcacattatagagaaattctaagatagaaattttaaaagaagccattttcttttttaatctccttttgtgctattttattttgttttttattgttttcctttctgctagacactcagccggagttgtaccacccaatgaaaaaaggttggtttgtccaagatgttccctttaagaccttcattcctctccactccctagtgtgtccgaagcttcatgttctgtttcatgccatcacctggctttccccacctcattccttctgacacggctgtgagtggggtcagagcagccccacctccatgttgctgacaagctgacctgactccagcactctgaggccagtttccatggtgttggttacctcgtggtcatgctaagctttccctctgggatgtcagagaatgcacagcaaccaaaatagatttcatgacccttttaatctgggtagatttttagaagtatatccaacttaggttggttgtgaactgctgtctccgtataaatatgccttatttacagtcaggtggagagtcgttctcttttccctctttttctctgcaattcccatttacatcttttctttttggctctcctcgccctttgtctgtgccagttgtctcatgtcccctgagttgtatattcctcagaacatcggaagccaatggatcaaacagctggagacaacccagctcactgtactgagtctccagttttcaaaaagagttaacgttccgtaaagcactatgtggaatgctttgcattcttgtccccatcttagtccactgaacgtccctgtaggatgagtagtgtttttagctctattttctagattagacaattgaagaagtttctgagatgacgtgacttgctctaagaagtggaggaaccaggatttgaacccagttctctgttccccaagcccatgtgatttcattacctgagttgtcggtgtcacgggatcccccaggtgggtgggtggcccagtcattgtgaatcatttcaacatttcttgttcataatgtgttgtatgagcccacccttggctttggcagacttcctgttgatgggccaaacggtgttgcccggctaagaaggtggtgttctggtttacgccacaggttattctcagaacacaaaagtgtgatttcaatcttctgaaaatgacttcgtgtagatgctttattttattctacttggatatgcctgttcgtggggatgactgtgccgacattcctttcaacagcacaactgagatgtttatagagaaagatgagttttctagaagtttaactggcttttgcttttgtactgaactgttatgagttgggacaatttaaacattaactttggtgtcttgaagtcacttgtttatgttaagaaacgtgggggctataccaccaaaaatctattataacagtctggactggtggtaggttttttttttttttttttttttttgagatggggtcttgctgttgcccaggctggagtgcagtggtgcggtcttggctcactgcagcctcctcctctggggctcaagcagtcctcctacctcagcctcccaagtaggtgggaccacaggtgcatgccaccaccctcggctaaatttttttttttttttttttttttaacgtagagacagggttttgccatgttgcccaggctggtctcgaactcctggactcaagtgatcctcccaccttggcctcccaaaatgctgggattataggcatgagccactgtatccagtgacagtagacctttagtttgctcagtgccacattgctttttgaataattcctgcctgtgtgacctttaaaattctgggagagagaaacatatatatggaaggagctcagaattacagttgattgggcttggtcataagcatccttgctgaggcaatacccttccagatccctctttctcaaatagttggagtgcagtattgctatttcatgggcactttgagacaaaagctagctctgatttaactagaatctagtcgtgcaagtctttaaagttgaagctttagaaaaattgcatcatttttggctgcattgcatgagctagcctgcatgttcagcagctgtggaagctgttacaagttgctatgtgttaagaacaagtctagttgtgaggcagaagctctgctgtggttgtgccttgtgccattacctgcctttgacaagcccagggacagcagtgctttgcatgtcctcatgttgaagtctcacttgcaggtagttaccttagaatgccagatacgctgtcgggttgatccagttataaaaggctcatatcacagacgtttatattgaactgtatgttattatgaataaggaattcttatgatagctagaaatcacatgctttggaactaaaaatagaggacttcctctcacgttccctccctgggcctgtgctgcgtcgtcgtgctgcgtatttggatactatccttcggagcgccacactcgagtgatgttgctcaggcagtgtctgaccttggtgagaggagagttgctgttcttgctgctctgtttagagaaaggtgccttccatgctgatattagaatgcttcctataggtggaatgcacgcttcctgtttatcttctaatagccacttaggatatgagcatctaggatctcggcacagagggattcagcgtggtgggagatgcgggaagaaatccgtaatgacagactgttgtcattactgttggaacctccccaggaccaactgaaacttgaagggaaaataagagtttaggttggggagggtatttgaggcagaatgaattccctgtgggctaacctactatgtccaaggcaaacgtgcaggttattgtgaggatgggtgctgtggcagccgggtgtgggtagtaggtgctcagtaatttctcctacgatggtgtgtatttcccatgctaggatgcccctcggctccgcttctatgtgtcttacaataaacattttctctgaaggcttgcatttcattttcccaagttggagacaagtaagcactccctcctcctccattatacccattggtctctgcaaatgcctgtctcattcatctttagagagcacagggcaccctcagacttgtgaacatggtggcagatgagtcgcgtggggaggtgcgtgttgaggggctcactggccctcaggagggagtttgctgcttctgtgcaatgggtgtgagatgggccatccttgggaactcagccatgatctctctccacacaggatctggagtgggagagcaggatgggggactgatcggtgccgaagagaaagtgattaacagtaagaataaagtggatgaaaacatggtgagcctgttctttcttctgcccaacacgctttacttttgagactcattagagcgagtgacctgatgtcagatgcttccaggtgcacgtctctgtgttcgttttccgcacagtagaaggttggagggctccaacggctcccacagactggctgtggtgtttagcatctgggtatgaaaaggattaaaaagcccttttcagcagtagctcatctcttgctatagagtaggaaaatatatttacaactaaagatatgaataacctgttagaggccattttcaagtgagtagagagttaataacttggattagagttgggttttgttcttatactgccttaggtttatacccccttttattcacctagtattttctgtcatttatagttctggattatcttcaactgagtttgatatttcaatgtggctttttttttttttttgaaatggagtcttgctttgtcaccgaggctggagtgcagtggcatgatctctgctcactgcaagctccacctcccgggttcacgccattctcctgcctcagcctcccaagtagctgggactacaggcgtccgccaccacgcctggctaattttttgtatttttagtagagacgaggtttcactgtgttagccaggatggtctcgatctcctgaccttgtgatccacctgcctcggcctcccaaagtgctgggattacaggcgtgagccaccgcgcctggtgtaaacggggctttttggcagtctgttctgagatacgtctccacaacggttacttgaaggaaaatgcatacgggaccagctgccataatatagtcttccctccatacctgccccttcattaggggtttggggagtggatttggaaggctgtgacagaactggttggttaatgggggtcccacaggtacctgcttccttccatcaagcagcaggtagcagaggaaggaggcagtaaataccaaactccccgttcacccagttgcttgctgccgacattctcatgactgtttcaggtcattgacgagactctggatgttaaggaaatgattttcaatgccgagagagttggaggcctcgaggaagagcgggtacgtgtttagctccagaacctaaggtttcctgccaatcttaggtatttctcctctggaccttctcagttcaagtagaaaacgggagagatgcctgagctaataagggtccctcatccccagctttccgtacttttggataagaaagctaaaattaaaatctccatggagattgggaagagtgggcgttctccacctgtgggtggttccctgcaaagcaggatcttggtgctactttgggttttaggggctcgaccttccaggagcgtggccctcagtgagttacttgcctcacggctgccagatggtcactgggacttttttccacgtctgctttattacgtaggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggtgaggagctgggctgctgagggcctgctctgcactgtgggctgggttgggggtgggaacctgtggaattaataggcatcttcactcctcgagtactggacatgctgctgttatcagttcagttactcactggattcctaggtcgtgtttttggaaatcagcccctgccacaaggggctgttgccaactttcaacattagtttgggccttggctatgaatgtcagaaagtcatgtgaacattttatgctacagagggtgaaaactcttttctcagattatttccttagtgttcctttttccaggtatttttttttttaatgggggaaaggagcaacaggaaatttagaaagtgctgaagcagactgtttctgttctgtcttctgctggttactgaacttgtcttgccactcactccttagtgaacagtgggaatgtccagagtcccttgatccccaaatataaatacagtaaggaccttaatgagccctgggaaattagtgcagatgctggtcttagttatttgtgtttttttgtttgttttggttttttggttttttggagacagtctcgctgtgtcgcccaggctggagtgcagtggcgcgatctcagcgcactgcaacctctgtctcccgggttcaggtgattcttgtgcctcagcctcccacctagctgagactacaggtgtgtgccaccacgcccagctagtctttgtatttttattagagataggatttccccatattgaccagggtgatctcaaatcctgacctcaagtgatccacccgcctcagcctcccaaagtgctgggattacaagcatgagctactgcacctggccagttacttggttttatctcctgctggagactggcctagctgtagaatttcagaactgaaaaagaccagagatcccctggtcccaccgtctgcttgctagcctactgctgactggcttgccttggctggcccaggtagtaagcagtggcgccgagccttgcttgtcaccacggtgctaggaaatccagttgactgtcatcttccgtgagggctaagctttcagggctctcgtttcgaaagcattgcctctttgatccccttattttctttctcctgtgtttcaccaccggttctcatttggcctgtccggtgggaacgggctgctggctgcatttggtcctcaggggattgtgcagcaaatggctcaggtctcccagcaccctgtgcaggtctcttcccagacaccacaatgaccctcaggttttgttcttccaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaccgaga

SEQ ID NO: 1012 - DNA, 50576 bp, Homo sapiens
agcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgaggtgagcgcgggccggggacccggggcgctgggaagctcctgcccgcccgaccctgcagcgcggcgctgggctcggccggctcccctggcgtgtccgtcggtggccgagctctgggcgcacaggtggaatttcctgttcagcgggtgccgggccgcgggcgggcggggctggccggacctttggtaccggaccggctgcgccccgccagggggaggcgggaagcccctgggccttcctgcgccctcggtcctttctttccctgagttgaaaaaaggggctccgtctcggcccctccatgactctcgcgctgttagtgaacatctggaagaaaccaggggcttggagtggggttatttgggaggaagtgaaatttcaggagggtttggagtctcagccatccttggcctctgcagaaagtttctttcgtctctctccttccccgtcaaaaggcgctttgggacctcgcagaggacaactgggaggccagggctttggctgccatacgggctggagctaagaactccagagttgggcttgcctgggcttctcgagaggggatggagccctttgggaaggcggctgtatgggaagggatgtgggaacacacatgtcttgagccttttgcgaagtaccgaaacaggaagctcttctttggcagaaagaacaatgaaagacctattgaaagatctcaaaaagattacatgttcctgtatggagttggggatgggtcgctagtcacttcattgacggacccacctaggtggtagtgcccgggcgggaccagcagccaggtctctaccctctctgtccaaggcagacccccaggtttcctggaaggccagggcataccaggtcagggcggcgctgagaggcaggggctgtgtggcagagagttttgctcctctgcaaatgatggcctccctgccctgccaaccctcactttctcccctccttccgggtgcccctgggctccatagtctccgccgttgctccctaagtcaggcctgattttggtgctgtctcagatcaattccttttgtccaagcagcatcccgacctagggagcttgcagaaaatcagacgctggggctttggaggctgcctgcaccacagacaggacctggggctgggctctgctattttctccacttttcaccctcagcaaggaggaaagcttccagtggacctgaaggcttgggcccttcccctggctgtgcctgtgccctgctgtgaggcagattcaccttctcttccttgctgtaattgctatgtttgtgtccttgctaattgcctacttggggttctagactccctgcctcttcagcagagaacctgctgtttggaatttgttatttcagggcagtccggtgcccccaccccaagtttgttctccctgacttccctttctaggactctcctgcccacacggggaaagcagggtcttcctggtcgtgtggtccagcctcctctctgagccatctcaccacctgacaagcagccaggctggggctcaccttccactcacccccaggatcccacattcagcggacttgtcttgtcacctgcaagccctggctttagtttcccccatccctgctcatttcctcctcctctgcgaagctcatttgctctctgcgcccttgggctgttccttccccctctgccattttcattctcttggcttgctctttgtcttttctcctgccgagctttattgaactaactcagtacctagtcccatgggtgaagggaaggctctcagagaccagtaagatgtggttgtttcctttaaagaacatccagtcttgagagcgaaactaagagacgaatgccaaagttagctgtgaggcggagtgtccagaggaaattggccaaagctcatttccatgtcttgcagattcctcccatccctggcctcaccagaaatcccagtccctgggatcaccctgtagtgtgtgtttgcagctaggatgtccatccccggccgggaggtgtggctgctgcccctgggtttattatctgggtcagcagagcctggcccacagggtgctgttgtttctgggttccttgtccccagttgcatccatccgtgcacccttgtttggtggtatttgtatctggctgtccccttcccaaggctggtggtgtggcccctgccccacccctgctgttcccatcaagtgttctgcgtggccttcagagtcctgatgcacgttactgcatctggggatggtgtgagccctgcctgcaagcaagcagggaaacagatgccacttcttatggccattaatgagagccagggagcctgcctccctgagggtcttgattcctgttgagtatttgatggtgaatatgaagctgccttgacatccactggttccttttccgatcacaattgccctaggtaagactcagcatcccttaggcatccagagaccaagtttggaaaaatcggatgttgtgtggccaaaatcagatgtctaggggccagggtgtacacctctggctattcagagggtcacctgcttgttaatttgtcaaccattcaggcattcattcacataacaatatctgctaggtaacccactgactgagcctgtgccaggtgctgggaaatagcagtgaggaagaccctagactcacagcccctgtccttgggaccacccaaggtagtgtggggtacagggaactgaattctgactcatgagtactagcttctcgatatgcactgggtgagcacatggcatctctctaacccaggctggaagggccaggtcagcaaattagggctgcaggcatctgtgatgtggtggcaggaggtaacatgcagccaagacccggggccgccttgtctagccacgtgatctcagagatgttactcaatatctctaagccttggtttctgtggctataaaatggtgatgacatatatgttccaggtttgttgaaaggattaagaggggtactttacatgaaagccctttgtaagttgcagtgtggtgttcaaatgatgcagcttgagtttttgagttgaaagggacttgagacaagcaagaagatcgtatagtatcagtaggtcgcctgtcgagaggctgagaacccaggctgtcagtggggccctgacctcacagaggagccatcctgccctgccaaacacagggaagtgcccccaggattcaaggaactgctcgccagcaacagagacctcttcctaagaccttctgattttcattcccctgctttacccagcttctaggagaaatatctttctatgaaaagaaaatgtgtgccagctgcatatccctttctccttctcatcccctgcccctcccaccatagaaaattaaacttttattttgttttgttttttagacatgggggtcttgctatgttgcccaggctggactcaaactcttgggcccaggtgatcgatcctccttgtctcagacttctaagtagttgggattacaggcgtgagccactgtgcccacataaaactttagagaactgccttttttgttctctagagcatgtgctgggcaggtgtgtgcagtgggtgaggaagagggttgggaaggcagaaagcagcaggaagctaggattgtcctgtaggtggggcttcagctgctggagtggaccggaaatctgccttctccaggggctttctggagccttccctctgccttggtcctgagaacacctggaaattcctcgtttaggagttgagaaaactgaggaagaggagaagatgcccctagtttgatggctgccttcgcctgctagcagtggaaatggtcagagggtggacctgctcgagccgacttgctggcctgttgccacgttgtcaccggctgcggaaggagaacgagtcacagctccctccccctacctgaccctcactctgctccctgggaaccagactaccagactgcctactgctgtggccagtggcttctgtccctcggaacactgtggccctcaagttccctgatgtctgctccttctctggtctgtggttctgccaaggctggtggctcatgtctcttttaaaagagaagttgtctttggaagaggaagggaaacgtgacagagtcccctgggagcccaggtcctgaagatgatgttgcttctgatattgtgcaatgattactggagtgtctagaatactaataatgatgaacactaataatcgttagcatttattgagcatggctggctgcttgtcttttttcctgccaagcttcattgaactaactgtgtacctagtcctgggtcaggcatggctgaagggaagtaagatgtggtcttactagtctttgagaccaagtattacccttctcagagacaagtgttgttattactgtttttttttttttttagacagggtctccctctgtcacccaggctggagtgcaatggtgcaatcatggctcactgccactttgacctcccggctcaagcaatcctcctgcctcagctttctcagtagctgggactacaggtgggcaccagcacgcctgactaatttttgtattttttgtagaggcagggtcttgctatgttgcccaagctggtcttgaactcctgggctcaagtgatctgcccacctcagcctccaaaagtgctgggactacaagtgtgagcccccacacccagccttattattattattattattattattattattattttgagatggagtttcgctctttttgcccagctggagtgcaatggtgtgatctcagctcaccacaacctccgcctcctggattcaagcgattctcctgcctcagcctcccgagtagctgggattacaggcatgcaccaccatgcacggctaatgttgtatttttagtagagatggggtttctccatgttggtcaggctggtctcaaactcctgagatcaggtgatctgcccacctcggcctcccaaagtgctgggattacaggtgtgagccaccacgcccggcccagccttattgttattacctttttataggtgaggaaaatggagcacatggaggctaagtaacttgcctgaggtcgcagagcaaaatagtggcggaatctagattggagcccaggtagtctggccctgtcatatcctatgtgggctgtgacatgcggaacagggctgtcagcccacagggttcaggaggggatggaatactaaaggttgacaattcatcagatttgggtaagaaactggatttctcttctcaggttgtttctgagatgcctgggactaaattatagaaaccatttggtaggatgggaatagaaacttacagaattctcagagttcttagcctggcctggttggcagtggtgagaagtgtgtttggggtttgctcagagctcatgggtagtagttgccctttttgctttgttaagaatctttccagaagcagctccctgctaaaaattctgtctcagatgctcatattttcaaaatttccctattctgcctggacttagcaatattttgggattttcccccgaatcctgtgatagttggctaactgatcaaaatcttggatcctttgactctttttggcccacgttggtgatgctgaggtggtggtggggatgatgatggtggtggcgatgttgaaagggtggagaagaatgtgatgacagttatttctacctttcactaaatatctgcacttcaattcctgacctcactttatcctcacaacagctgtgtgggggaaagaatgcccagttcacagacgagaatactgaggctcaaagggtttgtgtaaaggcagtaagaagtagagtaagaattcaaactcagatctacgcaacttcagagcctgggagctcaccaccatgccattataaaattgtgttcctgagatgatggtgaaggttgcatatccccagcaaactgctagaacatgttattcaccagagagctgtgagcacataagaaggaagtggtgatcacccggtgccagtgctggtgtgctacaaacatcatagaccagcttgtctggtttccccttttgatgaggttccttagctggtggaccaggagcacagctggagttgtgatttcaacatgctttacatagacacagctttatgtattatacatatgattaaaaattatggcggaagttttaaaatgaaaaccaattcacccacctctgccaacaaatcacttttcacgcctctttcccctccttgctgtctatggttcaatgtgtctagttggttgttgtgcacacaccacttgtatcctggacaaggtgttttattggcctcctgtctgctgggtgtggagccctgggtgttggaggatcgaagttctggtaggcttgtgtctgattgaaaggctgtgcctaagggggggtctgttcttgaatccacgtcactttgggtggtgacctcaggctgctcgtcaccccttcctgggttctgtgccatttcttatttagtaacagctcagatgaggacttggggcatttgcctaccagctccacagatgacaccagctgggagggaaaggctgataccttgtatgacttgattatgagtcagagcatctggacagactgtctgataggctgcgctgagcagaatgcatccgtctgggtcaggagtcagtgctttgctcactgaaccacctccctcaaccatggagcagaaaccacgagacccagagttctgagttgacagtgagcccaggagagatcaggcatggaagtgtgactgcccaaagtcgaagtgtgctttcttccccctatgtttttatttggttataccttttaaagttattattaaaagtctaatatatacatatttaaagaaaacttagccaactcagataagtagtaagaatttaaaaatgaggccgggtgcggtggttcatgcctgtaatcccagcactttgagaggccagggccgatggatcacttgaggtcaggagttcaagactagcctggccaacatggtgaaaccccatctccactaaaaatccaaaaattagccaggcatggcggtgggcacctgtaatcctagctactcaggagactgagagaggagaatcacttgaacctgggaggtggaggttgcagtgagccgagatcgtgccattgcactccagcctgggtgacagagcgagactctgtctcaaaaaaaattttttttaataaaaatgacacaaatacccctacaaagacattttaacaatttggtattgcctatgcatgttttctaaaaaaatttttttcctcattaccacatttaggaagcttttctttttgaagtcacacaatatagaaatgtacagtgtaaaatgtgaaacttctgaaattccctctcccagattttagagcctctataaatagttttgtttatattctcccacaagtcttgtgtgtgtgttctgctgtttgtgtgcacacctattctcctccaaatggaatcatcactaattccactctgcagtaaagatatgattttattaatgaacttatcaaacatttattagatatcatacctcatgctagatttgtggagcaagacagacccccttccctcccctatcacaggagtctgggagggaggtgttggagagggatctcccagaattactccaaggagatgcctgagctgaatttcgaagggcaggagtgactattttttttttttctgagatagggtcttgctctgtcgcctaggctggagtgcagtggcgcgatctcggctcactgcaacctctgcctcccgggtttgagcaattctcctgcctcagccttccaagcagctggaattacaggtgtgcgccactgcgccaggctaatttttgtatttttagtagagatggcggtttcaccatatgggccaggctggtcttgaatcctggcctcgagtggtctacctgccttgaactcccaaagtgctgggattgcaggcatgagccaccgtgcccagcctatttttttcatttaacattctatcttagatagcttttccatgtcattatctactttttgaaaaacgatttttgattgccttataagctttcatcgagggaacatatcattctttccatcttcttattttaatcgttttattgtttgggtgtgttacttgaatgcatcattggacaattaatagaaaaagagcaaacagaatgaggaaggtaattggcaagcagaccctgtggaggccacgctagtcagacctcttgtgggttatgctggtgaattctggaaacggtgtcttcaagggaagatgactaagggtgagatggaaccagatggccagggtttagaaaacattttgtttgaatgatcagaggagttgagcatgtttagccagaggaggtgcagactgagagagcacacgagcaccgatgtagagcttccactggagcgtctcctgagtggggaaactaggctggttctgttgcagtgctaattagtgcagaggtgattgcagtgctgatcacacttggtggaaggaagagcttcctaatactcgtactaaggaaaatgctatttcttccaaaaggatggtctcgcgaggatgagaggtgggtgacatgccctgcagaatctgtctcggctctgagaatccaatttcaagggtagatccagcagttctcccctcgcttgtatcctattcccccaggatagagtctggttctaatagaggacacagacttcctggtgccctcccctgggggtggggcccctctgtttgcatagttggtcctttccccaaaacaggtgctcagatttgtagccatggaagcgtgttttagaacttacccagttctagaggctgcaggcaggcttgggtttttcccactagcttctgcagatccctgggtccaccaagtcagaaacagactgtggcacctccatgccatgaaatatgactcagcactgaaaaggaacaagctgatggatgcaacaacttgaaagacctccagggaattttgtgcagttaaaaaaaaagccaacagtcccatacataccatattatttatttatataatataatgggttttttttttttttttttttttgagacagagtcctgctctgtcccaggctggagtacagcggtgtgatctgggctcactgcaacctccgcctccctggttcaagcgattctcctgcctcagcctcccgagtagctgggactacaggtgtgtgccaccacacccagctaatttttgtatttttagtagagacagggtttcgccatgttggccagactggtcttgaaatcctgacctcaggtgatccacccgccttggccttccaaagtgctgggattacaggcatgagccaccacgcctggcctatataacataatttttgaaatgacaccatgttagtagtagaggacagattagcgattgtggagctgaaggggtgggggacaggagggaggtggctgtggttacagaaggccatgggcatcctcgtgttggagctgttcagaatgttgactgtgatgccagagacaggggactacgctagcgatgacatagatggaacttaatacttaacgtgagtagcggtgaaacgggaagtctgaataagatccgcggatgatactgctgttgtggtattatgatacagttttatgaggtgtgactattgggagaaactgggcaaggatctcagtatgatttcctacaactgtatgggaatctacaagtatctccataaaaatgtcagtaatgaaaggcacactagctcgtgaaatcagaatgtggatttaataaaaagtcaagaaaacgaatgaaaagaagttactaggtgctggctgcacctcttgtttctcttgtcgggttttgggggatctgcctgtttgtgctgctgcaggcagatgcttctgctctgagtccggtgacttggggcaggaggaaggtggggcagctgggccgggaagtaggtctttggcacataaggagagggctggtgcaaactaaatgggatcgaagaggcagagatggaattttccggctagaattggcaaaagaggttatgtcctggtgtgtgtgttttgggggcgacacactgaactgaggaccaggagagatccggcaaagtcgaactttaaatggggcctgaggacagtgggtggccaggccaggtctgaccccagagagcctgggggactgtcagcagagccctgaggtgtggactgagtattttttccccttcttggttgagggcacttggcaactggcagattattccagcctgccctggggaggctgcctaagtctggctatggggagagaagaccttccatcaacccatcaattagtcaatcaagtgctaactctgggcaaggttgagggtggagggggagggagagaggcagtaggaagaggaaaccggggcactgtgaccagccaggacttcctggtccacccagcatggtgcaggttggggaagaggtgaggccccagggagaaagtacggtggcttgttgtggtcccgggaggattcctggcaaggctcagctttggcctgtgtgctggagggcaggcaggttcggtaggcggtaggggagcccagccattccgagcaggcagatgggttcctaaccgagaggttaggaacctcttggttcctaacaggcttgggggcctttctggctagagccaacgtcagagttgagggagccagtgcccttagaccaatgttaaaggagtgacgacccatatacagtggtgggcacagcaggggcccgtctcttgggcccaagaagtgggttttgtagtagatagagttttgcagagtgttccttttttttttgtttttgaaatcaacactgtatttattgatttagactactttattgaggtatgattgatatgcaaaaagctgtacctttttgtgacattacagacaggggcctgtgctagcaatgacatagaatggaacttaatattcacatgagtagcagtgaaacgggaaatctgaataagatccacagatgatactgctgttgtgcttatcacgaatgacagcaagatagtgtcaattaagacagccatttcaagctactgacatcctgctcttttctcttgttttttgtttcttttgtttctatttaatgtgtacaacctgatgagtgtggatgtatggaaacaccagtgataccatcccataagttaggctgcaaaatatccatcaccttccaaagtttcctcctgccctctttatctattattctatttatttataataataattactattttgtgataagaacacttaatacaagatctcttattgaaggtatggaccaccttttgtgtatccattcatttgctaaggaaaatgcttagtttgttcccacatcttggcttctgtgaacagtgctgcagtgagcataggatgcagctctctcttcagatcctggtttcaattccttcctttggataaatactcagaagtgggctcgctggatctgcagagcatgatctctctgggcttcagttcgcttttctgcaatattgggggggtctcttgagtggtgcaagatcaaagataaccaggtccccgcacgtttgtgtctttccacaaggtcagacttttattgatgcaatttcaatcataaacaccactagccacatggagttcccaaaaagacaattctccttagtacttcctgttcactcaggaggcagagcctcgggcacacaggctgaagccactccacaagtcagtcaacattgcaagccatacataatcatatacttaatatataaatgtatagattaaacatcccacatcaaagtaacatttatcatcaagagaaaggggttaggaaaaagggttaatgaaccagtccagggagagccacgaagacaacaagaccctcctgccctggcctgggcagtctgtcggtttcgtggggaagagtttctgatgttggcagaggcttcgctggcagatgctaggtgcttatcatgagtgacagcaagatagtgtcaattaagacagccatttcaagctgctgaagtcttgctcttttctcttgttttgtttttttgtttcttttggttgcttttttttttgagacagggtctcgctctgttgcccaagctggagtgcagtggcgtgatcacagctcactgcagccttgacatcccaggctcaagtgatcctcccacctcagcccgctgagtagctgtgccaccatgctaagctaatttttttaaaaaatttttgtagagatgggggtctctctgcattgcccaggcttgtctcaaactccagggctcaagcaatcctcccacctcagcctgccaaagtgctgggattccaggcatgagccactgtgcctggctgtcttcttttttttttttttttttttttttgagacagagtctcagtctgccacccaggctggagtgcagtggtgcgatctcggctcactgcaagctctgcctcccaggttcacgcctttctcctgcctcagcctccccagtagctgggactacaggtgcccaccaccatacccggctaattttttgtatttttagtagagacggggtttcaccgtgttagccaggatggtcttgatctcctaatctcgtgatccgcccgcctcagcctcccaaagtgctgggactacaggcgtgaaccaccgcgcccggccattgctgtcctcttcctatggccacagagtcctctactgaggacagacagtggaggagtgtgtatgtccttgtctggctggatgccgtgtttatttatttgcaaaacatcttgtccctgttgacaaagtgaaacataagatgaggtctttttctaggatggagttatttatgtcaagggtgctgtgtacgagcctcacgcatctgcagtgggaccctataggagggcaaagaaccagcttcagtgaggactgcctgacacaactctcttctttcctttctggggagctggtgcaggggagggtgtggcgtcaccacgcgagtggtcaggactgagagccctgagctgctggggcaaatacttttctctgtgcctcagttttccccctcttaaaagtgggttaataaccacttacggccttccaaatagaacataattagctaattcctgctaatgactgaggcctacctactgtctctctttgattttaatttctccacccactgtttatccatctgccaaaagccaggcagcccaattcctccctctggtctggtggagcagctgaagttcagattcaaacttcaaaacaaactgaaaggctgggcgcggtggctcatgcctgtaatcccagtactttgggaggccgaggagagcagatcacctgaggtcaggagtcgagaccagcctggccaaatggcgaaatcctgtctctgctaaaaatacaaaaattagccaggtgtggtggcgggcgcctgtagtcccagctactcgggaggctgaggcaggagaatcactagaacctgggaggcggaggttgtggtgagctaagatggtgccactgcactccagactgcgtgacagagcgagactctgtctcaaaaaaaaaaaaaaaatcaaacaccctccaacaaaaaaaatgaaagaccttaacagcacaagtctgtagtgtgggccttagtgaggagcgacctggcaggtctttccaggatcccaggagccaatccttggctggcccacatctacccgcccttgtcactctgtcccgacccatggctccaggagggctctgctgctgtcccgcttctctgtaacccctctgtccactttctctgggagagagcagaaggccagccagggtgtccctacccacttgcacccatgggtggtttaccccacaagaccagagagtgctggccaggtcgcagcatgctctgggcctcagcttacacataaagcttctggtagtttccaaaaacattttttaagacaatgaaaaccttgtttcaaatactttttttgcagagcctgaaaataatgaaacaattggcttgaagcaggagcaggacacagagggcctctggatcattctttaagacaagttagggattcaaaaccacggacagacccacagcagcaggaggagggagtctgcccacaggctgcagccccaggagctgcttttccacctctgaggtctcccaagggattgtcccatccctcctcctgggggcccacagccaggtgagggaggcggtggccacagcaaatacactcattatttttggacatctttgtgccatgtaggtgtcttcaagaaatatcacgtccaattcttacagccgctaggcttcattttcagatgaaaaaagggttaagagaggaaaatttatcaaaaacccagatagctgaaagtgtggcagagctgaattttgaacccaaatctatctgactccaaatccagtgttgctctcctgggccctctgctgcttctcctgggggtgaggtgtgtgggtgtggggtgggggtgggggtggcagttattaccaactccccgtatagagccacccttgacataagtaactccatcttagaaaaagacttcatcttccatttcatagggcactttgcccacaaggacaaggtgttttgcttgataaatttaaagactgcaaacaaacagacaagcatcctcctccactgtcagtcctcaccagaggactctgtggccataaaaagagcaggactttggcagttcaccctctgctgtcactggtgataagcacccaacatccactgccaaaggctctgcccacattacagactcttccctgaaagactgatgaaccagccagcctagcccagcccagactttttttgtcttcgtggctctccctggactggttcattagccctttttcctatcccctttctcttggtatgtttttcaggttttgccataaatgttaccttatgggtacctgataattacgcgtctagtatatcttgcatggctctgcatgccgagagagcattcatgtaggagaactgcaggttaggtggtactcctaacagaagtgttctctgaatttcatttatgactggaatttcaagcggaatggcaaattcattatatctatcacgtgccatccctaagatagctgattttcttggattcgtttgtccttgtgttagattttttcaagtccgtctccagattttgttgggtctgaatatgggtggacagatctccaggctgatgtgatccagtcccagagggctagaacatatcttggctgattggtgggtttttttttgtttttttgtttttgaaatggaatatcactcttttcttttcttttcctctctctctttctctctctctctttctttttgtttttgagatggagttttgttcttgttgcccaggctggagtgcaatggcgcaatctcggctcatcccaacctccgtctcccaggttcaagtgattctcccacctcagcctcccgagtagctgggattacaggcatgtgccaccatgcccggctaattttttgtatttttagtagagacggggtttctccatgttggtcaggctggtctcaaactcctgacctcaggtgatctgcccaccttggcctcccaaaatgctggtgggattacaggcgtgagccaccacacctggcctggagtctcactctttcttgcccaggctggagtgcaatggtgcgatctcggctcactgcaacctccaccccctgggttcaagcgattctcctgtctcagcctcccgagtagctgggactacaggcgtgtgccaccacatccagctaattttgtatttttagtagagacggagtttcatcatgttggccaggctggtttcaaactcctgacctcaggtgatccacctgcctcagcctcccaaagtactgaaattacaggcgtgagccaccacatccagccttggctgatttgtggttctaatggtttatggtttggtagttttataatagctcatgacagtttcctgctcgtgtagggatgcaatgcgtttctgtgcctgatagtgccgtggtgtctgctgcattctcccacagatgtaggggccagtctgcatctgtgctctgtctttggcaaaaatctgttctcagtttcagtaactctgctgtggtgtagtctccgtcctcactggtgtcctgaggactgtgattctcatagttatcattggtacctctttttctagttattataggtcttgctgtatatacccaccccaagggtcattgtaatgtcctaagttctctgcagggggttcccttggtcccaggggttcctccttaaaagttacccctgacagggatttacttttccttttttttttttctttttcttttctttttcttttttcagacagagtctcgctgtgttgcccaggctggagtgccgtggcgcaatctcggctcactgcaagctccacttcccgggttcacaccgttctcctgcctcagcctcccgagtagctgggactacaggtgcccaccaccacacccagctaattttttgtatttttagtagagatggggtttcaccctgttagccaggatagtctcgatctcctgacctcatgatccgcctgcctcggcctcccaaagtgctgggattacaggcttgagccaccgcacccgacctacttttccttaaaattccttgagctggctctttgcctgtctggcgatctgtgagatactttgcattaaaagtacagggattttttcttttagggcttaacttttttttttttttttttttttttttttgagacggagtctcactctgtcacccaggctggagtgcagtggcatgatctcggttcactgcaacctctgcctcctgggttctagtgattctcctgcttcagcctcctgagtagctgggactacaggcccatactaccgcacctggctaattttttgtatttttagtagggatgggatttcaccgtgttagccaagatgatctcgatctcctgacctcgtgatccacctgccttggcctcccagagtgctgggattacaggcatgagccaccgtgcctggcggggcttaacatttttagggtcctcaagtctgactgtacatcctcagggggtcatacagggagtctttctgacttccaactctatttgggcaatggttcgatttcccaccttagccaaccggatgagtaggggttatgcaataattggcttcctcttctttcagccgagttaaaaatttgtttttaggccgggcgcggtggctcacgcctgtaatcccagcactttgggaggctgaggtgggcagatcacgagttcaagagatcaagaccatcctggcaaacatggtgaaaccctgtctgtactaaaaatacaaaaattagccaggtgcggtggcaggtgcctgtaatcccagctactcgggaggctgaggcaggagaaccgcttgaacctgggaggtggaggttgtggtgagccgatatggcgccattgcactccagcctgggcgacaagagcgaaactccgtctcaaaaacaaaaaatttttttgttttgccaactgccatctcctaagttgagaccatgcttgctatgagcctttctggccccactagcttcctagcctggcatcagccgagaccttgtcagctcttggagctacaggacctgggtaaagaacctcatcacctgaggttttcctcagggagctagactttcaaggtgaagtgagatgacgtctctttttgaagagggtggcagtttgttttttcaaacggcttgatttctaatttaagttttagtggaggctttcgccttagcatcgactataccacctatgcccagtaagctgactgtgccaattctcatgagcggtgcgaggtcctaaccgggtccatgcacctttgtgtctttccacaaggtcagacttattgatgtgacttcaatcacacaaggcgcgagccgcatggagttcccaaagagacagctctccttagtacttcctgttcactccgtagtcagagcctcaggcacacaggctcaaaccactccagtcaatattgcaaactatacataataatattcttaaccaatatataaaagtataaacattccacatcaaagtaacatttaacatcaagagaaaggggataggaaaaagggtttaacaaaccagtccaggaagagccacgaagataaaaagagtctcctggtgtgagctgggtcatttgtcggtcttgccgggaagagtttctgatgttggcagagccttcgttggcagatgctgggtgcttatcacgaatgacagcaaaatggtgtcagtgaagagggcatcttgaggtgccgaagtcctgctctttttaagatgaagtctttttctaagatggcgttacttatgtcaagggtgctctgtacaaggctcctggtcccttgggctgcgtggggagggccctgggcagtgctgggagttgggacgggacttgaaacctgcaggagctggctgctccctggcagagaaccgctgggtttctgtgttgacaacgtcctcacagctgggctgagtcaggtcctgggggactttccttcaggctgtaaccaggtgtggggacttgtggtttacttccttcagtgggagttcttggccgtgggtcagctttgtgttcccctgatgggctggggttacagatctacagatatttctggatcttccttggggccctgcagccccacctgttttccagcagctccttctggcggggcggctgagggcggcgacgggtcaaagggaaaggtgggcgggccggggttttggggtgtctgccagcagctggctgggtctgcagctggccctgtgctctcccaggaggagctggagtgtgtatttctgggaaaagtgatagcctcagggacttctgggatgatgcttataaccaattgtgggagggtccccagggcgtggaagcaaagttcgacctggcacagcagcttcccttcatcccaggtggttgctcaaaatagaccagctgagactctaagccagcttctcctcctggtgacaggaaggggtgagcctcctggaaatggtgggtggagtttctccaactttcaggttcccaagaatgacctggagcacttgaataaaaacttccacatccgaggccctgctcctgatgcatgacatcagcacctccagggagaggggcttgggaatctggatgtggaacaaacactgcatttgtttcagttgattgttattgttctttttcatgaccagacaagtccaggaaatgctgggggttgcgatcaatgggaaccataggcttttgcaggtttcgtgaaaattggcttctagagagatcgattacccctggttggggagtgggtgggaggattccagtgtggcctttcttttcctttctcatttgcccatcggtcatccccagataagcactcaagtgtcctcttttatgaggccccgtgctgggccctggactgccatggtggcaggtggggtgaagtcccgccctcaggagcctgctgaccgcctgctctgtgcacagctgctggagcttccccggggctgctgatttaactggggagggcctgtctatgtggggtccctcctagccggagacaggtcccttttatgaacagcagcctgatgaagaggccttcctgcaacatgcctctggtatcattctcagctcagcattgcccaggggacaaacacagagtttgttcttggcagtcattccctgctgtcatctcaggtgggcttgagccgtgctgggtttccgggaaatctggccaggatccagcacaacctttagccagtccggcagggagcggccacgaggttgtgctggctcggtctttcccttgcaaaggaaggcatcttcgacctgccacagaatgctttcttccccggggaaacccttgcaggtgctcgggctctactttcctttctcgcttgaacaattacagggatagtttatggttctcatgaccctggtgggggtgatgacatcatgggattgaaatccgtcccaccttggagtcaccgagcgtgtcagtcaagagccttggccacaaatcagtggcacttggcagcagcacacaaatccagccaccctgtccttgtctcaggtctgggcagcacagctgtgtccctagctggtggcatcgcccctgccccttgaccttgatcttcagcctcagaagcaggctacccattgtcatgtgactgcccttcacggtccctccccaggattccaaggggcctcttgaggtttccaggttcagccgcttccttcccagcagatcacacccaaccttagccacatgaggaacgatctttagaaagggtctggcccgaagcttcatttttccctgtctgctttggttggaatcttgtgtggctttgtgtgcagttggtagtatttttgttgttggtaagtgtaggggcccttccccattgcttttctctaaggataaccatgctctgagcagcccatggcaaattctggctttggacttgttggtccccagagccagtggggtcgtgggccctggagagtttgcactcagtggcaggtcttagtgtgtgtttgaggaaccaggagagcgttcctctcagagggaggattctctggttgactcacacagagttttgttggctcagcatttagctttcagccctggtgagtttctctgacttaatgggagtaggctggctgcaagaatctttcctatattatcaaataaaataggtctcttttttggccctctagaaatcagtgttttttttcttttcgttttggagagcccggccttggggaggatatgcatcagttgctctagtgtgcctcagacaatgagataagatgaaatagggcgtgctctaggacctctccacttccccttcccgggtttctggatctgacccttcgctccctgcagaaagttgggtgagatggcaatggtccgatctcatccctgctgggtgggatggcagtggtccctcttgggtgagatggtggtggtctgatcttgtccctgctggatgggatggcggtggtctgattttgtccctgctgggtgggatggcggtggtccctgctgggtgggatggtggtgatctgatctcgtccctgctgggtgggatggtggtctgatctcgcccctgctgggtgagatagtggtggtccctgttagatcctggccctttagggtctgtaccctgcttgtcctgagccctttatccccaacctcccgcctggaagtcattcctcgttcccttgtctgagtggcctggagccgagctgtgtttctgggtcctttggccaggatctaactacagtgggccagcaggaagaggctgtgatatttacatggcctctatctgtgtttatggtaagcagacacacctggcttcatagcaccgttttatgtgtgcacctgcaaagatgtttacttttaagaaagagagacaggagaagtgaaagcaggcgcaggcataggatctctcctgtcggctgtggcccagtagagaggtgttatgcctacagttgtctaagtgtctaagtggatgggagttccctgagacctccccctcccacctcccccacccaggagttaaaagagctttgctgcttcactgactttattaactttgtgaccttggacaggccactccctctctttcatcctcagtgttcttatcaataaaacgatgggattatgcaacagtatctctgttacacctgaaaatggagccaagagctaaggttataaaaggaagcagcccagttactgattagacagcacttttaggctgggtggagccacagaactcacactgcagggaggacagaggacccaccattgagctagcgccactgctgacagcctcgctccgtggcagagtctggggtgacccctgagtcaatgccctcagccaccttaccccttctcatgggagtctctgtcttctgtttccctgaatccttgctcccagaattctggaacctaaccacactgggaggcagtaaaccaggaccagattctggatctgccaccaagtactgggtgaccttgcaaaatcagcattcttccctgccttctttatataacacgggtgatagcaccagccagtcttgaatgagtcacaggactgtcatgaagatccagtaagaaaatggttgtgaaattaccctgtgaattggatatacatctaaacatgataaattattatttcattacatttctttttttctttgtttctttctttcctttttttttttgagatgaggttttgctgtctctgtctcgcccaggcaggagggcagtggcatgactatggctcactgcagcctcagcctccctgggttcagatcatcctcctgcctcaacctcccgagtagccaggactacaggtgcatgctgccatgtctggctagttttttgtatttctgtctttcttatcattcactgagccctttgaattgggtttagccgtgttggccatgctggtctcgaactcctgggctcaagtgatctgtccaccttggcctttcacagtgcaagtgtgagccaccatgcctggcccttttgttaaatatctttttttttttttttgagaccgagtctcactctgttgcccaggctggagtgcagtggtgtgatctcggctcactgcaatctccgcctcccaggttcaagcaactcttgtacttcagcctcccgaatagctgggataacaggtgtccgccaccacacctggctaattttttatgttttttgtagagatggagtttccccatgttggccaggctggtctcgaactcctgacctaggtgatccacccaccttggcctccaaaaatgctgggattacaggcatgagccaccgcgcccagccacttttgttactttttttttttttgaaatggagtttcgctcttgttgcccaggctggagtgtaatggcacgattttggctcaccgcaacctctgcctcctgggttcaagcgactctcctgcctcagccccccgagtagctgggattacaggcgtccacgaccacgcctggctaattttttttgtatttttagtagagatggggtttcaccacattggccaggctggtcttgacctcctgacctcaggtgatctgcctgcctcggcctcccaaagtgctgggattacaggcgtgagccaccacacccggcctacatttcttatacatatatacacatacatggtctgttcagagtgtagccgaaatctgtgttttctcattcttaaatatgattagactaccagaggccaccagatgtctaaagaaaacccagcctgaaaggcgaagttccaaagataacataaaaatgtctagttgcagctgggtgcagtggtgcaccctgtagtcccagctactcaggaggctgatgcaggaggattgcttgagccaagaattcaagaccagcctgggcaacatagcaagaccctgtatcttaaaaaaaaaaaaaaaaaaagattgcattgcatctatagctaattttgagaatagacaccttaatattgaatcatctaatccatgaacagcgtatattgctcaactaatttaggtcttttagaatttctcccagcagtattttacatctttcagtgtacaggttttgtgcattttttgtcagatttacctctaagtatttcatatttttgaagctattgtaaatggtgtcttttagttttagtttccagtttttcattgctgatatgccagtacaaagacagctacgggagtgtttctagcagctctgtttgtaatggcctgaaattggagacaccccaaatgtccatcaataggtgaacaggtaaacacatgttgtgtgtccaaacgatgggataaatgcagcaacaaccaaaaggtatgcactgctgggcacacaggaacctgcgtgagtctcagaggaatcgtgcggagtgaaagaagccagatggaagagtgcatactgcagaattccatttacataaagctctgggaaaagcagcctgaagcagatgagtggtttcttggggacaggaaatggattcagggaggaacatgtgggaggggccaggaggagattttgaaggagacggacacgggcatcatcttagctgtggatggtttcatgggtgcatatggatgcccaaaattgtacacttaaatatatacactttattttatgcaataatacctcaatgaagctgctttttaaatttaatggaaggtttgcaagagcaagtcaaagaaattcccaaagtagaaccaaacgctgaagaaacgcaaaatacgggagagaaaagatgacagctagaggcgtagaggatccattcttatccgtgatcttctgaaatgtcatcacaatacaatctgtttggctatatgtgctgtttcatttgtctttctcaccattcactgagccctttgaattggaagatttacaactctcttcagctcttggaaacatcctttcagtatttctttggtaatggtctcttctctgccaggctcagaaaagattgggctcaagtattctagaagacagaggtgagacaagaaaggacattgttagaaatacccaaatctccaccttggccccaagcaaaaagacaaaggccccagcagactcccacagtggatgggaaaaatagtctggagagattgaatcaaagaatatgtgggcttgagaaccccaggtacagaggaaggctgtagagagaggtgaaaagaaggggaatgagtctcttctcctacgtgttcctgaatgctagtggctgggtttaaatcactccagccaggagattagaaaattattctctggagcaatggaaccatccacaggaagatgtatatagtctaaccattgggagtgcccagaaaaaaaatctgtttagccactcacttgtgtccccgccagtgaagccagttgtggcaaggcatgcacacagagcttccaaacagccgccaggagcttgtttctaaataaaaataaccaccaaggatcccccagcatttgaggaaagtcttcaacatggaagaaaaagtcaaaaacagagaaaagatactcaatggaaatataaagatgagaaggttttgcattcatggaacaaatacaagatgccatgaaagaggaaaattcaaagaaacagaaagctcttagaaattaaaattttgataccaaaaatgaaaaactcaattgaaaggttaaaaataatgagatggataatacagagaaaggataaatagaggataaatataataaggattaaggaatggtagaccagaggaaatgaaagggagacataatctaaaaaataagacaggaaaatcactttgggaggctgagatggaaggatagcttgaagccaggagttcgagataagcctgggcaacatagtaagaccttgcctctacaaaaaattagaaaaaaattaactggacacggtggtgtacagctatagtcctacctactcaggaggctgatgtgggaggattgcctgagctcaggagttcaagattacagtgagctatgatcagaccactgcactccagcctgggcaacacagcaagaccctgtctcaagaaaacaaaaagacccaattcaaagcacattctcaaggctttcaaagaaagacaatgaagtcataagtaaaagataatgagtttataacattatcatatttctcaaaagcaaattagaagctaaaaaacagtggaaccctcaaaattctttcttttttttttgtttttgagacagagttttaccctgtcacccaggccggagttcagtggcgcaatctcagctcactgcaacctctgcctcctgaattcaagcgattctcctgcctcggcctcccaagtagctgggattacatgcacgtgccaccgcgcctggctaatttttgtattgttagtagagacagggtatcaccatgttggctgggctggtctcgaactcccgacctcagatgatccacctgcctcggcctcccaaagtgctgggattataggcgtgagccactgcacccagcttgagccctcaaaattctaagtgaaaattatttgaaacctatagttctatacccagccaaagttccataaatgtgtgagtgtagaattaaggtattttcagaaacatgcaaagtatcaaaaaatattcttctcagaaagtatatgttcatctcttctgggtctttgtggttagaaaaaaatttttaaaaagtatgtgttccaccacaatgaagtgtaaaccaagaaagatgaagaaaatgatccaggaaataggagttttaacgcagaaggagattaaggaaaatcccagggcaatggtgaaggaagttccagacaactgctatgagaaaggacaggcggctccaggactgtggccctcaggaagaacatgaaataagttatttaacagatgttacatgtagaagattgagaagagtattgcagagctctcagattgtatgtaaagatttgggtacaagttaaaaagaaaccccagtcaatgaaaattcacagcaggaaaaacaaagacatatacaaagaaaggaaatataatagtgaacaatattttcacaggctaataatgaaaacctagagtatggatataattttttttaaactctgggcctgtaactattgggaggatggggagagaaagggtggaaggacactaaaatccacattgtcataatagaaagtcagccgatgtctagatagatgaatcaagagattatggcgttggcatattatttagaaatatagagacagactccagaacaagcattttgaacacattttaagtggccgtctggggtgtgtttctgtgtgtgatattagatcaagtcacaaatatggccaattaggaaactaaaattggagttacaagtatcctatcccagtaaggcaggagtgaggagaatctttcatgcagtgagttgataatgggtaaatgtgacaaaccaagacatatcagcttaaatttacactgtcgaattacgagatcaccaccagaagaatgacatcaggaaactgtcaaaagggccaacacctgtgggtgtgggatgggctgttgcttttgttgtgagccgtattgagtgggcgtgaggtagttaaactgagagtgccacagtgccaggccatggtgcatccccaggattcagggcgggcagacggcatgtgctatcggcagaagccttcgccggtccgtcactgggtgcagcagacaccccacctgcccctccgtattctggcccctcatcatggatacccttggcagggaggaacccggggaagttgccatcctgtcttttgggcgtttggtttgcttgcttttccctctgttggggctgcgcgtgggtgtggattcccacagtgggcctctcactgtgccttgaggtcctggactggggctcccaaggttaaacacagagcagttttttccatgacagcaccacctttttacttttggctggttcaccattggcagggcaaggccgctgggtagggtgtgcagttgagtgctggccacaggctcctgggccaggtgatggggggattgaatctggtaggggctgtgtccgagggagcagggcctgctcctagaagtctgcacaggggtaccagttgccagtcatgggcctgggctggggccactctccggggcacccacctacgtcaaaggtgattcactgaaggggagacctggatgaccgggttcgacagcccttcattgcgttttaatttaaatgaacaattcgtaagcaatgatcgcctggtgctgtccagaccctgagatgcgtggttgggaaggccgacctcatgttcctcccagagcatgcccagggttcatgtcccggggtctgcgctctgggcagtggtccccatgcctctgggggaagcccccttcttctcacccaagcccctgctttcttctccaagctggacctcacaaaatgtgaacatcttccccagcggggtgcaggggaagagcgggtgagagggtctgagtggtggcgcctctctccctgcagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtgtgagtaaagctggggctggctccggggaggacgacaaggggtggctgtccctcttccctcagcggacagacccagggccacctactgagtacacgaggatctcttggcctctctggaaccctgatggggagtgatgggaagcagtcagggctgacccatggccccctcctggcattcattccccattgtggacggcgagggacaggcgggggtggtaccacctcccctgactgagcgccttctggtctcacacagaccgggacgtgcgtgtccagaaggtcttcaatggctacatgaggatcacaaatgagaattttgtggatgcctacgagaactccaactccactgagtttgtaagcctggccagcaaggtgaaggacgcggtgagtgcagcctgcccagagtcctgctgggctgtgtgcgctggtgtcccacctgctgggcaggagggacatgcctcgcctgtgctcccagggccctgggatgggggtgatctgcaaaggggacccgggccctggaggggagggagcagcccgggcttggggcagggtcatcgccgcatggggctcaccttgagtctctgcccttcctcagctgaagctgctgtacagcggagtcccattcctgggcccctaccacaaggagtcggctgtgacggccttcaggtgggtgtggagagaaggctcagtgggatgcaccccagactggctgggagtaggatcggggtacagtgtgtggggcaggaagcgggagatggtgctggaggtcctggcctggagagccaaggagggtcctcgctgtgtcctcctgtgcgttacttggcagcctgactcttctgcccccatggcaaaggtgcctgtagctgttgctgtgatgagctgcccaaaggcctgtgacgtgcttggcatgatgccaggaacggctgtgattctttgttgtttttccaaatttgggtatgggggagttggggtactcaggcagccttcaatgagcccccacattttctgtgcttgagcagtttttcacgcatacttttgtaaaaaaatagactttattctcaaagtgctttttattttgctagttcgtttgaaccctggggaatgctgtgtggcaggtggcattcccagttcctttctcaggtcagaaaacaggctcaggaaggtgacactcggtgtgtcctcgcttgtggccaaactccaatgggtttcccctcctcattcctacccctgagcagcccccagaatcggtctggttggggatgagactgtgagagcagagggcaaagggcaaggcctcttgctttggggtggaaagagggatgacacaagaggagctggggaagggcctctgcagatggcaggcccaggtgtgccccgagccgcccatgtgtcctggagtcgctctgggcgcacgtgggggaaatggggcccagagctccgcctcaggctcccgctctctccccagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccgtgagtccgagggccaggggtgggcgtgggactggccagccttccatggagtggggctgggccctggaccattgcaggggaccggcactcccagggcccagtgccccagagagaagactacgtgctggccgggcacctccctttagataataaggaagcaggaataaggaaatggattgtatcaggaaatgctttattctccttcttattcttcagccacggactccaaaacagtacagaggacccaggacagtaagtatcgtgcccgcctcctcttctgggtggggaagaggcgggatgtggccagatgcccttgagccagtggggtccccagaagcatgtccctctgaatgaagtatattatgacgatctttccaggcccttcctcttccaggcccttctgagaagcccccttcctgatttcccgaggcccagggcagcctggggcgtctcgaaggggcgaggcctgaggtccacacccacggggtctcagggtcctcccccagctctgcccagccctgcccccacacgtgccctccttcttgtctcctgcgcagacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagtgagtaccccggggggcgggtagggctgtgggagcttggcggctgccctgtagggggccagcttcttcaacgattgggatacagtttatgactcttggccgcaggccactgctaaacatccaggcagcaggaggcacgtgtggtgtgatcctcagctgcagctccaggggagtctgggaggtgatttttctcagccttggcaaagcagaggaaggctctatagtccccagataccaaatccagcctgtgcggcctgtgccctgaaccgccggagagaaggcactgcccacggttgtaaaatgtaggctttattattcagggatatgaaggccaacagatcaggagatgactgctcttgaaaagacaattttgttggcgggcacggtagctcatgcctgtaatctcagcgctttgggaggctgaggcgggaggatctcttgaggccaggagtttgagactagcctgggcaacaagactctgcctctataaaaaataaaaagcttagctgggtgtggtggcgcatgcctactcaggaggctgatgcaggaggatctccagcccaggaggtcgaggctgcagtgagcggtgattgcaccactgcactccagcctgggcaacagagaaagaacctgcctcaggccacatgaggaaacaccaggttggtcaaggggtaacaggaatgaggggaaaatgtaagcaagagccttttatgggccgggcatggtggctcacgcctgtaagcccagcactttgggaggccaaggcggctggatcacttgcggtcaggagtttgagaccagtcaagccaacctggtgaaaccctgtctctactaaaaatacaaaaatcagctgggtgtggtggcgggcgcctgtaatcccagctactcgggaggccaaggcgggagaatcacttgaacctgggaggcagaggttgcagtgagccgagatcgtaccactacactccagcctgggcaacagagcgagactctgtctcaaaaaaaaaaaaaaaaaaaaagagcctttatatggtttacacagaaaaggcaagacaaatcagggtgagaggtttagaactggcttgtttgaataatttcagtaggctccggggcataggagctgtccctagttctctgatacttgggcctggggtggttagggcaaagaatagtggccctgagtgtgagatcctttcggaggaggtggggctgggcccccataggtgggtttgcatagggaaggtttgcttgcaggtgagtcctttcctatctctaagcattggccagccttccacagtcagcagggcctcagatgtcaaagcacctgcattacagaaaacggaaaggcgtggttaatgcacctgtgggataccccacgtcagggtggggcgtacctcgcagaggtgctgtgcgtggtgggtgagccgcctctcctgcactcgctgggccagagccttccgtggctgtctagggaaatgagctcggcggacgtttcctgattaataatgggctaaaattcaggccaagaacaacctagaaccatctgccgccacagcttcgtaaccaggacttcttttccatctctctaatttattaattgtacaacaaagaagtacatgttcccagtgggagaaggaaatcggcaagcaaaaggaagactaaagtcactcgtcatcttactgtctagaaataaccactgttaattctttttctttgagatggaatctcgctctgtcgcccaggctggagtgcagtggcaagatctcggctcaccgcaacctccgcctcctgggttcatgcgattctcctgcttcatcctctcgagcagctgggattacaggcatgcgccacaacactcagctaattttttttgtatttttagtagagatggggttttaccatgttggtcaggctggtctcgaactcctgacctcaggcaatctgcctgccttggcctcccaaagtactgggattacaggcgtgagccacagcacccggccaaatttttgatgtctattttcccagccttttttgctgtgtgtgtgttaagaaataggattatcccgtgcattcagtctcattacctgctttaacaaatgaagtatattatgatggtctttccaaatcagtcaccctctctctcagggtttttataaggttgcattgtttagaaggaggggacacaatcaggatgacatggttgtgagcagtgtggactctggagcttgaatgcctgagtttaaattctaagcctgccacttattaaccatgagatgttgggcaagttactgaacatctctgtgtctcagtttcctcacctctgagataggggtaatagtatctacttcatagagctgttaggaagattatgagttaatagatttaaaagcaccgagaaccatgccaggcatgtttttttttttgagtctccttgtcacccaggctggagtgcagtggcgcaatcatagctcactgtaaccttgaactcctgaggctcaagcagttctctggccttgccccggagtagctgggactgcaggcaagcgccaccatgcccagctagtttttttgattatggagatgaggcgttacccaggctggtctgaaactcctggcctcaagcaattctcctgccttgacctcccaacaggctgggattataggcccgaccttggcatgttcttaataaatgttgattgttactactgctgttgttctgattgagcccacagtttatttaataaatcctctgttgtgggcatgtattgtgtctagggtgttgctctttttttttttttctgacagtctcgctgtgtcgcccaggctggagtgcggtggtgcgatctcggctcactgcaacctccgcctcccgggttccggtgattctcctgcctcagcctctggagtagctgggattacaggcgtgcaccgtgatgcccagctaatttttgtatctttagtagagatgggatttcaccatgttggccaggccggtctcgaactcctgacctcaggtgattcacccgccttggcctcccaaagtgctgggtttataggcgtgagccactgcgcccggctgggtgttgctctttgattgtgacaaaggtgaactgtttatcactagcgccttccatcagtgattgtgacaaaggtgaactgtttatcactagcgccttccatcagtgattgtgacaaaggtgaactgtttatcactagcgccttccatcagtgattgtgacaaaggtgaactgtttatcactagcgccttccatcagtgattgtgtgggggagggacttacttgaatgaaggtctttttgactccattcttggcctctgtggatgggaccagagttaggggtggggtcctcaggcacctctgcctgagagcctggtttgggtgtgtgagaagcttgggttctgtctgctcttcctaatgcccgccctctgcccccacaggttgtgtggcacctaccctccctcctacaacctgaccttccactcctcccagaacgtcctgctcatcacactgataaccaacactgagcggcggcatcccggctttgaggccaccttcttccagctgcctaggatgagcagtaaggaagggcagggcagggcgggactgccctcgggccacagagaaggggaaggccttagtgggggtgacctgagcttaggaggccacaggctagaccctgtggttggcgagctggcctaggtcagcagcagaggctgaagcttgagccaaaggcatctggccgaccgcctgggtcaggagccctcctgaagcttcggcacccggcacctggccttcctggctgtgcacctgctgtgcagcatccacgcgtccaggaggcagctccaggcctcaggctgcagagccctcgtccgcctgctcggccgggcaggttcctgatcctcttgctttctcccaccttccctctcaggctgtggaggccgcttacgtaaagcccaggggacattcaacagcccctactacccaggccactacccacccaacattgactgcacatggaacattgaggtaggagctatggggcgtgtgaacgtgtgtgtgtgtgagcatgtatgtgcacgtgtgtgtgtctccctgtgcagatgtgtgtggatgtgtgtgcatgtgtttgcatatgtgtgcatgtgtgtgtgtgtgtgtgtgtgtgcgtatgtgtgtgtgtgagacagaggtggatggcaaatgaggaagacagaagaaaaggaagaggagatcctttatcaaccccaaagaggcagccagatgtcgtgactcacacctgtaatctcagcactttgggagaccaaggcaggaggatcacttgaggccaggaattcaagaccagcctgtgtaacatagtgagacctcatctctacaaaacactacaaaaattagccaggcaggtgatacatgcctgtagtcccagctactcaggaggccgaggtgggaggatcacttaaacccaggagtttaaggctacagtaaactatgacagtgccatcgcactccagcctgggcaacagtgagaccctgtctcaaaaaacaacaaaaacaaataaacaaaccccaaagagaccatgtgtcttagggcccagggtggggtcaggtcttcctgcagtgtcaggcagacccagactcttatcttagctccttgtcaggtgatggaacgacctgggcagttgctgaagctccctgggcctcagcttgcccctaggtgaagtgagggtgatagtgcctgggtctcagaggcgccgtcaggaagaaatcaaagaaggtgtgtgagacaagagagtcgcctgtccgtgccgctcacgccatcccagccagagctgcctccctttcctttctttaaaaatgccaggagggccgggcgcagtggctcacgcctgtaatcccagaactttgggaggccaaggcaggtggatcacgaggtcaggagttcgagaccagcctgggcaacattgtgaaaccctgtctctactaaaaatacaaaaattagccgggtgtgatggcgggcacctgtaatcccagctgctcgggagactgaggcaggaaagtagcttgaacccgggagtcggaggttgtggtgagctgagatcttgccactgtactccagtctgggtgacagagtgagactttgtctcaaaaaaaaaaaaaaagaaaagaggctgggtgtggtggctcgtgcctgtaatcccagcactttgggaggccgaggcgggcagatcacctgaggtcaggagtttgagaccagcctgaccaacatggtgaaaccccatctctactaaaaatacaaaaaaaattatctgggtgttgtggcttgtgactgtaatcccagctgctcaggaggatgaggcagaagaatggcgtgaacccgggaggcggaggttgcggtgagctgagatcttgccactgcactccagcctgggcgacagagcaagactccatctcaaaaaacaaacaaacaaacaaacaaacaaacaaacacgctgggagaactttgcaacctgtcttggtgatggaaggcataccatctctccctggtccatgccgctgcctccctttgacgtcctcaggttcagggaggagggaggggaactgcacattcccagcagcctctcttccctcaggtgcccaacaaccagcatgtgaaggtgcgcttcaaattcttctacctgctggagcccggcgtgcctgcgggcacctgccccaaggactacgtggagatcaacggggagaagtgagtccccgggggtatgggggctgccgggcccatgctgcagggggaggggtcccaccagacccccagccccccggctcccagctgtccctcctcaccttgtgccccgccccccctccagatactgcggagagaggtcccagttcgtcgtcaccagcaacagcaacaagatcacagttcgcttccactcagatcagtcctacaccgacaccggcttcttagctgaatacctctcctacgactccagtgaccgtgagtgaacattgttgggaggagggctggcgggggcctgcaccgcatgttctgtctaccctgcatctcgttagcatcgtgctttgctgattctaaaatgctggagaatgtaagagcatctcacccctcccgtagctttgggaggaaaacacgctacctttgatgcattaatgaaagcaggctggctgtgagcgctggcacacactgtgtccttctgggttgcagtcccagcatgaggtacctgcggctggagacgcccctcatctgagcttccccggccatctgtccctcaggcccaccttcaccgtgactttgatcatctgtgcttgcctctgtggcctgttagcaccgttaggattcacagtgtaattctgagacacatgaggaagtgccattggctgtatgagcagtggtttttccacatatgcaatgtgtttttatttcaaccctgcgtcatagaataaccttgggaagacatttaactatgcttaggaatccaactttaaggtaaaattcaagggcctggctcaccaccaaaagtacacttggatgaaccaacgcctttgatctaaacacttacctgtgaccgaagtgtccctgtgccgaggcggtgacaatggtctccttacagctttgtcatctgcaaagtggtcagatgcctccggatttcagaaacattgaaatatggaaaatgtttagggtgaaggaagtgcgcgatgccgcactacatttggataggacacatcacatgcatcggggaccagctgagcgtcacaggcggggcctggccctcaggggcaccaggcagcccagcacacagggcagggcagggcagggcctgcgaccagctggcctctctgcagggcacctggggcttcctgggcttcgatcctcagtggtggggagggaccctgccagcccaggttggggtctgtggccagccctcttcccacactagctgcgggtgcaggaacccctttgtcacagcttggtgggcctgggtaacccctgccctgggccacagcacctgccctgctcctgtgtgtttgtggctgggaggttggcccgagggagggagccgggagccagcggagggaggtgggtgggtgctgggggcctcaggcctgcctgtgcccgcagcatgcccggggcagttcacgtgccgcacggggcggtgtatccggaaggagctgcgctgtgatggctgggccgactgcaccgaccacagcgatgagctcaactgcagtgagtcaggctgggagccccggtctccccaccctccttccccaccctgcccgcgtcccatggccctgctggctgactgccgaggcagaaaggccggaggtggtgggagtttttgctctcggccctgtgtagagacctctggccccactccccaccctgccatatggagatcttggcctgtggggcaggtggtggggtatctcggaagtgctgaggtcagcttggtagctggtggagcagggccccttgggcctctctgtagatcagaaagcggtccccaggtagctctgatcgcctgggcatcctggggaagcagtgagtgatgagggcctcacggccgacctccccttaccccactccaggttgcgacgccggccaccagttcacgtgcaagaacaagttctgcaagcccctcttctgggtctgcgacagtgtgaacgactgcggagacaacagcgacgagcaggggtgcagtgagtgctggggaggggctgcctgggcgggcaggtgggcggggcgactgacggtggctcctggtggctgagtcctggtgcctctccaggttgtccggcccagaccttcaggtgttccaatgggaagtgcctctcgaaaagccagcagtgcaatgggaaggacgactgtggggacgggtccgacgaggcctcctgccccaagggtgaggcccgccccacccatcttcctgttgggggcctcgcccctggaggaggctgccctgagcacacgcacatgcaggacgccccgagtttaatgaacacaaaccacctgtgtgttaagtgtgatgagaaagggctctggttgggggagaattttccagaaggtggagaacctgtagcagggcagggaggccagtgggcgtgggtggggcaggcctgggtgagggggtaatgtgcaggggccatgaggcgccattggtggtttctggcttctggtcggatgctgcagaggaattgagcccctcccttgtcctcctccttgaacagtgaacgtcgtcacttgtaccaaacacacctaccgctgcctcaatgggctctgcttgagcaagggcaaccctgagtgtgacgggaaggaggactgtagcgacggctcagatgagaaggactgcggtgagcagggcatccgagtacggttgtgcaggttgttcactgtgtgaagtgcccaccagagggtgcacctggaggtgcaatcccgccagcacctcacttagcagctctgtgcttgggtgagagggtgtgtctcctggaggaaaggatagccttgccagttggcatgaaggcaccaccccacgggctggctctggtcttggagaaaggcccgtacggccagcatctcagcgcctctgtagcatggcggggtcgtggctgcagtgcgttgctggcccctgctgtgtagacacagctgtggagcagtagcctggagaagagcggcccagctcacccaagcccaaggcagggtgtcacccctgcctgcccatactttaatctgcagcctctgtgtttcagaagcgttggctggccacaggttagatttgagcacagctccagcgttctgtgacctcacatcagcggttcattcgtccctctcagagctgtggccttcagcattcaaaggcgcttctccctgctccatgctgccccctcccctgtgatgtcccaaatgatgtcaagtcaggcagatgacacccaaatcaaagtgaagctgaccagccagcctccggaggccctcgctgcatttgtgagggagggggaggtgggaagatgagggtttgaatttgggagcggggagaaggaggggcatggtggaagggagtctgtgaagctcaaagatagttttgggggtccctcacgccctggccacgccagcagtgctgtgcacgccaaaagctggcttccccacacagggtctcctggcacacactgcatgtccccttgtggtttgatgtccccaccttgacttgctgtcctctggttctctgctccctctgcagactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtgggtctctgggtgggcagcagggagcctccttgctggccctttgcatctgggagtaatgccaggataggttggcaccgaggcagggcactggaggggtggccacatgtgttagtccattcttgagttgctctaaagaaatacctgagactgggtcatttataaagaaaagagtttatttggcccatggttctgcaggctgtataggaagcgtggtgccagcctctgcttctggtgagggcctcagggagcttccatccatggcagaaggtgaagggggagaaggcacatcacatggcgagaacaggagcaagagagagcaggaggaggtcctagactcttaagcagccagcctcgtgtgaactcagaactcacccatcaccatgggaagggcaccaaaacattcatgagggaaccgtgaccaaaacacctcctaccacgccccacctccaacactggggatcccatttcaacatgagatttggaggggacaagcatccaaaccaaatgagcagatatcccaggacggggctcaataacagtaataataaaaactcactgtattcggtgcccacttgcagccaagtgctgtctctgtgcctctcctaaaaccccctagcaagttaggcagcttgattgtatcctcactacagaaagtaaggttcagagaagtagggacgtttgcttggggtggcacagctgttaagtggcagagccagacttgagcacaggtgtggtctccggtgagtctgcactgtgcaactcctcggattggccaacgtgagctttggattcatgctccagctctggcttgccggtggccctgggcaggttattcaaacttcctaggccttgggttcttcaccaatgatagtgacagtatcagctcccacccttagagttgtgagaattaaatacaatgctgtacttgagacactttgcgctgtgcctggcacatagtaggtgctcagcatgtcatggcctcagacacacagacagatgagaggcctggaagggtcacatgggcatcccaggaacaggggcacaatgccgggctgcgctatttgtgtcttagctcctggcctctctgggcgtctggctgttggctgaaggaaggagtgttagggcctggcttgccctgaagaggcaggcacaggggcatgggccttccaggagaatccaacctcggaagaaggggatgcgctttctgctggctgcacgcttttccatggtaggcagctccaggagcaggtgacccaagccctcagctgccctttgcagggaggagagatgggcccacagcaggagggaggcctgaggcacagatggagtgtgctcagacccatgcacagggcttgggtgatggagatggacagcaagagcctgtggggagtggacccagttccatggtccccagcttcgctgggtgcttgacacgtggctttgtccagcctgaggctgtcccttgtctcactgtgtcacccaggctgaagttcagtggtgcaaatcatagcttgctacagtcttgaactcctgggcttgagcaatcctcctgcttcagcctcctgagtagctgggactacaggcacatgccaccatgcccagctagtttaaaatttttgtagagacagagccttgctaagttgctaagcttggcctccacctcctaggctgaagtgatcctcccatcttggcctcccaaagtgctggcattacagatgtgagccaccatgcctggcccaaccacttctctttgaggttggcttttgtgcctctttgatatgccccattctttccttttttgagccatgtccttgctttctggcactaccaggtacaataggctcatcttatgtttccccagcccagccctaggaccagccatttctccaaggagtcctttactgggaatggtatttagagaccaaggtccggttgcttagtgtgttcattgtcaccatggtgtcatgtccaggcccagttagcaggtagagctaggaaatggctgggtgcatactaagaactgccctgccatcctgcactgcttcctcttttcctttgcttcgttgctttctttctcatttccttctccttcatcgtgtgttgatcatcagtcatgcttctgccaacgagtagtgcaattaatcttcaacacccctggttactattgacactagagagaccaacatgaataggacttggtccctgcagattgtgggtcacagacttgtaagggtagggacaagacatgacacacatgtgcagtaagtgctgtggcagggctgtgtccaggctcccttgggcccagcatgtggagtttagaattctaaacccatatgcctgagggactcggggggtgactgttgggaacactcaacatgggtgtctgaactgagggttgaaggtgagggtgtctgtcagctggaccaggtggctcagaccttccagacaaagggagtgtcgtgtgcagaggcagggaggtgtgagatgtgcaggggcatggtgtcaagggaccctgagcacatggctaagtcatcatgcattcattgggcactgccgggaggcggcatcacgttgcggttaaatgcacaggctgcctaggttgcagttgtggtctacagcgtgttagctatatgatcttcggcaagttgccctctctgtgcttgagtcctcatcttaaaaagcgcgaccctacctcacaggactgtttcagggataaaacaacttactgtgtcagcatcgagaattgtgcttgggacatcagaagttctacctgagcactagcgattcccaactgcactccagcccctggggtcaccatgggggatatcagtggctgcatcttcacaatcagtctctcagctgctggtagacgtgcatgccttaaacgttagaggctgagtctgctgatagaatcaaatactgtcagacttaccgattggctgggtttgcagacagggcttcatgaaagcggggtcttgagctgaggtcgccaggtgaacagggcgggcttggaggagggaggtggaaacccgcaggcacagggcaaagagctggatgggggtgtccatgctgagtgttggggtcacggggaattgagctagagggacaaggatggctctcccctctcccccgtcccatgagaccctttcagctacatgctcgcctcctgggtgttcctgaaacatctctactctcttctatctgcactgccaccaccttgctcgtcctagctcactgtagcctgggcagctgcagcaccctccccatctacttccttccctctcaggactctggtctgcaccactcgagcccagaggggccttccccaaatctgatcaccccaatctcttgcttcagcgcctgccacggcttgcagtataaagcaggaactccttcacgaccgacacggccacgttatctggcccctgcccgtccgtgcagtctcagtctccagtgcagtcctcatgccttccccatgctcagtgtgagggtttcctaaatgtgcctttgctcttttttctttttttttgagaccgagtttcacttttgttgcccaggctggagtgcaatggcgcgatctcagctcactgcaacctccgcctcccgggttcaagcaattctcctgcctcaccctcccgagtagctggaattacaggcatgcgccaccgtgcccggctaattttttgtacttttagtagaaacggggtttcaccatgttagccaggctggtcttgaactcctgaccacgggtgatctgcctgccttggcctcccaaagtgctgggattataaggtgtgagccaccacgcccggccacctttgttctctttaaacatgcggcattctccaccccttcaggccataggtggccaggcctacgtgatgtcgaggcttggttcataactcacttcgtttccggactcccagcccatcctctcccacagctttctacccagtcctctgtgggacccttcttgtcacgctgtaattggtggttttcatatctctccacatgtacactgtgaacctgaaggctgggtcatagatcgcatcacagatgcccagagattgttgagtgaatgagttgatgggggttgagtacgtggctggatgtgagcaggctgggaaactgttagaaaggtcaggtcgattaacagtgaacgcagaaggcctgggtgggtcacaagacctcacctggcaactcttgggaattcttttaggctgtggaatgggacgcaaaggatctcacaaaaacagcttttgggaagtcattttctggtggcaacagattacagtgaagcgagattgggcatagcctaggttggaaaactgagctttggccttggcgtgcgattccgtggggaggtggctgtaagaaaggccagaagggggcctggcgcggtggctcatgcctataatcccagcactttgggaagccgaagcaggcagatcacctgaggtcaggagttcgagaccagcctgaccaacatggtgaaaccccatttctactaaaaatacaaaaattagctgagcatggtggcatgcacctgcactcccagctacttgggggcggctgaggtgggaggatcgcttgagtctgggaggcggaggttgtggtgagccaagatcatgccactacactccagcctaggcaacagagtaagactccatctcaagaaaaaagaaaggccagaaggtgatggacgctggggcagtgagagtggaccagggctcgggtgggcacgcgagtgatgtggaggcagaggctgggtttagtgctccggggtcggggaggtgccctggctgggtggttcagtaaccttttgaccttcctgagaggtgagggaaaatgaagcgggtcttcatgcctttctcttgtcacgcacattttctattttaaatatgtatttttccaatgttttattttgaaatttttcaaacctacaaaaatgttgtaaatacaatgaatgaaaaaaaggactagtacagtgaacacttttttttttgagacagagtctcactctgtccccaggctggagtgcagcagcgtgatctcagctcactgcaacctctgcctcccggcttcaagcaattctcctgcctcagcctccggagtagctgggactacaggtgtgcgccaccttgcccggctaaatttttgtatttttagtggagatggggtttcaccatggtggcctgcctggtctcgaactcgtgacctcgtgatccccccatgccttggcctcccaaagtgctgggattacaggtgtgagccaccgcacctggctgtacagtgaacactcttatacctttgatctacattcagtgattgagttaatcacgtttgctttctctctgtttgcacccgcatgtatttttcagaaccatttcccaactgggggcagccattgtgaggcttcccaccaggtgcctcggcctgtgtctccaaaaacacggatgctgtcccacactgagaaatggcggcattgctttgtgctgcgagctgacgtacgcgtcataaatgtcctccaatcatgcccatcatgttcttctttagacgtttttttttttgtttttttttttgagacgcactctttcgcccagtctggagtgcagtggcacaatctaagctcactgcaacctccacctcccaggttcaggtgattctcttgcctcagtctcctgagtagctggaattacaggcacctgccaccacgcctggctaatttttgtatttttagtagagacggggtttcaccacgttggccaggctggtctcaaactcccaaccttgtgatcctctcgcctggggctcccaaagtgctaggattacaggcgtgagccaccatgcccagccttcttcggagctttttaaaaaaagtcctaggatgcagtcaagggtcacgccttgtatttagtcattaggtttctttaacctcattttaatcaagaacagtttctctacgccttttattttttggttttttatggcattgacatttttgaaaagttcgggccagttatcttacaggatgcctctcaatttgggttttcccgactgtgttttcatggctgagttaggaagcagtgcgcgggcggtgctgtaccctactcggggagagcaggatcccccgtgaagggggctggtcgggagaggaggctgagcacctggctcgggacgcccaacaggtttcgccatcataaaggggcttcccccttggtcgtgactacactgcaggtgattctttgaatcagcgtgagtgtctcgttctccagccgtactttgcccggcgtctcagcgtccgttggtgattctcacattgttgattattattgtggcaggcgcgaatgtggttccttattgtaccgtttcttcagcatttaggggctgctcactctttctttctttctctttctcttttcttttctttttttttttcttttttgaggtggggtctcactgtgttgcccaggctggagttcagtggtgcgatcttggctcactgcaacctctgcctcctgggttcaagcaattctcctgcctcagcctcctgagtagctgggattacaggcaccggccaccacacctggctaatttttgtgtttttggtagaggcggggtttcaccatgctggccaggctggtcttgaactcctaacctcaggcgatccacccacctcggcctcccaaagtgcttggattacaggagtgagccaccatgcccggccaggggctgctttttctctgtaaagaatagctttccttttccctgtataaattcttttgaaattactttttagactcagggtggactgatggattaccccacccttttttattattccacctgtgtagtagtgtcaccctgtcaccacttatttcggggttcttattgtcctaactttagccagctttgtgaggccgcattgctgtttgagtgctcgatcgcttcctgcagaaacaaaatgttccaggttgctttatgcttcccattaagccccagatccgaaatcagctgtttttccaaggagccctggttcctttcaatagagaaggatatttagacactaagttctgggtgctgctggagacagtattggttttaggccagtttttaagaattgtgagccagcgggcacggtggcttatgcctgtaattccagcactttgggaggccaaggtgggctggtcgtttgaggtcaggagtttgagaccagcttggctaacatggcgaaaccccgtttccactaaaaatacaaaaattagccaggcgtggctgcacatgcctgtagtcccagctactcgggaggctgaggcaggagaatcgcttgaacctggtaggtgcaggttacagtgaactgagatcacacctctgtactccagcctgggtgacagagtgagacttcgtctcaaaaaataataataaaataaaataaaaaccatgaacctttcctgatatctctgatctcattccacatctgtgcctccctttccccccagtggggtgggctccggctctgcagtgcacgtggaaaagcttctgaattgctaaacctattccatagccagcaacaaacttagacacaacacaacatatttttcaattcattttggtcttaggttatatagcactacattaaaaatttatttgggctgggcgtggtggctcacgcctgtaatcccagcgctttgggaggccgaggcgggcggatcacaaggtcaggagatcgagaccagcctgaccaccatgatgaaatcccgtctctattaaaaatacaaaaattagctgggtgtggtggtgtgcacttgtaatcccagctactcaagaggctgaggcaggataatcgcttgaactcgggaggtggagattgcagtgagccgagatcatgccaccaccgcactccagtctgggtgacagagcgagactcagtctcaataaataaataaataaataaattatttggattgattgttctgttattcctcctgtgaaagatcaggttcgtaagataactaatttttggtcatcagattaaaaatgtattcaaggaagggggggtaaagagttcaagagggatttcatactgcagctggaggcacttagtagtttctagcttagggtcaagaccaagtaagagccggccccatcgtcttctcgtagcagcagctgtgcctcatccatgcggaatcctctgggaacgcgcggggccgcgaggccgtgtgcacagacccgagtgaccgcgcagtctcatagcggctctccctaccaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggtaagcttcgggctgacctagggctccgcagagggcctggggcctttctccaaggccgtgtttcctctgcgtgtccggtctcggggcggggggctgctccagtctccctctgcctggcagaatgaggctgtccagggcggaatggaggcctttagtaaaaggggcatgggatttgcagcctgggctcaggattgaaggttggctttgcccctaactagctgagtgaccttgagcgagttgcttaagctctgatcctgtttgtgcatgcgcgtaatgaagatagcaacaccttaagcccagtggtgcttaaggcacgtgagggggtgggtatgaagggaagcaggccgttagttggcaaatgctagattgaaagaatccactgtacagcatatgctgaacatttgtcgtctttggagaggaaagaaaacgaacaggacttacagctccaatgccctcacagaaccccgcgggcatttgcggcgccttccctccgcctctctgcttcttgttccctcacccctgcttgccacggcgtctgttccctctcaactcgcctggcagatctcagcatgcccctgcttcctctaggtggctgctattgccagagcccactgagtagacgcggattacccgtttgtcagccccgggcatctgggctgttccagagttttctagtccaatgacccgtggggagcgtctcgaatgacgctgccctcgaagcagcccggctctcagccccgtcctgccctctccccaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccaggtggcccccggggcaggagggcggcaggtgggccccgggagaggcgggactggggactcacggcagggcttgtctccgcccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgcatatctgcctcccctgtctctaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttta

SEQ ID NO: 1013 - DNA, 90095 bp, Homo sapiens
tctatgtttatatcatttagcagggaaggattgttaatgactaatctgtgtccatgaggcacagagccaaggaagagatgctgctgctagcccagaaggccgcctgtgatcatgcacagtacactggaactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaagtaagtacctaattcctttgggagtgggttgtgtatctcacagcaacagagaaaaaatagtcacttaaaagtttctctttgacatctgtaatgtatgtcaataaatgaattctaagttagtagagtttgatgtaaagtcctgaaaattaaaaaagagagaaactaaaaaacaaaaagaagcagaagcaaaagttaatgagtcttaacagttgcttacctattgaaaacttatttagaaatactcttttaacattgtggtcacctgagtaaatcactggagatagtgcatttcagaaatgtctccgttctgattccataaacaatttgacttgtatagtgtgctatattttggtgatttatcaaatcttgatgtgagtttgggagtattgctaatgtcagatgacttgggaactaagaataagacatttaacctatgcttaattgaaatgaaatttttccctagaagaagagtaggtggaaaaagtcttctttcttgacttcagttgtaaactcttctattgctttccattttgaatattaatatgacaggaaatatcagatggaaatatttttaaaagatagaaatgtgagtatgacgaagaactttagtaataaaattgtccaaggactaaatttatagataagatacctctttgtctccttattgacagagtgaatggggcaactgtggagcctgacttacttcttttaattgggtttttattcagaagggaggggcaggagggaatgacaagtgactcaccttgaattcttcctctaagaaactcacacctgagctttgagctataaagaaatctgatgctgtttctggtgctgtcttagaatcacttcaggagtattgacaagaggggtaggaacccttagaaataatattagtgataaataagaaggcaggaagaaacttttggaggtgatggataggtttatggtatagattgtggtgatgatttaatgagtgtatgcctatccccagactcatcaaagtgtatacatggaatatgtaaagcttttatatgtcagtcacacctcagtaaagtggtttacctatctatctatctatctatctatctatctatctaaatttttttttctgttcctaaaaaaaggaagggagaagagaggaaaagatgttcagggagctaccattttgtttctagctgtgattttataaaatgatagacacttttatctttgtgttacgttcctacccccagtcctccaaattatggatctgtgccatttgtaccgtggacttttctgttttctgaggatgttgcaacaaatactgatgcaactcctggttaactgataaagtactggccagggacaaagctctcttgtcctgagacccttcctcaagatttgcagcaatttcccaccacgtacctctgccctctcctcacagctggagagggaaagtcatggaatccttgtccttcctcttgtttccacctcttcaagattgggccaattgcaatggaatatccattggttgtgaggcctttgtactctgcaaggaaaagaaaagaaatgtgtgtatgtatgagtgtgtgatggagctaacttttctacaatgtctactaacatgtcctagcctttacttcattcgcctgtttccttctcacaaaaaccctgtatgggagtttttctttactttttattattatttttttgagacaaagtctcgctctgtctcccaggctggagtgcagtggcgctatatcggctcactgcagcctccacctcccgggttcaagcgattctcctgcctcagcctcctgagtagctggtactacaggcgtgcaccaccatgccactattttttgtatttttagtagagacggggtttcactatgttggccagactggtctcgaactcttgacctcaggtgatccgcccgcctcggcttcccagagtgctaggattacaggcgtgagccactgcgcccagccaggagtttttcttatactcattttacagatgagaaaactgagactcaaaaaatacaagtgacccgtccacaggcagatagttaggaagtagcgggacctgaacttgagggcgggtctttctgactccaaagcctcttcctggctactctgatattggctattggcggaggctgggaaaacttgaaatggggaatgatcggggagcggcgaggggggaccagccgttaagcattccagcctgacaggggtgatttgttaaacccaggaactagttagacgtttcctgaaacctcctgcatagggcattttcgagagattgcaccatcagtagggaaactggaaagtttggagcactatttgttttaacccagagaccagtctaagatagctgggtgaatatttccgttatcagcgttttaattaaagaccacaatgaactctccatgctgctgtgattagggacatcttagagaggagctcagaactgctgtggctcacagtctctggattatgaatgccatgagaatgcatatcatgatgtgatagattttcaaaggctcacattgtcattaggtgggtgcataaaggacagaaaaggttctttacttcatagaaagagatttcccttccctttgctctcagtctcatttttatcttagtctctagcaacacagattataaaggggaataaaagaaaataggaacaagctagatacagtgatgagtgcctgtgatcccagcagctcgggcggctgaggtggaaggattgcttgagctcaggagttcaaggctgcagtgagctatgataatgccactatactctagcctgggtaacatagagagacaccacctcaaaattttttttaaaaaataagaaataggaacaattttcctcccaggtatttttttattgtcacagtagtttctaccagtgaagatgtagctaaaaggcatcaccatacgagtgtccttagtcaccaagctgtatgaggaggcaaaaatcattattacatacaaatattcatccttctgtcttttctctcccttctctcaccctgctctggaatcccctaacccctttgctcttcacagtgaattattttctccctcagtttgcccatttccaattttggccataaaagaacatctactattcctactctctctgctttgtaaattggtgataagatgacactaatataatgcaacttgattgcaaagtaaaattgcaaatattgcacaggaaaaaaaataagatttattctttgttaggattaagaaatataacagggttctggtgattaaaataaataagtataaatataaaataaatttttattaattttcattttttaatataaaatcctaacaaaactttgagattttgcttcccattttaaagagatttagatgacctttcccaggtctcaatgaacctgagacaacctgggtctattacactttaattaatgttattaatgtaaagaaaaggagaaatggtatggctttgcattttcaagtcctgtagatatatttaacacagttatctggaaaacatggtaaataatgtagttgtgcatggagaagatagtcctgctgtgggatgttgctgattagagaaaacaaaaacactgctctgggctgtgactgttcctaagcagagagctatttgctgccatgtcctagagagttatggaagctgccagtgtagacgacaagttgataccagcctggggcttaaggagcaaaagctggttgccatccagaatttgcagggcagagacaggacaaagaaatgtcattccaaagtggtcatgtaaaagattcttgctctcctggagtcccgactctgaatctgaggctatagctgggcttcagggggccagggtcacttaagactacatttaaaaatctatgcattttacagagaatttttagggcagtgaattcattctatatgatattaccaatggtgggtacatgttattatacacttgtcaagacccatagaatacacaacaccaagattgagccctaatgtaaactatagtccttcgctgataaagatgtgtcagcataggttcatcgattgtaaaaaaatgtgccactctggtgctggttgttgaaagtaaaggaggctgtgcatgtgtgtggggggtgggggagaagacgtatatggaggctctccatacattttgttcaattttatagtgaacataaaatttctcctaaacatttattaatttagaaaaatatctgtattttgtgtatgtctttcctagagagaggtttataatttttgttgaagctcaaaaatgctgcacaatcctaaaattgttttaagaaaatgaagcaaacccttcttttctggagaatctaaatatacctgcttatagcatctgattatataattggcaaagttgaggacaggaaatgataccctaggagactgacatatcttaatgtagtcattgtgttaaaagtttcaacattatgaataagtctaaaatattttttgaccttcccctagccctattctcctctacttcactgtttcaatgttaatacatatcaaaacactttaatcttgtttaaccacttcctaatagttgatactatagagcacagttcatttagccattccactgttgatggttttttaggtggtttgccctctttctgcattagaggcaatgctacaatgaacatcctggtgcataccagcaaagatttctccaggaaagatacctaggaattaaaattgcactttattttaagatacactgctaaagagccctccaaaaagactaaaacctatgcccccactagcaatatgtgagaatgcatattttcatacactttgaatattatcaaagttaaaattttttgataatctcataggtgaaaatggtatttagttatagtaatatccattttcctaattattattagtttcagatattttctgtgtttactggccacttgtgtttccactttggtgaatttcctttttgtatcctttgccaatttctctcttgggttgtttatcctttctgtttttatttataggaatcgtttatatattgtttgtactaatatttttggtgttatttatgttgtaaatatttttatccatttttatatatttagctttgtttgtgatgccttaacctctgtcttacatttcaacgttctcaaatgtattcttttcctatttacttcttatttaataaagtccttctcaatccccaaatccataaagatcataaatatattttctcccaataattttataattttcagtctttaatccatctgagatgtattttccaagaatgattcataaagatgtctttatttttaccctcaaagcataggcaattttcttgccacaatttcttgaataggtcatccttcttccactgatttgagctgagtccactagctacagcatagacaactatttagggttgctcagaacacagcatgctattttcccttcctatagccatccctgttgcgtgtcattttcctagcctaatgcctattccttcaagactaagttcaagaatcaaccctccacgctcagaaagatttccctcattctcctcactatacccttgtttaaaactcatcaattacttccatttagaagaaaatccaaactccttaccatggccaacaggccatacaagagctgcctactctcagacctcatttcctatagcccctccttggctcactcatttccagcctcactgggcttgtgttgttcttccaacactccaagcccaggccctttgcttttgctgatcactctgcctgaacttattttccctttgtatgacttactcattcttgtccttcacatctcagttcgaatgtccacttttcagagagctcttctctgattgccctctccaaaactgtgttcaactacaacactctatacttctcttttactttcttattatcctcatcagaaatcctattatttgttgacttgtgtattattcacttatccctctagaatgtaagctctttgtcttaccactgtatttctaaaacctagaccgaaacttggtatgtagtagagaattaatgaatattggatgaatgaatgtccctgcttgtgctcctgatggcacctgtgcttagctctgttgtagcaatcctcacactactaccattgggtttttcttgcctgacttttccactaagctttctgaaaaatcattattttttactatgtctagtgtctgtcaataaatgtgcactgacaaaataaatgagtgaatgaatgggaaattgatgttgagatgccgtttttaaagagtaagtaccttatcacacatagctaaagagaccaactgacacatccaccgtactagtgggaaatcttagatctataagtttagaaacatttctatcttccaagttaccacaggagacagtgttactgattgtttcatgattataaacaggacccccatcttcccacctcctatgggaattttcttattgttcttccagtttccactaaccagtctcctcactgcccttctagcctcagatcatcccccaatcccaaagcccaggccatatatgttagcggtttttttagacagcatctcacttccaggtactgatttctataccagtcatttatgtctttgtaacaaccatcccaaagcttagtggcataaaacaggaatgatccattaattctcatagttctgtggggcggctgagcagcttctctgctggttatgcctgggttcactcatgttgctcattcagatgtgagttcaactggaatgaaaggactgagatggcctcactcatgtctggggtcttgatgtggccgtcagctgggatagttggaagagctggacttctttctccatgagatttttaaatctgagatatctgcaaacagtatggcaatctcagggcagcattctttcttagatatggaaaacagaagctacaaggtctcttaaagcctggcttagaagtccccaacctcacttccaccacattctgttggtcaacgaatttattagaccagctcaggtccaagggctagcgaaacagactttgtgcattgatgagaggtgtggcaaactcacattgtaagagcgtgtggaaaggaagcaattgtggtggccatctttgcaaacaatttccatgagtaagaggcataatatttcaaagatccaattaagtatttgaaaaaaaaaatgacaagttagtcacggagaaagcattcaacaaatagcttcttgaccattttgactaatgtacataatgcgaaaaaagaaaaaacaaactttcctgattatgaagagtgaacattaagaagaccaaacaaccacaacaacaaaactattcctggtagttctgatggaagagaattaacaacgggaaattcgcgagattaattaaaactatttccggcccagcatggtggctcactcctgtaatcccagcactttgggaggctgaggtgggcagattgcttgagctcaggagttctagaccagcctgggcaacatggtgaaatcctgtctctacaaaaaattaaaaaaattagctggggctgggcacggtggctcatgcctgaatcccagcactttgggaggccgaagctggcagatcatgaggtcaggagatcgagaccatcctggctaacacggtgaaaccccatctctactaaaaatacaaaaaattagctgggcatggtggcgggtgcctgtagtcccagctactcgggaggctgaggcaggagaatggtgtgaacccaggaggcggagcttgcagtgagccgagatggcaccactgcactccagcctgggtgacagagcgagactccatctcaaaaaaataaaaataaaaataaataaataaataaataaaattagctgggcaagtggtgcatgcctgtagtcccagctacttgggaggctgaggtgtgaggattgcttgagcctgggaggtcaagactgcagcgagctaagatcgcaccactgcattccagcccaggtgaaagagagagaccctgtctcaaaacaaacaaacaaacaacaaaaaccctgaaacaaaacaaaacaatttcctggggtggtcaactcatgtataaaatggttcccatggggagactggaaagcctatgcttaagagatttccaataaaaatggttaccattcactaattagtctacattgtggggaagcagacttagttgttagatttctttatgtgacaaaaaaaaaatccttcttcggctcttgtgtgtattgtgttgtatgcctctattcactaatttctgtcctatggcctaagcaagactgattctaaaggtggttatctagtaaggtatattattcattcactcatttatgtattagttactttatttattcatgcaaccatttgttcatttactcaattaacaagaatttattgtgcatctaagatgtacctggctggcattgtgcaaggcattggagatccaatgtaatctctcctagagctgctggtttaatgggagacacagaaaaccaaatccacaaaaacaaaggttgaattacaatggtaacaccactgcaaagaagaagtacccagggctatgaacgtctcctggagtttgtgctaatcaaggagttgagaagcagggctaggcctagagctaggcaagtgaggcactgagggtgcaaaatttaagaagacattcacttccaggttcctggtcctggaagcctcaactccaggtgcttcttctacatctagttggaaataaaggtcagctgttgtttaggcaccattgtgtaagctccagagagcagagacgctttgaaagctgtggatatctagttgatgcaggtattttattatttatttatttatttgagacagagtgtcactctgtcacaagactggagtgtagtggcgcaatctcggctcactgcaacctctgcttcctgggttcaagcaattcttctgcctcagcctcccaagtagctgggactacaggcgtgtgccaccgtgcccagctaatttttgtatttttagtagagatggagtttcaccatgttggccaggctggtctcaaatccctgacctcaggtgatccacccacctcagcctcccaaagtgctgggattacaggcatgagccactgtgcctggcctgtcatagttcttgacaaacaagtcatatttcttgctgctaatgggcacaaacaaaactgaggttgattagtttgaatatcagtataagttgatcatagatatgatccagagaatgctattattaaaaatttaattaaaatgttaatttaaatattaaattttattttaatctatcactaaaaatctatgtagtggttactaagatagtaataaaaattgtttggttcttatagagcactgtcttcagaatgatgtggtccaatggtcatattggctcgcagccatccttgttggccatatgttgtccttgacgtgtctctggattttcggaagtatctatttattctaaatctgtatttctgtcctggaaagaacttcagtttgagtgctgcttgaagaccaaatacttggaaaaataaaacgttttttcttttcctagagctcttttctctttttccttaagaatatatttccaggtcaggcgcggtggctcacgcctgtaatcccagcactttgggaggccaaggcgggtggatcacttgaggtcaggagtttgagaccagtctggccaacatggtgaaaccctgtctctactgaaaatacaaaaattagctgggtgtggtggtgcatgcctgtaatcccaactactcgggaggctgaggcaggagaatcacttgaacccgggagatgaagattgcagtgaactgaggtcgtgccactgcactccgacctgggcaacagagcaagactctgtctcagaaaaaaaaaaaaaaaaaaaagaatgtatttccagcctttgggcagaatctaaggcttcctctgagcataaaatgatgatggttagaaaaccttcatgttttttcctgccctttaaaaatggattacatagatatccaacaaagtgtatactttctatcaacaactgagttcatttgagacaatgtcaccaaggatgatgtcttgatatgtagagttcatagtgaactagtgcatgtaatcggtttttatcttcatcctccaagcactaagattcctctaaatcagagtcaaagttatttaattgcagcagtgtctttccaaggtctccgattgcaaatggtttatactaagtcagaggagctccatacgccatgaacttcccatgacacacggtatctaaataagtaaatattgataaccagaaagtgggagtccaagctaccagtaactatgtgtcttatcacaataaaaacaaacagtgcataccatttctgaaataattcctgggtccttaaatgaagacttaggttacagcattttagaaataagcaaaaagtaaaataaacattttgtccctcctttcaccaatacccaaggtttaaactttgtatcatggggctgctgcttctccttcctcctcctttttgtatgctgtacacaagttccttccttcccatctctactgacgccacgctgctatgcactctggtcaccacacaacaacttcctgaatgtttctccttcttttactgcttcccctccccagcccaccttctcactagagtaatcatatctactgattttattgtgccactcaaaatttccagtagttccccattgaccacagttaggttccccaaacattttatggggaggaattactttttcctcaaagctttaagaatggtgtgtagcaagggcaaggatgtgtgagaaagagagaagccctgtatgaacttgtgtatttttacataggaagctttccatatataatttcattcaatctttttcattgtgaaatattttcaacatgcaacaaaatagagtaatataatcaacttccttgtatttattgctcaacttagaaggagagcattacaggtattatagaaactccctatgtacctgcccagtcacattctgcagctctattctgaatatggggctcattactttcattcatgtctttacagttaaggcaaggatcacaagctttttctacaaaggatagactgaatattttagactttgcagaccatatggactgtattgcaaccacagtacttaactctgtactgtggctcagaaaggagccatagagagcaagtaaacaaaagggcaaatctggtccttggcaggctgggttgggtctgagagtcatagtttgctgatctctgcagtagagtaacagtaataatatgtagcactgctttgcatatctttatatcaaactgtatgtattattctgcaacctgattcttttgctcaatatgatgtttccccatttattcatatgaatacatctagttctagttcattttattttattttattttttaattttttttgagatggagtgctctgttgcacaggctggagtacagtggtgcgatctcggctcactgcaacctccacttcctgggttcaagtgattctcctgcctcagcctcccgagtagctgggattacaggcatgtgtcaccacccccggctaattttttgtatttgtagtagagaagggatttcaccatgttggccaggctggtctcgaactcctgacctcagctgatctgcccacctcggcctcccaaagtgctgggattacaggtgtgagccactatgcccagccgctagttcattttatagtcatttattttagttcagattataattattttaattgctgtatagtattcacctgtgaatgtgcaatttatttattgtatccattctctttttgatggacattatgctgtttccaatttcttaccattggaaacaatgtggtgaactttttttgtacatgtcactgtatacatatatttgaaaacctatgaaagattcactttttaagctttacggcaaccctattatttcgatttaaatccccaatcaggggagtgtctgggtggtagtgtcaggaggaggtgctgagtgagtagttccaggtcatgcgtgaagctacggaatgtcagaactggcactccacccttaatctcctcatgtctcatccccagtgatatttatactagaccaaagctattatttctgcatatgtaaaacattgccagctatgcaaagggaatatgaaataaatataagcaatgattcctctcttctagaagtttacgatctggtgatatagtaaagacaaaacagatgaaatcaaagcattaattactatacaaggaggagggagagaaaaatgacaaggaagcatcaatcaacaaactggaacatataggggaaaaatctataagactgagaggtgcaagagcacatttgagcaaatggagacatgctgtgcccttgaaaggcaaaattaaatatcagaaatgagcagattttctccctaaatatctacgtttggcaccgtctcaaactcccaaagaaacttttctttttaagagtgtgataaaagatatgataattttatcacagaaaacaagcaagggtatcttaggaaatgttgaaagagaatgatcgataataagaaaggatgatattgatacaagaagtaactgcacgatcaatggaaaactaaagtcttaaagaagcactatgaaccaatgggtgagggaaaatgtactcaagaagcaattctgaaaaaaaaaaatccaccttgtaccataaactaaaaataagaagcaataaaagtaacctttaaaaaatcagatatatttaactacatgcaatgcaaaactttttaggtaaaggtaatttaaaggcatgtagtaaatataatagaatgctaatacattcaacgtatgaagaactctgccaagtcaataaaaaaaggaacacttcagtagaaaaatggcaaaggaagtaaacccaaaatggaaactgtcacacatagccaatatagatgtaaagaaatgttttttaaattactgctaatcagagtaatttaatacaacaagataggatttgtcacctagtaaattagaaaaaattgttcaaagtgagagtgggtgatgctaataaaggtatgatgagaaaagcagtcttactgctggtgggagtataaatggaaaaaaatgatagaacacaatttgacattttttatgctttgctgtattgcctcaattttctgcaatgacccttttattttaaaaatactttagcttaaaaataaattttaataacttttcagaaaaacagtggatgaaggaatgcttaaagttggggttttattaagttaacaaactattaattgagactgattaggctaacagagggggcagctggctaatctatcctgcatccaccctatccctcttccaggacaggggtggggaatgggggagtcagggggaaggtagggaagtgatcatgttcaaatcagatctttttcttttctttacctgctctgattcttcttcttcttctttttttttttttttttttgagacgagtctcactctgttgcccaggctggagtgctggagtgctggagtgcagtggcgtgatctcgagttactgcaacctctgcctcccaggttcaaatgattctcctgcctcagcctcctgagtagcttggattacaggcacctgccaccacgcctggctaatttttatatttttagtaaagacggggtttcaccatgttgaccaggctggtctcaaactcctgacctcaagtgatccgcctgtctcagcctcccaaagtgttgggattacaggtgtgaaccactatgtctggcctttagctgcatttctaaggagatttgcttcctctacttcatgtgttctgccagctgttgaccatggctatcacctgacaatgttgttttcctttctttcttttctttttgagatggaatctcactctgtttcccaggttagtgcagtggtgcaattttgggtcactgcaacttctgcctcccgagttcaagtgattctcctgcctcagcctctcgagtagctgggattacaagcctgtgccaccatgcctggttaatttttgtatttttattagagatgagattcctcatgttggccaggctggtcttgaactcccgacctcaagtaatccgcccacctcagcctcccaaagtgctgggattacaggcgtgagccactgcatccggccataatgttgtttttctttctgatctggtgttctctcttccacaatagactgctttctctacttgtgccttttggcatggaaaatgagctgccccatttgtagagacagtctcatggacaaggcatagttttgagtaaatgggtactcataatagctagtcataaagtaaatcctgaaattttaaaaaaatgtttaaaatcttaaagtcattagaaattaaaaaaattcaaatttatatacatattttagtggcagaaaatatgataaaatgaccaataacagactctcacgtgtagacatatgctaccttaggataaaattctgccatgaagtggaatggaatgaaatgtaaacttgaggaagaacaggaatgattaaaaagtttccagctgttaaagaataacttcatctatttcttaaaaggataagggagggtaaaaagttgctgtgatatttagatttaatcgaattatttaaaagtaatgcaacaacatgtaaaaatgtcaatttttataatacatcagaaattatattacttgcaactattttattttttagtgaaagacattagatgtcaacccaaaaagtgtgttgaaggagcatattgtttttcaagggtctttcaaaggttaaaattctcaacctataacatgactccttttatggaagggaggatttgaaggaaaaaagactatagagctaaagtcaagggtctcctgggagttcttcttttgcagttccttccccaaaatgaaagtgaagagtattagagaaagaagagcaccaaagtaaccgtaattagacaaataatgtatatggaaactcttggcaaataggctaaagttgctaatcccagtaagaagctgttaagaggtaaagaaaatctgactattatgagatgtatttaattaagtgggtttatatccccaaggtaatctttacatttattcatagtttacctctaacactactttgattgtttgaatcccttctgttctttgtttcaggcagggattaacatactttttgtgtaaaaggctagatagtaaatatttttgggtttctgaaccgtgcagtcttgtgttgcaactactgtactcaactctgctactgcagggagaaaagagccatagatattccataaacaagtggctgtggctgagtaccattaaactatttataggcactgaatatgaatttcatataatttccatgtgtcataaaatattcttcttttgttttttttaaccatctgaaaatgtaaaaccattctaagctcacaggctacacaaaaacaggcagccgaccggatttggcctgcaggcaatagtttaccaactctgtttttagatacagtatttgaaggcccttttatactgaagagtgagaacaatattctggaaggatacacaaagaattagcaattgtaattgtatttaggtaaggaaaatgggtgtctaagctgggaagactttttttcagtatactgtttgaattgtttaccatgtgcttgtgttactatttcaaaaatttagtttctttttttttaaagcccattcgggaattgtaaacccaatgaatctgacttgagtggaccctgctaactatctggattctagagagttctgctgttagctaatcaggggcattcacatggtaggtctccaatcagggataataacttaaatgatgcagaattaggggaactggacttttcatttgggagagcaagtgataaattatgtcctaagcttttgtgccaatagggcttataacatttctccaggaagagcaagtcaaatgtcatagaatttggcagaactaagcaagaaaaacaataaatgcagataatttaatagagccaacatttcttgagggctgactgtatgccaggcccttaatttgaaggtgccaagtttatatgaatgtattgaagaaaatatatcacaggaatccaaaatgaagatgagtgtgcctggaaaatattaaaaaactgtaatgtgcagtggaagtacgggggagcttgctgaacatggctcaaggttaaaaaagacagatgtgagacaaggagagcacagagggaaacctgaagtcagagtcacagagctgtaatatcctatttttaaagaccagaggaaatgggccttaagttacagagtataagcttgggttgaatattaggaaaactttctgaccgttcacattgtgggttcctggaaaatattattatgggaaattgtggaatttcctattcccaagataggagaaactctagaacaataattgcctaaattttgatggggagtggggtatttaagcccatttattatacaatatacagacacatatacatatttagtatcatgattcatatatgtattcatatatacacattatatatatccttatacaattgatatgtacatgctgaaatttgaatttccctagtcctcaactagcttatgagtatgaatgaggtcctgttaataacaacaactcaacatttttcttttgagactttagctctgtcgtccaggctggaatgcagtggcatgatcagagttcactgcagcctcgacctcccaggctcaagtgatcctcctgcttcaacttcccaagtagcttggctgggactacaggtgtgcatcaccatgcccagctaatttttaaatttttattagaggtgagttttgtcatgttgcccaggctggtctcgaactcttgggcttgagtgattctcctgccttggccttccaaagtgatgggattacaggcagtagccactgtgcctagccagaaactcaacttttactggcttactcttcaggacctcccgctcctatcagagcctccctccccgacaacaccccagttatttcaggagtgccttggggtctcttcatgtttataactaagtctgctctggctgttccttccactccattttgtgtccatggggcagagcagtgcccaaccagtagtcatgattcctctgctgggcacctctgctgcccagccctcttgggttcggagttccactgtgatatatggcatagttgtttgaggatgagggtgaggttgaagtgagttctctctctcttctgcttgttgcattggacggatctgccttatacctcaatgtttccagacttcatttttatttacaacccttttcttctcacctctgggtggtaggaaggtctcctgaatctagtatgggttggtcaaacacagctacactgaaaattacatatgtctctaatggctaaggctttcctttggggtgaagttcatggtccctagctctctatgagtttagaatggattttctcccaccaagccgcttatattaatggatagtagagtttggcagtagggcttggtggaatttgatgggctatgccgtgggtttaccagatggacccagatatgcctggaacccacagtggacacagtttgtgtctcttctcagaagactctccctcattcttgcttcttcatgtggttcttctctgttgtcttcccatcaatgcagattgctctagtatcgcccatctttaaaaattgcccttgaaactacatcctccctccgctacttctctatctcttgactctctatctcttcacatccaaacctctctattacagcatcctgttatttgccttcataaacagctttcatgacaatatataattatctatgtatttgggtgattatttaatatttattcctaattaagcttgatatcatggatcatgaatgtttattttccttttgccattttatcttcaaatatctagcacagagtttagtgcagaatatgtgctcactgaatatttgttgcaagcattgaataaatgaataaatgaaggaaacaggtttctggtggacgactttcccagcagccaagtgcacctgaaactcacttctgtttgagctaggacatttggtgagtgagagagaaagagagatacgaataatggggaaatcctaatgaaatacatacttatccaaaaaacccactatatcctcttcctgggcagcaaatatagacagctatttatttgtaaataaagtcataccttggtggagacagaaaaaaaaggtttgaaaatcatcctcagaaaacagcttgggaaaagagattctgacagcacacattatcacttttcattatttaacctttcaaattacttctttagggaggtagaagacatcgtagaaggagtgaaagaagaaaagaagacttagaaacatagctcaaagtgaacactgcttctcttagtttcctggatttcttctggacatttcctcaagatgaaacttcagacactttggtgagatttaccattatttttcttcttactatatctttttaaaaagccccggatcaatacatgaccaaggtagatcatgacagtgaaaatgaaagcccctgaaatttcctctaaaaggcagatacaaggaatatctctgattttctgatctgctgacataatgcctaaatagtcaaaaaaaattccagtaggaagtggctttaaatcactattaatgtttataaaaacctattcaactttagaataaagtttaagataataaatcatggattcatctcattttaaatcaaggccttttatatttgtttttttttctaataaagacatagtcaaaatgtcatcatatcttgcccaaatctcccaagggctgaaatttgaatgaaaacatacggtgtttttttcagataaattagtatcttttatgcaagcacgtatcttgggcatttttaggtccaaatgaggtataaaaatgataaatattgagaaaagatacatacagaaaggctatagtaaaatgcattcaaagggagccatttgtactttcgtaaactatctcgctgtctccttccccagctctcctaaccaacccttcccgcattcccacagtcacaaactatttattttcctttcaggagttttttttgaagaccaccataaagaaagtgcatttcaattgaaaaatttggatgggatcaaaaatgaatctcattgaacattcccatttacctaccacagatgaattttctttttctgaaaatttatttggtaagttgtcaagttcatttgaatatcaataagaacaaactacgatttggaaatacatgaggaaatgcctagatgatgagtccagcccagggtcaagaacatgtttttgttccttccaagtactcaatcaatgttagctactctgcaaggttagaggtagatcggaccttggattcatgggacttaatggtcttcatttttatagatgaggactgcaaaagctttgtgaattgctcaaggccgcgaggctagataattaacagagcagggagtagaaagcgattcctcctctaaggctaattccaatattattatagcaggtactaaactatgaaatcatgattcttatggcttaatatgacacctattaaaggctgagtttacttaggttatagctgggcagatttccttttgcagttcctccggtgctgggggatctatggcacagtgtcaggattagtcatttaagcaggattgaggacaaattgtactaagcagttttcagtagatctgtaactagatgataccataaaatgatatattgctccactttatgcatttatgaaaaacatctcattataaagagtttcaactgcaaacattaacaaagatttaaccaaggcaatattttgggtgggacagggagcctttctgccagtgttaaaataattcccttctgcataatagccctgctggcagcctgggatgctcccagttttcaccctccgttaatatatgggccatgatataccataatagtgaaaatgcaaacactagaagttcctcaaagttcaatgtatgaaggcatgaccgcttatttggttgctgatattcctaggacctgttaattaataatttgttctgttacctattagtcattagcactttagtgtgtaatagttgattaggccatttccaaaaaggggtcattatttgtaataattatttacatgtgtacctgcctccatacagtacaaatgcatttaagggcagtgaccatatttcattaatattttattatccagtgcatatttagtaggcacttgataaataagagtccagtaataaataatagaagggaaaagaaaaagaggtttatggaaaaaacagatgttgatccgtaactcttagagagaccaaaggcggcagtaattatttattaaatgccagttctcccaagtacttgctgcatcttatttcttccagttggcttatcttcatcctgtagatgcagtcaagggcagtgggaggccctgcctccatgtctagccacttgaccatttgcttctggcctgcctgcccttccgtggttcctcagaacagagtcaatgtatagacatcttaatgattttttcttctagcaatcagaactcacagaataattaggactattggcacataccacagataaagaaaaattgcactcaagattttttttcaaacagaaacttccatttcctgctgtaaaattttatgattgtaggttgagatctctgagcttaggcttcatcattactaaaccaatctattcagctccaatttgcatacagagagaaaattgtagggttttccttacaagctagcccaattttcagccagcacagaagatttcagggtgatttcagcagccataaggtgaaaaagatgccagtaaattcagaaaaagccacgaagatgccgtcaggttagaagcatctaaagatgattgctaaggaagcactgtgccttctgcttttatggtgtggttctctcctctctctcttttgctggaccacattcttattccatttcctaacactgcatttaaggtttctgagaatatatagcacaagctgcatgagctgcaatgcagagctgtaattctttgctggagcagtttcctcaactctttatctggtcccctcttctggtaaactaatctgaccatgtgtgaccattaggactccttttccttttctccactaagctgtagagccacgtctaagcattattttcaaatctctttcccctaggccctcagtctcacttcacttaacacatctgagctaggctgggcatagtggctcacacctgtaattccagcactttgggaggctgagggaggtggatcacgaggtcaggagatcaagatcatcctggccaacatggttaaaccctgtctctactaaaaatacaaaaattagcttggtgtggtggtgcatgcctataatcccagctactcaagagaactgaggcaggagaatcgcttgaaccagggcagaggttgcagtgagtcgagatcgcgccactgcactccagcctggtgacagagtgaggctccaactcaagaaaaacaaacaaaaaaaaaacatacctgagctaaaggtatgccaaaggggaggacgaagaaaattttgattcctttattcctcttcctcatcttcttgtgtgtcatgatgacattgatggcttctatggccccttcatgtgcgtagggtggaaggcaccagggaaaagactggcccatgaatgagtagcccacaggcctaactcagtactcctgagtctaagctacgccaggggttcagaagggttaatccatgggttcaactgcccagaaagctggactcttttccagtggttaactgtgtattgaaaacagcagtcatgttgttataataaaggcaaacaaggttaatggaatagtctatggatagctgtcacttcttctcttcaaatatcggacactgacaatacgctgggccttggaataaagcagagaataggacaggcaagatcctagtagaaagcaaactcacaataaacttgtaagtaaatcaataaacaaaataatattatttttataccttatttggacctacagatgcccaaggtagtgatacatgctatgaaggcaacaaaatagggtgatgccctatagcctggagtgatgggctgctctaagtggtatagtcaggaaaggcccctgaggagtccacaattgagcacagcctgaaagacaagaagccagagagaacattccgggaggagacaataacaagtgcaacggcccaaagtctggaatggactcagaaggaccttgtcttctactcatttttatttaggggtggacaactgctttcccattaaccagctgtgcagccttgaacagctcactcaagttcagttggtaaaagtagattatcaggctgggaattctaggacatttactcaaattaaacatttgagtccacaaaaatgctactgttgtccacgtcaggaagtggtgacttaatggtactcacttggtacacggctcaacaagtccttttaaggtggtcctgggcatggtccccttcactgcaggttattataaaggtcataattcaatgacaactttaaggcatttagaaggtgacctgaagacaaatacagacaagcactcactactgggtcctggagacaataatgaccttttcagtgataacttgcagcttcttctagaggtgaccatgggccccttactcttcaaaggctttgcttaaggtgaaggggaaatttcttcacccctgtaatgtttattccaaaaagcagagcccaaatgaggacttgtgtgaaggcagtttatgtgagacatgatgagggagtggaggcgagggagtgggcgatgcaacagggaaggagggaaaaccaaagaggtcagttgtcaagatccctggtgtgggggaggccagcttgatgccactgggagcagcacagagaactgtcagcagaggggtcagggactggagcatatattaatattaactgcccctcggctcccgttggttgagcgtcaccccagggggcattaattccccgcacttctggactgtttttgagctcaggccaagctgtctcctgtgggattagagaagttctgggcagaaagcataggaacgtgcggcatgctcttgaaatgacaggtggtcagcctgcagtcatcatctgagctcgtgtatgatcagctgccacaggtatggccgagatcagagacgggctgaagggatgtgacagctccaccagaaaaagaagaaaagaaacttggacagaatggaatcagagagatgggggttggaatcacctccctgaagtcctttaatttattctgttgccagacatccctgacaaatccagacggaaatctagcccgtcggtaactgaatccacgtagaggcctgggggtggaaggacacagttaccacacagagattcgtctcctttcctctgggagatcctgcaagccaggaagcttggtcaaagattaatttagtggattaaaaaaggcgtctctgatgaatgaataaggcaaagttttatgcaattagtgcataataaaaagtaataatgacaaagtccacagctccccaccatctgacatagtgaataaaacaggagatggtatattaactaaagtctatatttacttttagcaaattatgtttttaaaactcaaaaattacaaaaatttagagactaaagagacaaagcattccaacaataagagaagaagcaagagaaaatacagtcttatcctcccacacccaatgttcctgggcacagtgattcctgattcacttagcacagtgacactgggaatggaaataaggaataaaatagcgggaaatgaaatctcagaggcaagtgagattctctgaacttcagtttttacccacataaaatgaggataataatgtcacacttcacaggttgttgggaggaaggaatgggctgtgtgggaaagcgctctgtaagctgcaaggcatcctaaaatgttacaattaatccagagtttgaaatgtagttgtcatattttaaattgttgaaatgataaacaccattccactcattaaaagaaggaagtactgtttatctcaacattgtggagtgcaaagaactttcaaggggccagagagaatcaacaatacgtaaataaggctgggcgcgggggctcatgcctgtaatcccagcacattggaaggccaaggcaggcggatcaccagaggtcaggagtttgagaccagactggctaacgtggtgaaacctcgtctctactaaatatacaaaattagctgggcgtggtggcacgtgcctgtaatcccagctactcgggaggctgaggcaggagaatcgcttgaacccaggaggcggaggttacaatgagatgggcgacagagtgagcctcagtctccaaaaaaaaaaccaaacaaacaaaacaagaaaaaaacaccaaaaaacaaaaacaaacaatatgtaaataaatttctggttacctcacctttgcattattacattgctaacaacagctttggaatccacgtcttgtattgcttttattattgtatctaacagtctttccggagccccattctgattgaggcctagcaagtgtcaggaggtagatcctatacaatcccattcacttatctttcatttcctttggctatttctcattgccttatgcttcacttagctgtgtatgcccattttcttagggtgcgctttatttctttatttttatttttatagagaaagggccttgctctgtcacccaggctggagtgcagtggcacaatcagagctcactgcagccttgaactactgggcccaagcaatcctccctcctcagcctcttcatgctttatttgtatcagaatacactcactttgaaatctgcttcttccctatgacttatgcttaaattgaacgaatcttccagatgttacagagtcagtcagatgttttaaaatgcaattaaaggttttgagatgcagtttgtagaatatttctgacatttgatttcaggtatttttccatctcactgagttcaactcaagtgaacgtagttctgacttcttgggtgaattaaagttcaaagtttccaaaagatagagagataccattgtctcagataaaatgaagctttgtttcagcatacttgaaatattttgtcactgctatttcttctccacagctcttccatagctgtaagcagtctctaaggcatttaatttactgttactttggttttttctttctcaaggaatctcagttctggttctcttgatagtggagtaaagaaatgggagaaggaaagaaatattgaatgagcctcttcttattacaaaatagattactgattctttcagcaggggcttgcagagtttggaaaaggtgtgcaatgagtcagagagttggccagctggtaggcgattccactgcagtctaggccttagctctcaaccctgcaggctaagaaacagattcttagggatgccaagttaaaaaagattgactataaaatcatattgcaaatatattaacttacaacaataaaaataattgtaatgataacagctagtatttcttgagtgctttatagaaattaatgtgtcagatatcaagctaagtacattttagatttgttaacagatttcctgggttggttccaatctctgccatctactaccctgtggtcttggacaaattccttaactttgcacaagttacttgccttatttaaataaggtgataagaagaatgcctggcacatcacaagtactctatttgccactaaaattcactctcacaacacacctataaggtaggtaccattactgttccccttttatggtgagaaaaggaatatttagtgatgttaaataatctgctaaacattccataattagtaagtaggcaactgaaatataatcaggacaaggaaacaaaatccaatgtttaagtctccaggcttagagaatacttctattaaccttgtcaactgggaaggtctttcaataagattatctacctttaaagtctgctgaccatgtctgttctgaaggatagttctcagaaaaaaaacattgccaacatttactctaggacctcccttttttcatgccttcatagctgatgccccactcagcgtgagaggtacaacattcacagtgctcccaaatactctgccgaacagtgccatcagatagaactttctgtgacgaaggaaatgttctagctctacttcgtccaatacagtagccactattcgcatgtggttattgaacacttaaaatgtgactggtgtgactgaggaactgactctaatttaatttaaatcaatttaatttaaatagcctgatatggttgggctctgtgtccccacccaaatctcatctcaaattataatccccacatgttgagggagagacttggtgacaggtgattggatcatgggggtggtttccccatgctgttctcatgatagtgagtgagttctcatgagatcttgttgtttgataagtatctggtgcttctcccttcctactctctctcctgctgccttttgaggacatgctttgctgccctttcaccttctaccacgattataagtttcctgagacttccccagccatgcagaactgtgagtcaattaaaccttttttcttcataaattgcccagtcttggatagttcttcatagcagtgtgaaaagagactaataaatagccatacatagctagtggctactgttttagacagcagagatattcaggaaaaaatatttttttagggaaaaaataatatgagacagttgatcatctctaagagaaattcaaagggatccaatcagtcttgttatgagaacattctgtgtgaatttcactcagcaacaagggtttcctgggtcagctaaataatcctgctcatttcttatctagtatagatgtttctgagggcaaccgacaggtccatttattttggccagtgaaaaacttagtggagaattcttgaaatggaaaattctgaatcattcgtctagcttcatatcctttgggtagctttttcacctatgaccctctcagggaaaggatagctctgggattgtgaggaagggagaacgaggtcagaagtaaactgaggactgaaaatggctttgcagatggtgaccccgatcaagcaattcaaactgaaatatacccatagaccaccactcttttcctctttcttggcaattagggcaagtgtaccttagtttttccaccacgggattttgagtcagaagacctgggttaaagtcccagcttcattccttactaatgggatgactatagacaaatcactgaaactcactgagtttaaaaataggcttaaagatagtggaagttagaaataatacctccctccaagggtgcaagtgaagatctgatgagataatgcatatggaaccgctttggaaacttgtgaaggctatagaaatgtcttagcaatgattattccacttgtatagctcacctttgcctttcaaaattgctttcatatttactatctcattttatcttcagaacaggcctaaatagggcatgaattattatctatgttttaccatctattgatgtggacaaatggggcccacagaagctgagagactcatctaaggttacacagtgcatctcgctacattatgcctgggctccaccctggatcaactgagtccccttctaaagccctcatttctaaaaaacaaccaatagacttaagcttgatgtacaaaagttatgctgaaggataaaatatagaattattcctattcaataagcaacccaaggtacaacatgagtccaaagctgagcaatcataacatcaatgtagtgatgatgggtagccacctgttgtgctaagcattttataaatactattttagttaataatcacgtataattctttgaggttgtatagttatcaaccccattttacaaccaaggaaataaaggcagaaaatggttcaggaatttgtccattgtccacagagctaataagtgccaagacagcctggatgtattagtttgctgggtctgctgtaacaaagtaacatagactgggtagcttaaaccacagaaattatcccatagttctggaggctggaagtccaaaatcaaggtgtcagcagggttagctcttcctgaaggctgtgggtggaggatgtgctccagggctctctccttggcccacagatggccatctccgtctcctctctgtgtgttcacatcaacttccctctctgtgtttctgtctctgtaaccaaatttccagtttttataaggatacaagtcatattggatcttcattttaatttgattttctctgtaatgaccctatcaacaattaaggtcacattctgaggtactggggtttaaggcttcaacatatatacatcctcatcttacaatggttcaacctactatgtttagactttacaatggtgtgaaatagacacttttagcatagttttcaataaattgcatgagatattcagttctttattacaaaaaaggctttgtgctagatgattttgtcttacatggtggtaggcatgtcttacatggtggtagggaagacagaatgagagccaagcaaaaggggaaaccccttataaaaccatcagatcttgtgagacttactcactaccacgagaacagtgtgggggaaaccaaccccatgattcaattatctcctacaggatccgtcccacaacacgtggggattatgggagctacaattcaagatgagatttgggttgggacacagccaaaccatatcaagcattatgctttaaattcttccattttaaatcataccattccattttaaatcataccattctgccaccttttgatggggacaaatgtcaggacccggagcatggcacttgacctccaagtccagttttagagccagtgaacagaaacccaccctctaaaagttcttaaactggaaaagtactcccccaaaatgtttatctaagagactggtttccagcttactaggcaatttggcattaagaactttcctcataaacatttacaaatattctgctccgtaatgaagttaatcagtaaaccacacaacctctgtcctctctcactccttacctagtctcattttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtaggacactgttcacaggtgctttcaggtcgagctcttgcaactggactgaggaaatctggggactttggttggagatgacagtaacagatgtctgtcaaagatagtggctcagtcagacccagaagactggaatgagagtttgggttggggtgatttttatagggttctaaacagacgaatatcttatggggatgaaatccaaggatgtttcccctaatattcttcatagactcttatgtcaaattatcactattcttccaaaccaaacattagacaattctaatattaatatcaatggacacttgaaaaaacattttaacagacattatttaatgcagtgctcctaaaatggcaagtctcagttcccaggggatcacaaaatttatttagtgtctcgtgaccagcattaaaaactggattagaatataatagaatagaaatattagtgtccctcaaggagtaaagacaagtggtatttcatgaaattttgtttcagttacatgtgtataagtatgtacgagggatatgagataaaatgtatctaaaaccgtaggttgtggtaaaaaaaaaaatgaaaagagtttgggaaacacgaattaatgaagtagtttcacagcaggtttctcccaatagtccatgaaaaatcagataagcacagagttgagctttaggcccaggctcttggttttctctgaattaaaacatcgattataattaaaacacagtataatgtaaatcatattttaatattttttaaaacagaaattcatcttttaaatttccagcaagaaaaaactcgagtcatttttataataatgataattgtgaacatgtttttggtcatagacttggtagcataccattttgtttaaatgcgatgtttaaaagtgaccgacactgtatttagaaatggaaatgagttggaaggccggggaagcaaattttctatttacttcaatttaaccaacatttaataaacatttactatgtgtcagccattgagttagatgccaggaatataaagaaaagaatatagtctaatattttccctcaaagagttcacagactaatcacaacaatcacaaaagtatacatgtgtatgtggtgtcaggcactatgcagtttccattctttgtcttagttcatctttattacagcctctcatgcaggcactacattctttcagctttgtaaaggaaggaacagaagcttaaagaagttccatgtctttcccaggttcatatacctaacaagttgtgggtgaaatgaatccagatttgtctgctcagagggcactcttaggtagtatctcataccatctcaagttcagcgtggaagataagcctgtaaacaaaagaaatgattgtatgtgcttccaataagtgccataatagaagtgtgtacagaggtaggagaggtgaattccacctgggggaactggggcagacctcccagagtaggtgaccagaagtaggtgatcagctgacaaggcagggagaggcactgacatcacaaaggcctgatgccaggaacagcaaacaactttgcagtaaagccctgccatttagtgaagaaaccatggattaagaaataaaggaaggcaaaaaaaaaaagtgacttttctaggcactgcaattcaacagacattcattaaacatttactatggtcagcattgtgccaggaatgaaaaactggatataaactggaccctttcttaggagcatcagaaactcactgtgagattatgggggagtgccattgtttttatgcaaacctgatttcccatttgggggtacagtggttctggtcccaaactccttagagctgcactggctaatatgccacatgtggctattcaactttaacttagaattaaataaaatttaacagtcagactctaagtatcactagccacattccaagggttcaatatccctatgtggttagtggctaccatattggtaggtacagaacccttctatcacctcagaaagctccctcagatggcactcctttagagaaggtgttgaaacctggagactgtctaaccagaagaattttactttcttttcagggcttctcagactcccctggagtccatccatgtgttctcatttaagaactcgtccctaaacttccatggagaaccgtcacaaaggaatcctaattctcatactctttgataggctaattccaaaataaagattcctaaatctaaattttaatatgtattttcccttttaaattgtatcaaaatagaaataaatttaccttttcagaaagcatactctaaattaaagtcgaactacctctactccctccacatcttattttctgccaatgttgtatttgtttacttgtttacttatttttgtcctaacccttgacatccccacttcccaaaacacacaaacaagagaaaggctgggccttcgtatgtgtcttttcactttcatatgttcagaccctaacacagtgactgctaaatagcaagtgtttataacacacacacacacacacacacacacacacacacacacacagagagagagagagaacatgagcatatgtttataaataataatttgtaatgaaagaactatcctaatacttatatcatcaagacagactgtgttaataattacttattaactatcaattaactatgattaaaatcaggattttgctaggttctttaggaaacatgtcttttaatgacactcaacttaccgaaactgcttctcagcaaccgtattttacactcagaactaccttctgagatagcaacagtcccatttttataggagagattgaaataggaaaagcttagccagttaagatctcatggtcagttaactgtggaagttgttctagtccaaccattttggaatatttggccatgctggttctttggttgtaaagttcctttgtaattacttctctatttgtggagatttaggagacacactatgaaatgctagaagtgaatgtgctttgagaatagaaggttttttttgttttttgagatggagtctcgctctgtcacccaggctggagtgcaatgacatgatcttggctcatcactgcaggctccacctcccaggttcaagtgattctcctgcctcagcctcccgagtggctgggttacacgcacctgccaccacgtccagctaatttttgtatctttagtagagacggggtttcaccatgttggtcaggctggtcttgaactccttacctcaggtgatccactcgcctttgcctcccaaagtgctgggattacaggcattagccactgcacttggccaagaatagaagtattatttaatattattgtgtacggttctcatatttttactgatgttctactgttttagcatgatattatctatatctttgtgaaagctttccattttgatctagattattccagagactgaaagacagggatattattatctgacttgacttgggactcctttgtatttcttgattatgaaaataattgttttgttgaaataatgcttaaagattttagaattgtcatatgaggagaaaaaaagtacacatctccttggatgctacagaatccagattctatcggtttttgatcttgggcaaattacttaaccttactagacctgtggcagagagaaattgggctaagggaggaaggggagttaagggaataagataggttagaggataaaatctaagtgtacgtgaaactaatgcttttaatactttttagtttttttcaattccattcactccagaaattttcatcgtatttggtgatgaaatagatcaggattttgcttctattttatcttttctttttgtgtaataattccatatttttctccttccattttgcggtcataagacaaggcaccatttctaaaatattttgtccatcagacatactcgtttttttgtttgtttattttattttgttttgtttttgtttttgttttttttgagacagagtcttgctctgtctccaggctggagtgcagtggcgcgatctcggctcactacaaccaccacatcccaggttcaagtgattctcctgcctcagcctcccaggtagctgggactacaggtgtgcaccaccaagcccagctaatttttttgtatttttagtagagacggggtttcaccatgttggctaggatggtctcaatcttttgaccttgtgaaccacctgcctcggcctcccaaagtgctgggattacaggcgtgagccactgcacctggcctatgctgtttttatatggataagtcacacagaaggaaaggaaattgatttttgtacagatactgtataccatgtgttctgtcaatcatttcctgggttaatgcagaaagcattattttcaacatgtaatatgtatattctgaaatttggcagtgtagaaaagccctaaattctaatgttcataaactattagtcatatacttatggagacttttagatataaagaagaactagaagattatctagggtggagtcttctctttacagatgaacagagggaggcccaggtagggtaagtaatggtttttaaatggcatgtaactagattcaggaacatgactgccagggacctagaaacctcttctgttgggaagacttcccaagagaagcaatacccacagggaatttagaggtaagtggacattagtgagatgaagccctggaaggggttggctgtgttgagaaccatttcaggctcaggaagcagcaggtgggagaagtcctgagtctggaagcggcaaggcacattcaagaaacagagatgtccgaacatgcaaaatggctggaaaagaaagcaagggtagagtcatgcagaagcttgcaggcccagttataggttatgtgcaagcggaggccgagaagggggtaacaaacacaagtaggaggatgcagagaggggctttgaagatcatgtttttaagtatcacacacctgaaattacccccagagagcagcaattcagtgcatgggctttgagattagactcctagagctcaagtctcatctacttaggtaggtaggagtaaagttgcttaactactatgtgcctcatggtactcatttgtaagtgggggttaataatgttacccacctcatagagttttgtgaggaataaatgagaacatacaagtgcctgctactacgaagaactctataaaagttttctgcaaaatgtggtaatagtaatcataataattatagtaatcgtttcaactatcttttgagcacagcaaagagcattgccaatttgaaatccccaaagccccaaaaaaccacgtttttctaaaagtttggcacacacttttttggtgacagaacctgacctgaatgaatgtgaaactatttatggtctttacttattgcacttgctgtgaatattcatacgtttccctgtggaaaatattgctgtatttgattctgggttctgttccagactgtgctgggagggatatataaatagcactgtattctgttctgaaatcctgaaaattctgacttctaaaacacatacgactgccagggtttcagataaggaactgtgaatctgtatcatctcactcaatcctcagactaactcttgatatcgatattatcatcccaaccttgctgccatgaaaaccaagatttatcaatagtttgaataatttgctcaaaatcccactgttcataagagatggaattggaattttggtctagaattgtctgacaacactttgaagagtcagacacatttgtaaactttcctatctcttatttatgtctattttttcagcatttgcataatttcaattttttattttctaaagagccatagttgatgtttccaggaaatagaagcattttcataacctgatgattttctattacctagaggttttctaaataagggactcctttaataatgatggtagtaagaataattgttattattcctattttaagtcagctataatttatcgagcacttctgtgtgccaaacatttagcaaagcacttggcacacattatctcatataatccttacatcaacccaatgaggtaggtgttattattctctgttttattagaagaagactgcaacttaaagacattaaggaattgccagctgcacacagattgtaagtaacagagcaggaatttgaatccagtagatagattgcaggcactgtattcttttttttaaagctcctcctttgttttataatgattaaaataacacatacatatacacatggcaaaaactacaaacagtaaaaaaaattatgcaatcttctatcccagaatataatgtaaaaatatcacctctcacagtcaccaccacctactttcttctgtatcatgcagaaatttgtctttgcacgtgggcacgtgcgcgcacacacacacacacacacacacacagagttggtgtttaataccgatgtgaatatacacattggtctatagcttacctttttcatatagcaccatattgtagaaaatttccataacagcacatagaaatctaaataattgttttacatctacttaatagtgtatggatgtaacaaatttattgaagcagactcctatggatgaatatttagatcgtttccaatttatggctcttgcgaatgtgctgcaagtgaatatttttacaaaatactttttcatagaggttcaagcatatttctaaaataaattttcaagcagtggaaaatttatgctgggtgaaaaggacattgaagtttaaaaaactggaaaatattgacaaatttccccccaaaaatatttgtttccccaacagtgtgtattattaaactttttaaaccctcacacatttgaagatgaaaactgtaatgttttagtttcaatttaaatttaattattggcaaaggtgagcacatttttctgtttacaaaacacggttatatttctaacattgactattcctttcctttatccctttttccatagcttctcaaatattttcttattggttttcaggagctctttatacattaatgagatgagtctgtcctctatgttgcagatatttttctgaatttttaatttgtcatttaattttatatatatatatatatatatatatatactctaaagaagttgtaaacttttatgtagttaaatgtttcaatcttttcttagagcccacactcctaaccattacgccaaactgcctctctaatttccagaatgatgacattcattccagttttgttgtcacttttgttcaggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtaagcatctttgattggcagttttctccttcaggttttactatattggttgttgaaatcccttgaactaattgcttcccttttcccaggcaacttcccattttctcctcctgtgcgcctacctcctcctacatcctcacctttgttgtgtagtcaaagatctgtaggaaaagactgttagagtatttagcttaatgtttaagactgttagagtatctagcttagagtgtttagctttcttccttttcacaacctcacacgtagctaaagggaacttatgattaaattgaattttttgtaggttttgtttgtttttgttgtttttttaaaaaagaaagaagaaagtgatgaacacatctcttttaaaattaagatctagaagaatacaactttattcaataaatatttaaaaatatttttcatgtactttagttaattgagaaagagagaaagaaagagccaagtaataatagcttatattacaaaaaaatattttaacttggcatggtggctcatgcctgtaatcccagcactttgggaggccgaggcaggcagatcacctgagatcaggagttcaagaccagcctggccaacacggtgaaatctcgtctctactaaaaatacaaaaattagctgggtgtggtggcaggtgcctgtaattccagctactcaggaggctgaggcaggagaatcgcttgaacctgggaggtggaggttgcagtgagccaagatcgcaccattgcactccagcctgggcaacaagagcgaaaatccatctcaaaaaataattttttttttttttatttagcctaggcatggtggctcatgcctgtagttccagcactttgggaggctgaggtgggtggatcgcttgagtccaggagttcgagactagatagagcaacatgggaaaaccccatctctacaaaaaatacaaaaattagtcaggtgtggtggagcacgcatgttgtcccagctacttgggaggcagaggtgggaggatcacctgagcccgggaggttgaggctgcagtgagccgtgatcatgccactgcactccagactgaatgacagagagagaccctgcctcaaaaaatatatattttatttagcagtaatacagttctgttatggatgctatagagaaatcataacaaaattgcaatccatttaagatggataaaatataataaatgaaatataaaaatgacaatgtaggccgggcatggtggctcacgcctgtaatcccagcactttgggagaccaagacgggtggatcatgaggtcaggagaatgagaccatctgactaacacggtgaaaccccgtctctactaaaaatacaaaaaaattagctgggcttggtggtgcatgcctgtagtcccagctactcaggaggctgaggcaggagaatggcgtgaacccgagaggcagaggttgcagtgagccgagatcacgccactgcactccagcctgggcaactgagcgagactccgtctccaaaaaaaaaaaaagacaatgtaaaatcccatgtgattactgtctcaactaaggcacagataatcgtggtatttattcattaaacaaatattttgggaacacctaccatgggtcaggcactctgctaacatctagaacattgaatactgaataaaaaccatctcttgagcagaatctttcggatggtgtgacacactggggttccctgatgttggtggttgccacagaaataaacagaggacccagtcacataagatcggctcaaggacatttcaaacctttgaaagttcaaatgatcagattgtgtaaagccacattagtcacttcttaaaaactgggtatgatattgttagaattttttttaaataaagaagcatttgtacaccaactttacaaactaaagcagatctataaagaaaacttaaaagatcccacttatggccttcagaatgtccttaacctttttgtggagagtcacgtctgaataggtaaatgaacttatacattcgttggaagcatagattaagtcttctctacctatattgctactcatagcacctagcacagtgcctggtacatagtaaatatggaatgtcttttgaatgacacaatgaaaaaccatgttcatcactggtacgtaattaatcagcctctactttgcaaaaacacattaaaatttttttttacaatacttaattctttcccatctccgaatgataaaaagtaaatattaccctcgattcctatatgaagtggcagatctttttgagctggcagagctgtggagatcgagatctgcttatgttaaagattttaaaatggtgtggaataaagcaggaaaacatttctaattggttagaaaaataaaataggccggacgctgtggttcacttatgtaagtcccagcactatgggaggccgaggtggggggatcacctaaggtcaggagttcaagaccagcctggccaacatggtgaaaccccatctctactaaaagtacaaaaattagctgggcatagtggcacgcacctgtagtcccagctacttgggagtctgagacaggagaattcctcgaatccagaaggtggaggttgcagtgagctgagattgtgccattgcactccatcctggatgacagagcgagactccgtcaaagacagaaaggaaggaaggaaggaaggaaggaaggaaggaaggaaggaaggaaggaaggaaggaaggaaggaaggaaaaaataaagtagtttccaaatgacaagccttgaactggaattaaaataaacaaaaataaaacttctacagttaggtttgagaaaccaactgctgatctacaggaaagaaaaagaacaaactttatagtagctctagtcaaaaagtggctggggctcttacactggagggcaaattaggaccaaaagatgaagcttataggatggcatcttttgaggcctaattcaagaattaattttttagcactaacatgaattgtcccaacaatgagattggctttttgccttaggtggtaacgaacttctcattattacaggaattcaaaaagaggttagataaacaggtttgagtacaggagatttgtatgttaggtgggacactgtattagctggcttctgaagtccttccttaaattctgtgaatctgtagtaccatatttataatattctaatctgcctgtttcatcttctaagcaagtttataaatttcataagttaaaaagtgactataattcatgtactccctcctgttgctatgaactgatgaaagggaaagctagaccatggtttttaaaccttgacactattgacattttaggctgaaaaactctgttgtggggggatgtcttgtacatactgtgggatatttagtagtagccctggcttctatccactagatcccagtagcaaccccccacttgtgacaaccaaaagtgtctacagacattgctaaatgtcctctggggttacaatcaccccagttgagaatcactgagagagactattcagtgaaaagtataatatagagcttctcaaacttgagctacacctggagatttcttgagggaagctataatatttcttgggtgcctctaatgttgacttaaattgcttttaatgaattacttatgctatcaagcaattatagcataagctatattatattataatagctatattatattgtgtatcatcttttatacactgaaaaatttctatacacaaaggaacaaacacaaatttacaaaattacatacaaacaaaactacaaaaccaataaaataatgaagtatattagattgtatggttttgttgcccaaaatgttaccaaactcaggttcttttgagtttggtatcactagaccatgtgtcatatgaggcctcaattctccactgcttttctctcttcgaagaattgattcaaccaaacctttgttcatccagagctccatttggccatccctgagctgggtacatctcaggcatatgaagtttgcctttgccattttgtcaaagctttttttttttttttttttttttgagacagagtcttgctctgttgcccaggctggagggcaatggcatgatctccactcactgcaacctctgcctcctgggttcaagtgattctcctgcctcagcctccccgagtagctgggcttacaggcgccctccactatgcccagctaatttttgtatttttagtagagatggagtttcaccatgttggccaggctggtctcaaatccctgacctcaggtgatccacccacctcagcctcccaaagtgctgggattacaggcatgagccactgtgcctggcctgtcatagttcttgacaaacaagtcatatttcttgctgctaatgggcacaaacaaaactgagggtgattagtttgaatatcagtataagatgatcatagatatgatccagagaatgctattattagttttttaaagactggcataaaataaaaatgtaaaaaataaatttaatatgtgtaaaggccttagaaaaaagtgtggcacatagtcaaaactcaatagatgtctattgttattattgttatggtcctagaattgatttacatatcgtgtaatggcaatgtgagtgttttctgcttatattgataaatattgatgctcaaatcatcgtgagttgtttaacaagatttatttgacatagattcagattacctaaagccacttcaacttgtctgtgtagaccagtgctactcaaagcatagtacctggaccagcagtatcagtatcactagagaatttatagaatgtggggttttaccccagacttactgaatcagaatttctgggaaaggggcccaagaatctgtgatttaaccagcactacatgctaaagtttgagaatactggcgtaaaaatcatatccaaaatcttcctaaggccactcatctggccaagcatcttggttttgtgttgtgagtgtgaaacccacaggatgggaaaagagaataggaggaatgctactctccatgaggtcatcaaaagcacaattcagtagaataaaatgtagacttgaaacctggactggaaagacacaaagcctaatctaagtcatgtttcctgctgggagagaaagaagcagaaaagaacacgcataatttattcggaaaatctgattcaaaagaaaaattccaatatacatacttttgaacctacaaatttcagtgctgatgacatgctaattctttttttttttctgaaacggattcttgctctgtcacccaggctggagtgcagtggcgcgatctcagctcacaaactccgcctcccgggttcacgccattctcctgcctcagcctcccgagtagctgggactacaggcacctgccaccacgcccggctaattttttgtatttttagtagagacagggtttcaccatgttagccagaatgatctccatctcctgacctcgtgatccgcccgcctcggcctcccaaagttctgggattacaggcgtgagccaccgtgcccggccgatgacatgctaattcttatggtaggcattttggaaacattctctctgatctttacagcaactatggaaagtaggaattattgtgtctattttaaaatgaggaataagcatatcatttccaaaacaagctaagatatagagatgccagtgctaatagcttgtgtgatgtgtttactatactttagtaatacacttattaattctcatatcttatgtccattttattttattttcttaaatttatgattgacataataattgtacatgtttatggggtacaacatgttttcatacatgtataattgtgtaatgatcaaatcagggtaattagcacatctaacagcttaatttatcatttcttcattatgagaatattaaaaaacctctcttctagttattttgaaatacacagtacattattattaactctagtcatgctgctatgcaatagaacatcagacatattccttctatctaactgtattcttggacccgttgactaatttcactgtccccttctccccccatcctcctcatcctctcataactaccattctactctctatttccatgagaacaacgttttagattctacatataagtgagatcatatggtatttgtctttctgtgcttggcttatttcatttcatgtaatatcctccgggctcatccatgttatcacaaatggcaggatttcattcttttttatggctgaatagtattccattatgtatacataccacattttcttgatccagtcatccattgatgaacgcttaggttgatcccctatcttggccattgtgaataatgctgcaataaacataggagtgcagatatctctttgacatactgatttcatttcctgtggagatataccctgtggtgggattcctggattatatagtagttacatttttaattttgtgaggaaacatcatactgttttccattatgactacacaaatttacactcccaccagcagtaagggttgacttttctctacatccttgccaaaacttgttatcttttgatttattgatagtcattctaaatggagtgaggtgatatctcattgtagttttgcattttcctgatgattagtggtgttgagtgccttatgcccattttatggaagtggaagctgaagcataagttgttaatctatttacccaagttttcatagctaataagagcttcaaaactatagcttataatctaactccagagcctgtatgattgaccactaggctatgatgccttttattggttgtccactaagtgattgttctgctcttcagttgtttgctcaagggtaatattgactaattcaatggcgagaggaagaaaacgaagcagtccgtttagctgttaaagaatcagtagtgtctaagccaagggaatgaatccctaaagtcactaaccttggatagcttacctccttagaagagaatttttctttctgtcttgtgaactgtgcttatgaccaagtgaaacttggtccacctgcgaagagttctggggcatggcagggtaaatagagtgagaccagtgggccaaggacaaccctggaaaacacttaccttaaaggtggtcaggggaagagaagcccacaaaggatatagaatagaagtaatcaagatagaagtctacaaggaagtgcaggatcacagaaggcaaggagatggagaaagtagtcagaagagagccaacctttggggaggtttaggaaggagaagctggatttggacataaatatatttttaagagcagagaaagacaaaatttttccattgattttgatttgagacgttgcccccatggtgtcaggaaaaggacaagcatgcaagggagaggatgggttggaaccaggcagggcccatgttctatgccagggattggcacatttttttctgtaaacatccagacaataacaagttgaggcttcacaccacagcagcctctgttgcaactaatcaactctgctactggagtgcaaaggcagccacatagaaaatgagcatagctatatttcagtaagctatacttacaaaaataggcaggaaaaaaaatgacagtgggctggctgcagtttgctgaacactgttcttgaccaatgacttttttttttttttttttttttgagatggactctcgctctgtcacccaggctggagcgcagtggcaatcttggcccacagcaacctccacctgggttcaagtgattctcctgcctcagcctcccaagtagctgggattacaggcaccagccaccatgcccagctaatttttgtatttttagtagagacggggtttcaccatgttggctagggtggttttgaagtcctgacctcaagtgatccacccgtctcagccttccaaagtgctgcggttgcaggcatgagccaccgtgcctggccttgacccatgactcttaagggttggtgtacgaattaactggaagctgtgtagtgaatgagcacaagattcaactcacagcccctatgtgagagaaatgtaactttattttttaaaattggatttaattcagtctagagctcggtggaaactttatttcattttattcagtatcattccattcacccccgccaaaattcttctggcggtttatctaagtaccaggattaagggagggttgtggagggattgggcactggggagtggggctctggccccacagctgtggggctgggtggggcttggtgccacagctgttgacacagtctgagatctgttggagtgctgttgtatttggtcttcagtcaccagtgggaaaggtctctgtgacaccatcctggggtactgagcacactcttccatcacgtctggccctggctgtctccttcattcagctcaggtgggtgggttctgatgttgcatcagtgctgtgttgggatgcctggcttcccagagaaaccatgctgccatttcatctgctctatgccatgctgggtgcagagaaccctgggggtttctccagttctacccaggaaagggcataagaatcctcgtcttccaggatcccaaatgacgtggagtttctataatctctcaatccacctatcctaggattctgtctggggatagggagttgggagggacagagctcaggaccttctcaggtacctaacatgtcttagctctttgacttcccctttagttgtctgcttcctcccgacttgaataagttttatctggtcttcaggattgggggcttaagctctggcgtctgaaaagccaaaaacaggctcctttatcttccttatgtgttctcctgtgaaaacaaatgaaaattatcctaccttagtgaatggaggaatgaggaagggctgtgaggaaaaccagaggagaaggacagaatagagtggaatgcatatcagaggaccaatgcctcatgcctgcaggtcttgtgagagctgctcagccaacctggtttccccgctgaccccgcagcccacttcccccatgcacatctcttgatatctgcactcagcagatgcaaagcgaattatactctgtaactttccatcaaagggagcacgggctttgcgggctgacaagctcacattgaatctaggctctgcacttcttggctgaataaacaagttacttaatatttactggttagagttcagcaaaataaaacagaaaccaacaattcaagcagaaaagaattaatacagaagttggaagagtcagagtaacaggatctatgctaagtttctgggagatgctcagagccacactgcagaactggcccgccggttgcttttctgccaaaatcaagaagatggggactcaggaagccacctcaggactgttggctccaggaagacaccacctcagctgccatctagggatcaggaagttgccttcactggcaatcactaactccagagacggggcttgcctgccaaatctgcacctgcaaacaatgaataccctgtcccctgcctttcaataccctcaaagctagtgactggaagccagagtgctgccacagcaaaactccacaatcccgcttaccagtagaaacaacggaagaacagcttgcttctcctttccaaaagtcttacaagggcatctctatgggagagcttaaatcatatccaccatgttagctgcgaaggaagtctgggcaaggttatgttctactttcctgcctctctggtaataggatgtgcactagactagaagggaggtgcagaagatataaagctagcgaattcttaagaccgtgcaatatttattcctctgagcctcagatctgcaaaatagggatattatctattttgtgggacatttgtgtggattgtacaagatttatattacattatattatatattagaatttaccagctctcttgctttagtatttcactgaagatttgtcagtcctgtgatacttaaaacaaacaaagaaaacacaagagaatttaaaaaaaaaaagcaaccttagaaacaaaacaaagatcagggttaaatttcctcattacattggtctctttttctggttccactaaaaatattttaatttgtctcagtgttttatttgtcataagtatttatagcatcaatgagagaaatgatggttttcaatttttgtaagtaataacttgggaacacaagcatcacgcagaatgacaatgactgccactttctcaggactagattaaatcaagagctttcttttgccctcagttatcagtgcagcatatggaaatgtgctaatgtctgaatgaattttgattcaaacctcaaacctcaaccaacaaaactgatcagcatctaactgaaaatttcaaatggctgcatttccaaataggtcagtgtctgtcacatttgtttcaatgccaagagagtcttcacacatccgagaatggtagaattcctaaaagatgctgtctgagtaaatgagtgaccctactgcctttctgaatatatttttgtgtaggattgtgaaccagcattagacttaggtctgaagttttaaaaaagcttccaaaagtattgaaactattccagtatagaatagatgtagtgtttccaaaggatcctttgtttatggacatttgtgaaagctgaggagtgctgacctatatataaacttattgacatcctatttaagatcaagcaaggtctgattttatacaatttaataatgatcctaatgaattctagaggtcaaattatcttggagtatgatgcaagatggggttccaaactatttcactgcattggaacccttttgtagtaagtgttatgaaaatcgtgggaagagtaggaccctgaaggcaaacaacatgctttccaatcccagctgattctcttcccaggtgtcctaaattacttaacctttctgatctttagactccccacctgtaagataaggacaacaatgaagatgagataaagatgaggagatgatgatgatgatggtgatgatgataatggtgatggtgatggtgatggtggtggtgataatgatgatgatggtgatggtgatgatgatggtaattatggtaatgttggtgatgtgatgatgatgatagtaataatcatgttgatagataatctatatcaagtgattactatgtgcaggcactgttctgggaggctttatatgtactaatttgtttaatcttcaggacagtcttttgaagcaggtatctgtagattgtcatgaggattaaataaattgatacctgtaaagtacttaacagagttcttcccaatggaaaatcctcaatcattgcctgctattattactattatcattgggttgttgtgaatttaaaaaaatgggatattatttttaaaatatctagctctgtacctggcactctttttaaaaagtttttttttttttagatttcaatagcttttgggggtacagtcgtacaaatggttttttgttacatgaatgacttgtatagtgatgaattctgagattttgttgtacctgtcaccagagtgtatacattttatccaatatgtagttttttatcccacacttttctcccctcctcccttttgagtctctgaagtctattatacactctgtatacctttgcttactgatagcttaggtcccacttgtaagtgggaacacatggcatttggttttccattcctgagttacttcacttagaataatggccttctgctctacccaagttgctgcaaaagacattatttcattcctttttatggctgaatggtattccatggtgtatatataccacagtttctttatccactcattggttgatgggcacttagattggttctatatctttgcaattgtgaattgggttgcaataaacatacatatgcatgtgtctttttatctaattactttttttcctttgggtagacactcactagtgggattgctggatcgaatggtagatctactttcagttctttaagaaatctccataacgttttccatagaggttgtactaatttacattctcaccaacagtgaaaagcattcccctttcactacatccacaccaaaatctattattttttgactttttaaaaatgggcattcttgcaggagtaaggtagtatctcattgtcattttaatttgcatttccccaatgattagtgatactgaacatgttttcatgtgttttttggccatttgtatgtgttcttttgagaaatgtctattcatgtcatttgtccactttttgatgagattacttgatttttcccttgctgatttattgagtttcttatagattctggatactagtactttgtcagatgcatagtttgcaaatattttatcccattctgtgggttgtctgttcactctgatgattatttattttgctgtgtagaatctttttagtttaatcaggtcccatttatttatttgtttgtttttgttgcatttgtttttggggttttagtcttgatgtacctggcactcttacatgctcagtaatcattagatgtgattttgttggtgaattcttatttgttattcctctgttcattcaacctccccagtctgggtcatacactgttttcaaaactctccctcttcctattagttaacccaattctttattcagcaaatattattaagtaccagtttgtatgccggagtctattctaagcataggagatgccttggtgagcaaaccagaccaaattcttgccttcatagtcaccattctaaagcaaaagcagaaaaatagtctacataactcagctaaaatagacaaaaagagaaaacagtcaagcaaacaaaaagattaagaaatataaaatcagtaaaagagtatcgaaaagaatacgtagaaaaatgcaatggtaataaaatgatttccagggaatatgaactgacatttcacataaacatataggtgatgaggcaagacaaactaagatgataaaaactaaatttaaacaagaaaaaatgtttaaagcaaacatataagcaatatgtataagtagtggttaaaagaaacgtcttaaagcataaattactaaatgagaaaagttataaatctacactcaagaaaaaaatggaaataggcatttaagcagcagtttggaggtgaaaggtttaaccccacagagcaaacgaattcacttgggctcaggtagctacgagcagcatcaggcacctcccagtgctggaattcacctattagaaacccagaacacccctaggaacctcagggaagatgctggggaccaggtgccggtcactgtgggccactagcttctgggggtttgcctacctggcactttaaatggtcactgaaggtatccaaagccaaactccagcacagcttggctgtcctcatcataacccctgtcctcatcctctcagcagaaacccagtaggtctgatggtgtcagtgggtttttgctttctactcctttagcctccttcatcacttaataagcattttgtcaaagaaatgagtgcatgtgattccaaagtcaaatggtaagaagggcatatcattagaaaaaagccccactcctaccctcttcaactgctcctagaggcaacccctaagaaccacttcagttttctttgctttttgtattttattgtttctttctttgttgtgtggatagtctttatttatttctgtagtaccatcttccctcccaacaaacatggaagaaaaaaagaaggggctggtgggaagaaatgccctgggggacacacctctccaatctctgcagttttgaagagggagtgttgaggtggaagtcttggggatatggggaagatggccagcccctcctcttgtctcccaggtggctcttggcagccttttaaagcttaaactcatcagttattttggagacgatgcttttaaaagacttggaagtctgggatatatgcttaaatggaaacttcttgagatatctccaaagcaattttcacacctccatcttccactgtactgagttctcttggtcccactgtggctgcatgcacagcagcatgcagttcttgtacagtctctggagtctgaaggagttccattttgtcttatcaatgatctgcacagctacctctttcctagttagggtgtgtcaggccaactgcatggtgaccaagttaccctggttgatggtcgtgatgagccagtagttgccaatatgggtatcctcagcagagatgcctgagaggtcctgcagtacgttggagatagggcttggagtcaaggtgtcccgaggtaggcttaaatttgggaaaagctgattaaaagcttggtccaaatcatgtcaaaagaatataacttccaaaatccacctgatgacctaatctttataatgaaatcaaaacacaatgccagagaaaaataaaaataaacaaaaacaaatgctaacacactaaatttaaaaagaaaaatgagaaaaaattcttacaaagtctttgtatagttttggtattagggtaatgctggcctcataaaataagttagaaagtgttccctctgcttctattttctggaaaagattgtacagaattggtatcatttcttctttaaatgcttgacagaataaaccagtgagaccatctgggcctgttgctttctgttttaggttattcattattgattcaatttctttaatagtataggcctattttgatgaccaatttctccttgttgagttttggtagggtatgtctttccaggaatttcatctaagttagcaaattagcaggcttggagttgttcatatttctttatttttcttttaatgtccatgggattagtaacgatgggcctctccttcatttctgatattggtaatttgtgtcttctctctctcttttttcttggttagccttgctgggcttggttagcctagccttattaattttatagatctattttattgactctattaatttttattgatctatttaaagaaccagcttttggtttcactggtttttctctatcattttcttactttcaatttcattgatctctgctctaattttaagtattttttttttttgcttattttggatttaatttgttcttttctagtttcctaaagtggaagcttagattattgattttagatcttaatcaatatatgcattttaatgctataaatttctctgtaaacactgcttttgtcacatcccataaattttgataaattgtattttcatttccctttagttcattttcacttagttctttaagtagtcacctctatgtcttctatttgcattatgtgtaaccttttagaaacctttgtgatgtaagatatgttatattcctatatttctctaaatcaaagttaatctcttctaagctcacaactctcccggctgatgtgaaattcatctggtctatgtttgagaatactccttcctccaggatcgtgcgcaaacctcaggatcatgttcaactttgaattggtcccttcaaagtgaacaactcagccacagtccagcatggacatcttaccccagggttttcaaggccatggttcttagtatcttcctgtccttgtctcagagctacatcattagagatctgtcactcctctagaagctctttattagtgctggttcaatactcacagaacctcccagactcatcccattcccaattctacaagcattgcccttcacctccaacacctttgagatgatgcaatataaccgtttcaaagagaggtcgaaaacaaaaatcctatgtgagagttatctttatttagagacagaaaaattgcagcttttgtcccagcaagtgaacaagagtttccgccctcttgggatggaaaagaaaatgaaaaagcaatagaagcaagaaaaaagcacacataaataccttgatcagttatcctttcatcttaatgctcctacaattattgcaaaacaatcatttatgaactcaaactggggacggtaacaaatttgttatgggctgggcacttgccatgctgtgtaaaacctgggtagattcatgtctcaagataatttttaaaaatgtaaacttcctactaaaaggacagcataaggcagtggttaagagcacagagtcaggtgggcacagtggctcatgcctgtaatcccaacagtttgggaggttgaggcaggaggattgcttgagcccaggagtgagagacctgcctggacaacatagctagactcagtctctataaaaaattaaaaattattaatagctgggcatggtggggtacacccatagtcccagctactcaggaggctgaggtgagaggatcgcttgagcccaggagtttgaggttgcagtgagctatgattgcaccatgcaatccaccctgggcgacagagcaagaccttgtctaaaaaaataggaaataaaaagagtgtagggtgtgagcttatcaaggttcacatctaaactctaccatttgctctctgcaggaccttgagcaaattaacttctttgtaactcagtctcctctttggtaagaaagagataatagtatgtgatgttccccttcctgtgtgcatgtgttctcattgttcaattcccacctatgagtgagaacatatggtgtttggttttttgtccttgcgatcgtttgctgagaatgatggtttccagcttcatccatgtccctacaaaggacatgaactcatcattttttatggctgtatattatccctaaaacttaaagtataataataaaaaaaaagaaagagataatagtagtatctgcctcattggattgttatgaataggaaatgaattgccatttaccattttagaacagtgcctggcacaaaataagtgctgtataagcggagacagacctagaagctgtctctatttaggtcatcttgaatggaaggatctctagttactcacctctgtgtgtttgctgctattttaaaagcctgtagacccttaaagttttacaacatcaaccaatattttattgattgcaaagtaatgggtggcctactaccagtggctatcagtatcagtcactggagtctggcacgtgcatgtgtatgtacacatatatgtgtatgacttgagaatagggtgtggtatgtggcttctaccagtataaagaagcatgagaagtgcctgaactcaggaagcagaggttgcagtgagctgagatcacgccactgcacttcagcctgggcaacagagtgaggctccatctgggaaagaaaaaaaaaaaagaggcagaaaagcagtgtgcaatattctgcagaatcgaggaatccatgtaaaagtaccatcctatagctattttcttgctaccccagggatcccattggtgctacacattccccagatggcaatgccaaccctgtctacttatcctgtattaccagcaaggctctgttcctcagtgaatttcctttccattcattttcaaatgacttttctgatatgagcattgttgaatatgcacaagaaagaggcagaggtatgtgtatggatagatttgcataagtataaatacagtatatgtacccatatttaaatgatataatgataatattgtgttgctattcagagtgaaagctaattaattcagctattgagatgataatgatttctttttcagttaataccagagtcaaaaaaccctgcagaatggttctacgcactgttcctttgactcatcttggaagaaagacctttattctgttaactattaagctgtctatcagtatctatgacagttttaaaggaaatcattcctgggaggggtagaagattattagtaggaaggctgactcatgtaggctcaagtggacattgaggtcatgatttggtaccaggaaagaaaaagtcctctttttgcttttagtctcttaaaatgcatgctttggtatttgcactctcaatatcaacactgatctgcagcacaaagtctttttttagactttatttggttggatttgacatttagaaaaatgttaagatctttcctactgaaatttacaccagctgaaaaattcacaagcaagtccatgactttcttaaccttgacatctctaacttttccttcagcctctgttttcatatttcatgagttaccaaaacctgatgttctctctgtttcctcctttctcttctgtcccactttagttcaggcattggtagcctctcagttgtattatggcaatagtctcctctctctagtctccaatacgcgttccacctttaccttgctccgaggagcttcccaacatacaggttaggtcatactgtcccctgtcaaagcctttaatggcttccctctttcaacatggtaaagactcaactcctttgcttggcattcaaggacacttaatcacattctgttcctgttacaactgcttacccatctcccactaattctctccatactctacccaaccgccaccaagatggagtatctaccctttcttggaattttcataacaccctgtgtttgctcatttttccgaatgtctttcctccctcatggtccatgtttctaaaaccttacttattcttcaaagcccagatcaaattctatttccttcatggacccctccctgattctggctactcttaattaatcaggttcactcccagtctatacaatgccttttcttcggggcgcttgacttctagcagttgggaaatcctcatattatacttatcttgctagaacaatttttaagtgccttctgctggaaaattgtcataagaaatatgcagctctacatgggtgcagtgtaattgctgcctctcctccttaaatgtggcacaatctttacaagcatatggtgtggacctgcttctacatttcaataatttattccttgtttagctatctcatcactcatattttatattatgctgtaaatttacttctgtttattccaactaagtatgcaactctgaagacaaggaatgtcttattcatcttggtatttcccaggtcagagaatgcagctttcagatagttggtacttaacagtaaactattttactctcttgtaacccaagggtggcaattgcaagatagtaaagagtacaggctttagtgcatgactgcctgggtttgaaccttcctagccaactactaaccatgtgatcatggccaagatacttaaactctctgtacctttttttcttcatctataatatggggacaaataatactatcttcatcataaaattgatataagaattacatcagtaaatggaggtaaagtagctcaaacaatagctactaggtgcttaataaatgttagatattattccaacagtctgttaaaataggaaggactcctctcaattttgacagagacatgaagacactagatgctacattccaaggtgagcccatctggcagaaatttcacagtggatattcaagaaccagttaaacatctcacttattttgagggaatgaagagatcaggagttggaaattatagagaggtcttataaagattttggagcatgtgactagtgtgctgtgtgaatcttacatccctactgcaaaggagaatgttggaaatgggagtgtctgtccctcgggccaccactggaacgtgtagtaactttgtgagaattggaaaatggtgtcccctcatgcccccaaaatgtatactaaagaggtcctgttgccccaagcccaatgaaagagtcttcaagacgatcacttgagtaggttgacatgtatcccctgaagctgacagacatggggactttgtgtctcactttcacccgagaagttgaaaggcaggaagccgggtggctgactgctcatggataaatgggagagatttctctgctccacagagattgttagatcagagaaagccattatggggttatcttaggtccatgtgaagagaaccacatagagtgacctcagtgtaaaaattgtggagtgaatcgccagattcctagatgttgaaggagacacataccatgggctagaatagatatgtatttgccctcatcaaaaaagttcagatgaggctgggcgtggtggctcatgcctgtaatcccagcactttgggaggctgaggcgggcagatcacttaaggtcaggagtttgagaccagcctggccaacatggtgaaaccccatctctactaaaaatacaaaaattagtcggccgcggtgggcggcgcctgtcatcctagctgctccagagggtgaggcaggagaatccattgaacctgggaggcagagactgcatgagctgagattgtgccactgcactccagcctgggcgacagaacaagactctgtctcaaaaaaacaaaaaacaaagttcagatgaaagtatcccgaagatgagaggtctctaaacaacccaacccaatggagaaagagacaactttgaaaacttgctatgcacaaaccagcttacagaaatactaggcgagtaactgccttcctgtcatttcttctcttacctctcacaatcctctcctgaattcaacactgcctccttgactctgaaagtgtcaggaactgtggttagtcagatggaggagaaagcagaaagtggggaaatggagcagcagagttgaagtcggttacctcccttcttcactctaggcatcttacctgttaacaggctgcagctgtgctataccttctcgggggagatggttgcttttagctcaaggttggcatttttattattatgccaggctggcatataaagtactgaattgaaaccttgaatgcgattttctccctgaatgcctggttaacagcaactcactttccaaaacttagctcagtgctcactccctatcctgacctcttcatcccaaactgaggaatctgtgtgtctgctctgccgcagtgcagcttttagagcccaggcaacatgtaatttcacttgtttagttgtttgtgcgtctttgtcctcagccagcctttaaactcttggagcccaggggtgaattgtttgcctttgtaccctctgcacttagtgctcactggcatagaattgtcccccaataaagatctatgaaagtaatttgtcttagaaaacaaattcacatttttcctaagagaggctataattcaaatttgtctttatttctgagagataaattaaaaacaacaggcttctcaacaacacaatgtcacataaagtatttgtcactggtgtgctcaaggatggcctgggtgctctccagcagttggtgagaaaatgtcctggcatctctcaatccaaacctgtttttttcctgagaagctgtgagaggactttttacacttttcagtgtttctcccacaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgtatacaggtattcacttcaagcaattacatttcactaaaaatctcttaaggaggcagatgtcaggtaactcatcacgagagtgctacttcacatattaaagaaggaacctactaagccatctaagttcttgaaaagggtaatgaaccactgaaattgtccaaactgtcaactaaagagcattttagtcacccgaaagaaatgggttttttttgttgtttttctttgtcgcagtgaactatacatggagcccagtggcattaacataccattcaaataatgtgctttaatgagctacgaatgacatctaaaagtttcctctaaatttgattttaatatacttattatttattgcttaattagcatacaaattcactattgtggaaaaaaatgagaatgctttataaggtataactgcctctgaattgtctaaatagagttctaaaccaagtcattttattaaggatctgtcttctcttagtgcagctttgaaccaatttgtataggtttacacaggaaattaactactcccagttttaatataattttgtctttctatctgataaagagacactgtattaactgctggctttgtgaggaactgtaatcttcatcaaaaattggaatgcatgctagtatataacataattaatttttcattctgcaaattctacagaccactcagattctgagatatgtcctgtttctcctcaaaacacaaatagacaaatgtcaccaaggggatgacagcattcaggcagggaatgccaaatgaaataaaagccttcagaaggtgactccagttctattgttaccaaactgtacgggcaactgggatggacccagggaaataatgcatgcaggttgggggaaaataggtctgtgtaaataatccagctctgggtggatgaaaattttatagtagctgatcacaatctcatcttagcatacatgaaatgagaacctgcaataggggctgctgctggaatccaatcttgcaatggaaacacttactctgacactgcacagctcatatagctcatcacttaaatatgaacttgttccagctggagcgctgaggacattttgcatgaagccacatatagcagtctataatatttatgaacacaaactcatccagtaacagatgcggatatttcatggttctataaaataaattccctgtacaaagaaattcctggaactttgttttattggcattgagaaaagagtaaggacgttaaatgggatgaagggaagattgttttacattatttttaatagctctcttttttttttttttgttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccactgcgcccggctaattttttgtatttttagtagagacggggtttcaccttgttagccaggatggtctcgatctcctgacctcatccacccgcctcggcctcccaaagtgctgggattacaggcgtgagccaccgcgcccggccttaatagctctctttaagtgtaaatcaatgaggttgattgtatgatcattcaaagacattttaaaagtcaccttgtattatttttatttttaactgtattctcaggaattggcactgttcttaaaattaacaggattttaaaaatttccctaaaggatgttaacatttgtttttctcaataagtttatatgtatttaatgtgaaattcaatatccttcttctggtacagtatgtaaacatggatgaaaataatattaatggcatgttttaaaacaccaattttcacagtcccctagagcaggaacagggagagtgtcattcaccttttcattgactgaatcccttgcatttgtacaatgctttcatatcacaagttctttatataaagctcatttaaaaatgattattgcttttattttgtgtagattattgcttttaatctacacaaaactctatgaggtagatattattcccattttacaaatgaggaaactgagactcacagaggttaaactacttgttcaaggttaagtctcaaaccttggccttccctttctaaaatgcataaaaggctagcgttagttctgtgccattgcataggggatcttctgggccaggtacatatcagtggttttatgaccacacacccaacagtactttctgtgattggtgaagtctctatgcttatttgttttaggcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggtaataatatgcaatggtgtctgccaagactggcaggaactgagtttctaggtacatagtgagctggccaggaggctttcaaattaaagccacaggcacagctgaatttctagtccaattgttcattaaaatggattcctaatacatgctttgatgtaaacattcaaatagtagcaatgcataaactaaaaagtgaaagttttccttctctctgactccattccagtcctactacctagtgtttgccagcagaaatgatttggtgtataaaatggattttttccaactgagtattgatgaccattttttccctctttttgagaagacagtctcaaactgggaagaacatggtctcaatagaggctgtggattaatccttataaatgagtaaaacagggtgaatacacgtatgtggatgaatagagaaaagtcctacccactggggttacaaatttctcaagaaatccattgagcaacttaggacaaaataggggaacagcatccaaggtgtttagacacacacattgtgataatgcacaggacatttgatggaattttattttgccattagctgaaaaaccagtaagctatgattgtccaaaccacacccttctcaatatttattacattattgacaaagaaaactttatccacatttagttttacaaatacgtatttttgtatttatttaagaaaaagtattttatatgaaagcattattttgccatagtgcttcatcagtaacactttggtataagaaaacaaagagttgacataattattcacactcttcaaaagatgctgtagagggagaaagagatgtttggggtctgaattgtccagattgttgactctctattttaggggttgacaaactttttttctttaaagggctttggccacatggtatctacaacagctactcaactctgccattttagtgcaaaagtagcagagacaatacataaacaaatgagtgtgactgtgttccaataaaactttataaaatccaatggatttggtccatgggccacagtttgttgatccctcctccacatgaatactctcagatgacttcaccaggtggaattcatgtagaatagtatatgaatatagtattcatagtagtcatactatatgaaaacctttcattagttataattaaagcttgaactttcagtgaccttcaatatgaatgggctcaatagtcttcatatccagactaccatttattcctaagaaatacacaagtggaatattttgttattcatattttatagataggaaaattcagtgaaatgtgatatggcctgcctgaggacccagagaaagaaattatacactctcttagaactcatagttcctgctgtatttatgcctttttttttttatgatttctgctattaggtccctccagatgaatgcacatatagaaagaaggctttatacacatcttccctaacaccttttattttcttgccagtgtaggagaaaactgaactcaccccagatcaacagactcttctacattttattatggattcatataacaaacagaggatgcctcaggaaataacaaataaaattgtatgtataatatctgaaaatatgtgggtttaaagttaatattttctggagtttttattgccttggaggtataatttatatgtgaatatgttactttgaaatgattagagctgagaattcaagttagacttttaaactctcagcaacattaaacaattcaagagtatgaagtctcccacctatcttgataatggtaattgccctccaaagatctgagaaatagtaagatgggttttcaaattttatcatctaaacctagtttttctttagtctaatggttttatattatcattttcttatctactttttaatcattggtttttttcttaaaatttagttaaaagaagaattcagtgcagaagaaaattttctcattttgacggaaatggcaaccaatcatgtacaggttcttgtagaattcacaaaaaagctaccaggtattttttaaataatcaaagttaatatttattgagagtttaaatatgtgcccacagattagattacctattttacatacggtgttttaattttcaaaacattcctgtgagatcagctctattttcactattactttgccaagtattttcacatgtacttatttcactgctattctctacaatagtcttgtgacattgagaaaggcaggtctgttctttgtaaaatgaaaatcatttaatatctgatttaaagtaactgtcgaactactatagacataagatattagaactagaaaggatatttaaaataatgtataataattctttcaaatcaatagattaaaaattgaaactttgcaaagttgtcattcacccatttattccttcaataagcaattgttgatacctactctatactaagtgcctggctattaccttcagggagagtgatcaaaggtgataataataatgataaatacacatacatacacatacacacgaagtgctgtttgaacacagaggaactggttgctaattgtgtctaggaaagatggagagacttcagggaggatcatatttgagttgagtctaaaagaaaaagaagttttccagttggcatggagaagcagcagcattccaagttgagagatctgcttgtttttttgtttttgttttgttttgtttgagacggagtctcgctctgttgcccaggctggagtgcaatggcatgatcttggctcactgcaacctctgcttcccgagttcaagcaattctcctgcctcagtctcctgagtagctgggactacaggcacacaccaccatgcccagctaatttttgtatttttagtagagatggggtttcaccatattggacaggctgaattcaaactcctgacctcaagtgagctgcccgacttggccaaagtgctgggattacaggcgcaagccaccatgtctggccgagaaatctgcttgttataaggcactgaggcatgaacaagaataggattatttgagataggagagaaaattcagtgtggttatagtatagtgtctgtggtgggctcctaggttagacaataaggtaagttggtaccagactgatgaaggcctaactaaggaatttaatctgtgtaccctggacagtaaagagatttcggtggtttttgtagcagagggaaatgaagtttttgttatacagaaatgacttaatcaggttcatgtaagatgaatttgaatggaaagggtctgggggcagggaagatcaagtagtatgctactgcacaagtccaggcaacagggcttgaaataaagcaatagcagtggggaagagaagaagaaacaaaaagaagagagattcaaaaatcgatagggcttgaggaacagttgtatgtgtaaggtgagggagagggacttacttatccacactcattctgatggtgccagtatagaaactagaatgtgggagtcttcttatatcccagcctcaaattctttttgccacattattaatgctatctaagctaatgggttttagttgtttcagtgtttattaaaatattggtgtattgaaatcccgtagtctagaagagtataataaataccttgtatagcagcataatactataatattaaattatagaagataacttctgacataggattttagttaaacatgttaatttgccttctttttgccagcattatgctattattttattaaatgtgtcacagatagacataagcctacataaaactcataaagtgtgaggagaaatttctcactatcattgaaacactaatatgctctcatttctttattaacaatgaaagaggaacttaatttactatatgctaattaaactgaaggcaagctcaataaaaaactggattatataagagtaaaaactgtggaggaaagaactggaaaaaggagatatttttggttatttatgggaagagattttttaagttcaaatggtcagttggttttgaatcaagaaataattgaagacaaataaaaaccttattcataagaaggtagcttatctgaaagcaatagcaatatcttggcatctcttaattcccagtgcctagcctcgttcctgagggagcaagtacaattagtgtgtgttcaatgagtaaagcagaaggaaaaaatttaaaatatggaaagaaataaaaggcaaaaacccttgagaaggaaaaaaattgacaataatgacagagatagcattattacaagtagtaacaatagggatataataccagtactgaagggatattttgtgaaaaactgaattgaatcattccattcagtattcattgagcacaacctgtgccaggcactgtccaaggtgctggagtccctgagggcaataagacagggcccctttcctcaaagaagctcttagattctctcggatggtggctcaatttttagcgttgctctcttctctatactccctttgctatttagttcttcccaagccatttaggccctgatggtgttatctctattcatgtgagtgtatgtgccagcatgcacatgagcttgtgttttgtttcccattcattcattcaatctgtcaattatccaacaaataattcttaggtacctattatgtgccaggaactggggatacaaaagtaaagaaaaacaaggcctctgcccccaagaaatgtacactccagtagaggtggcagacaattaacaaataagcaaataaatctataatatcatgtcgggtggtgataagttctataaactaaaataaagcaggtagagactagtagtggtggggagtgtattttagattggggaatgctggagcagaggcttgattgcaggaaggagcagggcatggggcatggggttatctgggaagaacattaatctctgaggcaaaaagaggcttgtgtgttcacagcagggccaggtggtcagtgtggctggaacacaaagagtagagggaatgaggagtagaaaatgagttcagagaagctgttgggactgtactatttaagcctggataacaactttgaattttccagggagtgttatattccatcaggttggcaattcttaccatatttttctgattttcccccaccctgtgtgtcgcagtgctgagttcagagcagatacatcaacatgactttggttggctgtttttgggaaatactacccgttctttagcttgactaaagactcatgagttagccaaatattctgggtgcatataaagttttcttctggcttgtagatgcttccaatctgcagagttgaccctgtcacatcaggtgtgactaacataatggctcaaagaaaatctacctgtgtctagtttctgagggtttcttcatctgaatcagtgtatctatgccataatatatgtatctacttggacttgacatctccctttgcccagcttgtttaataaattctgctcaatgaagataaaagcctctattttattggcgagtacaaatggactcaactagactacccaattttaaacaactacagaatcacttgatgtaaatgttttatcaatggcaatgatggtgatcatgaaatattgttactccttgataccaatttgattatcatcattacctaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtaagtgatttggctaatggtaaaagagtttgtttctaggagtaaaattggtgtgcttcatgagggtggggctcttgccaatcttatgcaatgttatatgcctgttgtgcctagcatgaagaatggctctaaaaagatatgtgttaaattgataagacttctagaggcttggttcaaatatctctgttgtaataacaaagtagcaaaactacccctttactgcactaagatgaagagccaaaggaagacttttttaaagattggaaaattcatctgattttgaacaactagcacaaaggagctaggattcttcagccaagaaaaagattatttaaaatcttctggtatgtaagactaagtatccagctattatatatctgtatcaaaataaaataagaagacattttaatagcaacatttatatgtcatttactaggtctcagacacttttctttcttttttcttcctttcttttttttttttagacacagtcttgctctttgcccaggctggagtgtagtggtgtgatctcggctcactgcagcctctgtttcccaggttccagcaattcttgtgcctcagcctcccgagtagccaggattataggcatgtactaccacacccagctaattttggtatttttagtagagacagagtttctccatgtttcccgagctggtctcaaactcttggtctcaagcgatcagcctgacttggccttccaaagtgctgagattacaggtgtgagccaccgtgcctgactaaagttaactttttttttcttttctttttttttttttgagacagaatcttgctctgttgcttaggctagagtgcagtggcatgctcttggctcaccagtttcccctgggttcaagtgatttttttgtgcttcagcttcccaagtagctgggactacaggcgcatgccatcacacccagctaatttttgtatttttagtagagacagggtttcaccatgttggccaggctggtcttggactcctggcctcgagtgatccacctacctcggcctcccaaagtgctaggattaaaggcatgagccaccacacccagccggtttcagacacttttctaaatatatgatttcatctaatcttctcaaatattctatgaataaatactattatcattcccatttttcaaatggaaaagctgagacagagaaaggttaaataactttcccaatgacagagaggaagtctgacttcagaagctttgtgtcagcccaatgcagtggctcacgcctataatcccagaactttgggaggcagaggggggtggatcacttgaaatcaggagttcaagaccagcctggccaacatagtgaaactccgtctctactaaaaatacaaaaaattagctgggcatggtagtacgtgcctgtaatcccagttactcaggaagctgaggcaggagaattgcttgaacttgggagatggaggttgcagtgagtcaagatcgtgccaccacactccagcctgggcaacagagtgagactcagtctgaaaaaaaaagaagctttgtgtcttaaccactatgctatagtacctctcaagagacgagataatagcacaagttactcagtgtttaacttattgtggaataacactgtgacagggaagctcaagagacattgagatgaattaccaggaattctgtgcaatttatcttaggagatccttaagataggatgagttcttattttcccgagagatttcatatatgggttgggagtggggaatgaatgagatgacttctcaggatgttttctttctaaagtcttatcattaacaaaagcaaatttaaagacttttaaaaccgatattttaagatagagattagagggaaagttttcaggtagttctgcatctgtgatataagtgaaataattttttaaatggaaaattatttttaaaggcagtttctccatagtcattatgtttttttcctagttaaaaacaaaaagcataattagcatcattggtagatttaaaaaccacacactttaaaaagatgcattattcttaatatattaatttactagtctaacaaatatttaagggcaaggtactatggtagcagtgaagagagaaatcaagcatgttctttcccctaagaagcttacagtctaatgggaagagattaactgtccatgattatgataaaatatggaagagaaaaacagagagatgatgactcctagttgagagagctccgaaaaagttttattggcatttgagctgggacttgaatgagatttgatttggatatccagggtgcaagagagaaggaccagcaggagcaaagagaaagaggcaagaaagctcagggaatgcacacaaagaagggtgagtagctgagctgactgaattgagggttacattaaagggaaatagaaaggaataaaagaatcagatgattgagggccttggatgctgggctaatgattttgttatttcccaagtaataggagagatggaagatttttgagcagaggagggaaaatgtcaaaattaagctttacaaattttctagcagtgttagggtaagccagaacagaagtcacctcttaggaggcaagaagtctcaaagatgtcacgcttgctgccaggagaaatggagagaagagaaaggatctgggagatatatcttcgtggcttatcaacttttgaaagacattatgttgtcaagaaatatggattttggttctggacagattgtgtgtgtgtgtgtgtgtgtgtgtgtgtccaggctaaggggaaaatgttgaatcaggtaacctccaaggcaccattcagttctacaagtcttactgcttttcctctcttaaataattcaattttcctgatgggtggtttagctagtcactaggccagctactgaagtatcctgattttaaagccataatcaataattgacagttcaacttaggaaagaattaaaggacaggctgaattttcacatgtatgggtataattgttgttttagactattgaacatacactggtggttctctctttatgcagaaaactacaatggcttcaacaggttcagcagcttagctttgtcatttatttgattctggcttccatggactgtggcggtgctccctttaagaaaatcccagttggccgggtgcggtggctcacgcctctaatcccagcactttgggaggccaaggcgggtggattacaaggtcaggagatcgagaccatcctggctaacatggtgaaaccccgtctctactaaaaatacaaacaattagtcaggcgtggtggcgggtgcctgtagtcccagctactcgggaggctgaggcaggagaatggcgtgaacccaggaggtggagcttacagtgagccgagatcacgccactgtactccagcctgggggacagagtgagactcggtctcacaaaaaaaaaaaaaaaaaaaaatccatcagtcaaatctaattcttacaaaactaataaaataaaaaggaatgatgactcatgacaaaacttattcattttactgacaggtctctactctagggaatgtgtgtttggtttattcatcaagagacagtggtgattaaggatactgactgtggaatctggattgaatatgggccccactacttattagctacatgtcccatttttttaaagctgttgaaatagacttcataaccaatttgatctctttgaaatcatgtttaactttaatatttattctgcagtcttgcctcaagtttgataataaaatcttgataagacagggttttcttctttttgagtcagtattttatcccaagcacctagcacatgcctggcttggactgggtgctccacaaaattctgtggaataacgaaaaaaatgaatgaaggtttgtccggagctataaaactggtctgtttatttacttttcagatggttgtttccctgaatatcagagttgttaatgtccaaagctaacaagtaaccaacaaaaagttggttaaacattcttctagacattgcctgtagtagttaatttggggaacagatatcttttttgcatttgagtgtaagaaaaggaaaaagacagtttggatatggaagttctgttgtgttctctctcctcctcctcctcaaagatgagtcatttaaagttgattcaggtgccagacaatgaaaaagaggggtgcaatgtctgccatatgaattgaaatgttttgatgagagggcatctgcaggagaattatctggtggttgttctatctttctttctctgtctctttttctctcctggatgctcagcttcctttaaaaaaaaatctttgcctggctccatcagatctcctgggtcctgagccaagtcagatgctgccatttccatgatgaccactgggttagtaccagattccttccccagcctggctgaggtggggaaaatcccttccactgtggttcagctaaaaggggaaaaatagtcttccaaaaaagtttacaaggctactaagaggagaattatgtttatagaaaggcatatataaggctgagcatgctgactcacacctacaatcccagcactttgggaggccaaggcaggaagattgcttgagcccaggaatttgagaccagcctgagccacagagcgagactccatctttacaaaaaagttaaaaaaattagctgggcatggtggcatgagtctgtaatctcagctagttgagaggctgaggtgggagggtctctagagcccaggaggtggaggttgcagtgagctgagattgtgccactgtactccagcctgggtgacagagtgagaccttgtctcaaaaaaaaaaaaaaaaaaaaaaaaaaaaccaaacggggggcatatatgcgtaatgtctggatctattaattacggcaccagaaagataattattcagcacctactgtgtgtcaggctgtattatcagtgtttgtgtgagctttgggtcctacaagaagcagatatcaacatgggactaaatatgtcagaagttaattgggggaaatgcctctgaagaataaagggggaggaagcaggtggagtccaggagactgtacactactatgctgatctgacacctgtgaaagtggagcaggaaggcatgattgggcatgaagagcatcagatcacagcacagtcctgagaaagtctcagctaggccattggagagggacctagtccgagctgcccactgaatggacaagcactaacacacccactatgctcattcaccagttgagacaagactggtgaaagtgtgtcctcagcactcacagggcggcagctggaggctatcagccagccagactccctactgtgggctgtctttaagggtgatctgagtgggtcatctccatggctaacattttgcttcacgaaaaatattgtttgctctttgtagcactttgaggtagatattatcaattctatgccagacctagaccctgttaatcccaataacaaaatatcagtcccaagtatctgttccctctgatattactctctaactttccagcttgccaccttccagtaccctgactctagggattctttgttccaaatcaacgtccattgccgggcgcggtggctcatgcttgtaatcccagcactttgggaggctgaggcaggtggatcacgaggtcaggagtttgagaccagcttggccaacatagtgaaaccttgtctctattaaaaatataaaaaattagcctggcgtggtggcaggcacctgtaatcctagctactcaggaggctgaggcaggagaattgcctgaacccaggaggtggaggcagcagtaagccaagatcgtgccactgcactccagcctgggtgacagagtgagactctgtctcaaaaaacaaacaaacaaacaaacaaacaaaatcaaaaatccatttgttgaccctccatccactaaccctccagccattgactctacttccttttgcctgaccacactttcctcagtacttggcttagagttcgtggttcatcaatatgatcatttccttagatcattcaccagatatcctcaactctttgtctttctttcacctaagaaaaccctctgcctgactgagtacgactcttaacctactctgtgcttgagcctgagaactgaaacagtatgactggcttacccaaagttagtgatcaaacacttcaggtggacctcagtactttccatgtatcccttttctctagccaattcactcttatacttatggaaaattgtcttgtaccttctctttcttcaaatttccaacatctcttcccactcattctcaactataactttgttgagaaaaggtgtctttcaagaacatgccataggagttggagctcaaggatatgtggtcaaaccccagcttcaaggaaatgtaatcaagcttagagaaagatgaactccccgagcttagtcaatatgtcaagacagagattgtcacaagaaacaaagctggagccaagttcctagaattagatgcacacagagctccccagggttttctgagagttgacttcatccacatgatccactatggctccctaccattttggtaacattccagcaagtggggagggcaaaggggaaaaagagtggcacaccttccctttaaaggaataatcctgaagtggtatgcacaacttcacagagttccccagagttttctgagtctgggtcagaattgaaacctgttgaggcaagtggtgtggttctagccgtgaagacacaaaagcttccaaaaccaaagtcaggcagttacaccttggggctcccatgatttctggctgccacatattgctggagcctctctgtcacaaatcagctacctccaacagaagcaattgtcttattcctttgttttatttatttatttatttatttatttattttgagacagagtctcactctgtcgcccaggctggagtgcagtgaccgtgatctcggctcactgcaacctccgcctcctgggttcaagcgattctcctgcctcagcctcccaagtagctgggactaccggggcgtgcccccatgcttggctaattttttgtatttttagtagagacggggttttaccatgttagccaggatggtctcgatctcctgacctcatgattcgcccgccttggcctcccaaagtgctgggattacaggcttgagccaccgcacccggccctgttcctctttttattatattaagcactttataaacacttgttttttgcctgaagaatacttatgagctgagtgcggtggctcacacctgtaatcccagccctttgggaggccgaggcgggtggatcatgaggtcaggagattgagaccatcctggctaacatggtgaaaccccgtctctactaaaaatataaaaaattagccgggcatggtggcacgcacctgtagtcccagctagtcaggaggctgaggctggagaattgcttgaacccggaaggcggaggtttcagtgagccaagattgcaccactgcactccagcctgggcaacagagcaagactccatctcaattaaaaaaaaaaaaaaaagaatacctctgatgatcagttgtagggtagagatgatttgcatcccctaaaccttcagaacaggcaaggctttctgactcatgtcatctctcatcagaatatctcctcatatttctcagggtggtggctcattagcctccctcctctcacttgatgagacacttagcttcgaatcttatcattttcatttgactctgcctgtagggcaactatccggtagcaatggaagatcatttccattaggacctgtatttgtttatttgtttacttttttttaacaagcttttattgagtacttctatgggataggtacactggcggtacaaagatgaataagataaagtcataatcctcaaggacttcatcttctaggggaaatatatttgaaaagaattaatcacaatagatttcatgcataatttaagttagaggtttggctgctgtaacagagacaaaaaataaagagtgcttaaacaagatggaaatgtatttctatcttatactagtctgggcatgaggagaatgggactgatagggaatcttcatagtgtccctctgtgtcatagttctatccatacagatggatgtcatgctcatccatccacagagagttgacttcatcttcttggtccagtatggctccccaccattttggtaaaaacacattccaggccgggcacagtggctcacacctgtaatcccagcacttcgggaggccaacgtgggcagatcacgaggtcacaagattgagaccatcctggctaacacagtgaaaccccatccctactaaaaatacaaaaaattagccgggcatggtggcatgtgccggtagtcccagctactctgaaggctgaggcaggagaatccctggaacctgggaggcagaggttgtaatgagcacagatagtgccactgcactccagcctgggcaacagagtgagactccatctcaaaaacaagcaaacaaacaaaaacacattccagcaagtagggagggcaaaggggaaaaagaatggcacaccttccctgtaagtgaataatcctgaagtgttacacataacttctactggcattccattggcaagaacttaacttcttcatcacaccttgagacaagagacctgtaaagagaactactaatgcaataactgggtgagaaatgatgagggtcttgctggttagaatgcatataatcaaaaagaaaaaaatcttccatgtaatttcataagtttcagaacttgtgatacctcaagtttcagaaaagctaaagaatgaagttttccagaatatgatctgtataaataaatatgcatgtttctagtttataataagatactttctccaaatatcaaccatatattgtgacaataaaaaccatccaaactcacatgctgctgcatattttatctataatgttttcatttattaatatttatgaatttccttctcccagtgggttttcagaacattgcctcttccacacaacacataaaaacctgatctcgcaagatgacctttcagactaactttttattcttatgctaatacaatcattcttatttctattatacatttaattccagagtaacataatgctcaaagttactctgtttatgcctatgcaactctttaaagaatatgatgtgaaatctcttttcttgttcttcaaattcatactcttttgtttgctgttattaaatcccaatcacatacacaaagataactgtctctgagatgcttttaatgagaattagagtatttatgttaattgaggctttagaacgtatatctgatataatttgtgcttgagttgtttctatacaattctagtgcatcattgattttattcctaatgtaccattacttacaaactaggggtttaagttggaattgttaataaaaataggaataatcatagtatataaaatattatagactgaaataggtttgctaacactgaatgagtttatattttgttttgttttgattttttttgagacaaagtttcattcttatcgtccaggctagagtgcaatggcacgatctgggcttactgcaacctccgcctcctgggttcaggcaattctccagcctcagcctcctgagaagctggggttacaggcgacaggcaacatgtccggttaattttttgtatttttagtagagatggagtttcaccatgttggccaggctggtcttaaactcctaagctcaggtgatctttccgcctcagcctcccaaagtgctgggattacaggtgtgagccaccgcgcctggcccaagtttacattttaacattaaggaaattagcaataacctctcagagatcaaagcaacttgttctgtccatttcaaatataaataatccctgacatttatagtagttttgggcctttttccatccccacaagggacataaataaaatattcaattcagtaagaatttaccagtatgacaatatatctcatgttttgcaatgttttgttttcacatgcattatcctgttagtgctgctcccaatggccctcactaggtgagtgttatttataaaatatcctattttatagatgtagaaatgggcttagagaggcaagatgacctgctcaagttcatacagctaatcaaaagagtgcgaggaaattaaggtgggtattctaactcagagcccagcactctttctatatgtggcatctgtcactcaccaatttctaatatttgcccaactatctgctagcagggaatataaagtaaaacatggtttctgcccttcagttgagagataaagtataagcagttgttagcaatttcaaattgctttaagtcagtgatcaaatgaatagacaatgaagtcagagaaaggagataatcttgttagggtgatgaagttgtagcccttaatagtaccatactaaaatatactgtgcttatttttgttatatgatttcactgctttagccttttcagcttgcacaaaatgaaaacagttaccagaactatgttttccaaagatgcaaatctaagctgattatcagttcagatactgtctttgagaggggttagaaatgtaaagaaacaaatgatagactatttataagaagggtaaatgctttagttaaatttagaaatcttaacacctctacttttgcttttgaaagtggtcacatgctaacttttgcatgggcaaatttaggactcaaattataggaagaaaccttccttggattaagaggaaacattaaagaaatacaagtgaggttatttccattgcccctaggcagaatccattgttcctcagctgtatttcccaagctttttgtacttgctcggttttagatattatgtatttatttatgtcaagtcgccccttggtatccacagaggattggttctaagatctctcttggataccagttaatggctgctcaagtccctgatataaaatacaacctttgtatataacctatgtacatcctgttgtatactctaaatcacctccagatgacttataatacctaatacaatgtaagtggtatgtaaataattgcttcactgtattgtttagggaataatgacaagaaaaaagtctgtacacgttcattacagttgcaatacttttcccaaatatttttgatctgtggttggttgaatccatggatacagaacccacagagagttaactgtatctgcttcttccattaacctgttaattgcctgaggacttcatattcccagattcccagcactaatatagtgcctgacacatagcaggaatacaaatattggtgaattttgttgagttgaatctggaacttgacagtccaaactctggtaactcctaagccctggtgagacctaattaggccggatagtttttagccactaggactaatgggaagcatatcatgtattatatattttaaattaaatattttatacttaaagtagttcttttttgaattgctagtttgatggcagctgtttacttaggaccaagagtatggcacaaatgactccctggggaaagtttagcagttgaaatagaggacatagtccaatctcttagcaccacaagaatatgtccattgccttaatggcatcccttgtccccatcacatctcacaactatgtcaccttcatcataaagaactacgaaaacatactactgcctgatttaacatgcatttattaatctcctattatgtcttcagaaggatgctagttattagagatgcagaggtgaataagaaatatctggccagtcacagtggctcactcccataatcccaacatttaaggaggccaaggtggaaggattgcttaagaccaggagttcgagaccggcctagaatacatagcaagtccctgtctctacaaaaaataaaatgtctggatgtggtggtgcatacctgtagtcctagccactcaagagactgaggcaggagaactgcttgagcccccaggaggccaaggctgcagtgggttatgattgtgccactgcactccagcctgggtgacatagccagattctgtcataaaaaaaaaaaaatctatggagcaccctttatgggtcaggcagcatggcagccactggagataacagtaactgattcccactcttcttttttttttgagacggagtctcgctctgtcacccaggctagagtgcagtgcagcgatcttagctcgctgcaacctccgtctctcgggttcaagcaattctcctgcctcagcctcctgagtagctgggactacaggcgcgtgccaccacacctagctaatttgttgtatttttagtagagatggggtttcaccgtgttagccaggatggtcttgatctcttgaccttgtgatccgcccgccttggcctcccaaagtgctgggattacaggtgtgagtcactgcgcccggccgattcccactcttataaaatgtatatggtatttcacactccagtgagaaggagagatatgaattgtgataagttgcaatagaactgaacctagaaaaggaagtaactaattctgcttctctgtgacagggaaagctccatagaggaagcaaaatttgaacttggccttgaaccatggatggggtgccttagtctaacagggatcctgccttgtatttcaggaaaaagcatgaagacataaaaagtgtatcccacttgttaggggagctgtcagaatgctcttggccgatagctacagaaaataaactcattatggcctaaaaaagtaagaaaatgtatgagctcaaacaagaaacccagaggaagggtgacagcagaattggttaatttaggggcagaacccaccatcggaaacacagatccatctcatctttctgctttgctatccttggcgtattgaccttccccacaggctggttctcctcctggtcatctaatggccacagcagtgctaggcactatgtctgggcacaacactggtcaaaggaaaaagaaatgctgtcttcctcagtatggaaatctttcttaggaacttcccagtagactcccctttagtctcatgggcccaaatttcactgctgtccctaactacaccaacctctgatgtgggaaatgagaccaacagtggctggaccttgggctggagctgggatttgcctctaccatagtgtatggccatggggcagggagggggaagggagcctgtgcaggcaacaagctgaatcagctttaggagccttagatgaatcggtgttattagttcctagggaaactattgggctgctgagagattagtttgaaaggaaagcagaaggcagatgtggctttgtgtgccgtgtcagggatttataccttgacctctgtgctatggagtgatgtcatttctagaaaagtttcaagttacatggttttaaggaaatagtatcatttttaaccagatgctcagtccatcttgaggacgtcatcagaataagtcatatagaggtatttaagatactaggatatatgtctagtgtaatatgcatacttgtaaataacacacacacacacacacacacacacacacacctgcttcatttttgttcccaattacgactagaaagctaattaggaaataaaaacttttaacatttaaaacacctaaagcagtatagtgttaattctatcaaatggttattctctcaaagaatatttctgatcattgaacataatttattaatcacagacctctttttaaaaaagggaaaacaaataggaaacaggagcagaaacataacattatttttgcattttcagacttttccatggcaaagtctttggtagttaagttagaaaatagcccccccttgtgaccaaaaatcaggtaattggtcattcaagcgaaaatgaagcaaattttaagcaattctccaggaagaaggaagcaggaaaacaggaaaaggctgtccccttcaggatgatgttagtgttacatctccagtgttagaaattgctggttcacaagccctttgtttatgttggcatggttaactctgattgttgactctaattccaaaagtagatttatatttatctatcttgtaggaaaattattttttaactctcccattatttcttttttacattttctctatattcactcttggcttttacaacatgcacaagatgaaataatcattttaaaaactttaaccttattttccccaaatgttatcaattgtaattagatagctaatggaggcaacatctctggagggtgtgtggggatttagaaaggcaaatgaaataggaaatttggtaatcaaagaaatttctaaaaattttaatattttcaaatcagctgtcttgaatatccctaaatcttcatgtactatttaatttaatggcatagccataaattattattttaggtaaccacaactgaggagtgtagtctctgaatgctgaagaaagcataaagattgacatttttttgaagatgaaaaagaacagccttaccaagaaaatagagaacttagtttagctttaatacctggaaaaatactgaagcaaatcactgatcagccagtttgtatttatccccagtaatttgcagaatttgttggttttttaaaacctacatggctttgtaaagacaaaagttcacacgtttaatctaagacttaagatgaactgaaattaagatggactaatgtgttgattcagttctcctgaataatgataataatagctactattataattatctactctgacatttattgaggatttactatgaacctggaattgtgctaagcactctctatatatctcatataacactactgttatatggagtacacattatattacacgtgacaacatttcacagatgagaaaatgaagtcttaaaaaatttaagtaatgtcccaagaccaagtcgtggagtttggtttcaaactcagagctagcttatgacctcttaaccactaggtttgctggaagccaggactggtattctccaggctcacattctccaatcctctgcactttaagttgtatctagttgggtcatgggtatttagttcattctgtaacagctggataaagggcaatcttccacatgatgtaatccccaaattgctcaacaaagacattgttgttaatagagtccactggggtcaattaaaaaatcaaagtcaaaggggagcagagggtggtattttgaccagagaggaaaacggcaaggatttaatttgggaagactgttttttaaaaaatatttaaacatttattgtgctcaaaatttaaatccaaaaaaattaaataaatcgtataattctctttataggctgggtgcggtggctcatgtctgtaatcccagcactttgagaggctgaggcgggtggatcacctgaggtcgggagttcgagaccagcctgaccaacatggagaaaccccgtatctactaaaaatataaaattagctgggcatggtggtgcatgcctgtaatcccagctactcgggagactgaggcaaaagaattgcttgaacctgggaggcggagtttgcggtgagcctagaccgtgccattgctctccagcctgggcaacaagagtgaaactccgtctcaaagaaaaaaaaaacaaaaaacaaaaaacaactctcttttaaagtacaaaataattcatcaccttcctttattatttacccattatttcatctaaatgtttgtagctaagattttcttaaagcaggttacccatgattacagctgcctgagaggcctgtctcgtggcatgtatatatgtttcaccaaaggcaatttgggaatgtgtgttggatcaagattcagataatgtagacttgggttttccatttattatgccagtaaacttagtcaactcagattacccattctgagccttactttctcaagtctgaaatggggatagtaatactggcttatcagtacttcctgcacaggattgttgtacagaatcaaattcgtttatatatttgaaaaatatctacggaagggatgggtgtaattattgaaaagaagaaatcctagcatacttcgggatcttttactaccatttgcatcactgtaagatagagaaaaatgagagctgtgtccatgcatgttagaagtaatttttttcctttttgtattcattttattttaattttttttacattttattttagattcaggaggtacatgtgcaggtttgttacatggtgcgttagtctgttttgcattgctataaaggaatacctgagactgggtaatttataaaggaaagaggtttatttggttcatggttctgcaggctgtgcaagcatgacaccagcatctgctcagcttctggggaagccccagggagcttttactcatggtggaaggtgaagggggagcaggcatgtcacatggtgagacagggagaaagagagatgctaggctcttttaaacattcatatttcacagtaactaataaagtaagaactcattcattaccatggggagggcaccaagccattcatgaggggtctaccccaatgacccaaacaccttccaccaggccccatctccaacactgaggattacatttcaacatgagatttagaggcaaaaaacatccaaactatttcacatggatatattgtgtaatgatgtgatttggacttctggtgaacgcatccctcatccaaatagtgaacattgtacccaataggtaatctttcaaccctcaccttcatcccaccctcctgccttttggagttgccagtgtctattatttccatttgtatgtccatgtgtatccattgttcagtgaggacatgcggtatttgattttctgcttctgagttatttcacttatgatactcttctaacagtgagaatttaggctttctggtaagtataccttagatgataattgtactctttagcgtctggaatcaaagtttattctggtttgctcagccaaagctctttaactctggatctggtttggaagaaatggagcagtctattctcatctggaccaatcccaggaaacatcctcatctcaattaatccataagtcacatcacaggtttttgtgttggttttgttttgtttttctgtcaccacgattctccatccaatggctcttgtggaataaagcaatgcacagaagtggcactaagaagtctgttttttttgtttttgtttttgtttttagagatagcatcttggcccgggcgtggtggctcacgcctataatcccagcactttgggaggctgaggtgggtggatcacaaggtcagggtttcgagatcagcttggccaatatagtgaaaccctgtctctactaaaaatacaaaaaaaaaaaaaaaaaaatcagccaggtgtggtggcacacacctgtagtcccagctacttgggaggccaagggacggaggttgcagtgagccaagatcacgccactgcactccagcctgggcaacaagagtgagattccatctcaaaaaaaaaaaaaaaaaaaaaaaaaaagagacagcatctcactttgtcacacagactggagtgcagtagcacaatcacagcttactgcagcctcaacctccaggcttaagcgatcctcccacctcagcctcctgagtagctgggaccacaggcatgtgcccactgcacccagctaacttttgtagtttttgtagagatggggttttgccatgttgcccaggctagtctcaaactcctgagctcaagcaatcttccagccttggcctccttaagtgttgggattataggcgtaagccactgcacctggttagaagtcttaaatgacaaagaggagtgagctagataaaagagaaaagggatatttcaagtagagagcacaacatgtacaaaaactgggcaatgtgaattgtttagggaactacaagtggccgaggtggctagaggaaaggcagtgtgatagagtgatagagtgcagcttagccgtagccactgtcaggactttggagcctgccagctttggtttgaaacctagttccacctctctcagccgagtgcctttgggctagttatataacctctctgtatctacctcacggggtttagaactattaaatgaattatggtatattaaatgcttaaaatattgcataatacataatgagtactcctactattactattgttattgtgaatagttagataggcaggggacaggtcctagaggctcctacgttaaaaggaagaaaattaaaactatatgcctaaagccatggggaggtttagaaggtttttgtaagaagtagagagaaagtatgtgatgtgatctgatttttagaaaggtcattccaatgagaggtgacagcgtgctggcagtcctcagagccctcgcttgctctcggcacctcctctgcctgggctcccactttggcagcacttgaggagcccttcagcccaccactgcactgtgggagcccctttcagggctggccaaggctggagcccactcccttagcttgcagggaggtgtggagggagagacgcgagcgggaaccggggctgcgtgcagcgcttgcaggccagctggaattccgggtgggcgtgggcttggcgggcccctcactcggagcagccggccagccctgctggccccgggtaataagggacttagcacccgggccagtggctgcggagggtgtactgggtcccccagcagtgccagcccaccggcgctgcgctggatttctcaccgagccttagctgccttcccgaggggcagggctcgggacctgcagcccgccatgcctgagcctcccacccactccatgggctcctgtgcggcccaagcctccccaacgagcaccaccccctgctccacggcgcccagtcccatcgaccacccaagggctgaggaatgcgagcgcagggcgcatgactggcagacagctccacctgcagccctggtgccggatccactaggtgaagccagctgggctcctgagtctggtggggacgtggagagtctttatatctagctcagggattataaacacaccaatcagcaccctgtgtctagctcaaggtttgtgagtgcaccaatcgacactgtatctagctgctctggtggggccttggagaacctttatgcctagctcagggattgtaaatacaccaatcagcaccctgtgtttagctcaaggtttgtgaatgcaccaatcgacactctgtatctagctgctctggtggggccttggagaacctgtgtgtggaaactctgtatctaactaatctgatggggacgtggagaacctttgtatctagctcagggattgtaaatgtaccaatcagcgccctgacaaaacaggccactgggctctaccaatcagcaggatgtgggtggggccagataagagaataaaagcaggctgcccgagcccgcattggcaacccactcgggtccccttccacactgtggaggctttgttctttcgctctttgcaataactcttgctactgctcactctttgggtccacgctgcttttatgagttgtaacactcactgcgaagatctgcagcttcactcctgaacccagcgagaccacgagcccaccaggaggaataaacaactccagacgtgctgccttaagagctgtaacactcaccgcaaaggtctgcagcttcactcctgagccagcgagaccatgaacccaccagaaggaagaaactccgaacacatctgaacatcagaagggacagactccagatgtgccaccttaagagctgtaacaccgcgagggtccgcggcttcattcttgaagtcagtgagaccaaggacccaccaattccggacacaccaatacgtggatagggatagatcaaagggaatcaaactaaagataggaaggccagtaaagaggcaactgcagtaatccagaggaagagagatggaagcttaaattaagtaaatgccaggtgcaataaagaggagagggagcaccaggtgagagtgaggaggagaagccacaggcctgggtgcctgaatctcagttgtcaggcctgggcagttgagtggtgtggataccactcaccgagaatgggaacgccaggaaagaagtggatttggagaaacgtgggggagcttagttctgtggtgtctttgattttggacatactgggtttgaagagaacagccaattactgatgcttagtaggtaatggcttggtgcttcaggaagagatcagaaccctttgataagaaccctggcctggctgggcgcggtggctcacgcctgtaatcccagcactttgagaggccgaggcgggcggatcacgaggtcaggagatcaagaccatcctggctaacacggtgaaacccagtctctactaaaaaataccaaaaaattagccgggcgcggtggcgggagcctgtagtcccagctactggggaagctgaggcaggagaatggcgggaacccgggaggcggagcttgctgtaagccgagatcacgccactgcactccagcctgggtgacagagcgagactccatctcaaaaaaaataaaataaataaataaataaagaaccctggcccatttagaaatgaagctgtctatacttccagactgaataacaaccactttttgttagttgtttaagatgtgatctctgccttaattatcgatagtcatattcaaaagattcactaaatcccatctggaaaatggagacgtttttgagattcttttggcaattcaagagcattatcattgattattagtagtgactgaaacaaagacactgacaaaattagacatacactcattacactcattgttttggctatattttgagaattttgtcaactgattgtcttcacaatgtccttcctttggacatataataaaaataatatagtcattatttgaatgtgtgcatatagttgcaaaattaccatgtgtttatatgtataatgtgtttctagttttacactgtttagtcactcaaaaattgtattatgattgcaactttcccccacaggtatctctgatgaatatataacacctatgtttagtttttataaaagtattggggaactgaaaatgactcaagaggagtatgctctgcttacagcaattgttatcctgtctccaggtaattccaatgttacattttaatttttatgccatttttttcagtatactagtaataacgtttattgaaaaaaatctggaaaacatagaaatataaagaaaaagtaaagtagcctataattctgctatccaaatagaaccattattaacctttcagtgcacttcttttcagtctttttaaaaaatatcacacttattcatttaataaatgtatattgaacacctactatgtactaaccatgatgctaagcaccggggatgcaacaagacacagctcccatgcagcttgcattctggtaggatgagaaagataataaatgaagaaacaatattttttcagaaggtggtaaatgctacaaaaaatataatgagaatataaagaaagagagtggcacaaaaatggtattttaatttgtggtcacaggaggctttttttaagtgggtggcattggagcagggatctaaatgaaattacatactttttaacataataaggaacttttttctgagtttatatttcttctaaaagtcatttcccaagtcattaaaaaattacattggtaaagttgtaatatgtgctacatattccattgtatgaatatacaatcatttacttaatctttaccacatgtttgtatattcaggatatttccagtttttttgatgttgaaaatgtttcttcaacagttttttttggttgttgaaatgatacctctttccatatttttttctatattttttggttactttaataatttgggtgtcgaatgatgccatgctcatgatttgtagagcataataacaatgttagccttaggccatttttatacattatcttgaggcagaagctagttgttactttgctttaccataaaaattatgacttgtgactaaaaaactattcagcagaaccttctaaagttatgtatggatatgtcctatgacccagtgatttcacttctgagaatatactcaacagaaaggatgctcacgtccaccctacaggttatctttaggggttttgattggaaggggaattgggaggcttctgggaagcattacatgtgttgtatcttgatctcgttataattacgtgtgtgtgcataaaaattcatcaggttgaacacttaattttcacattttgtgtacaacatttaacttacacttcaaaatagttaacgttgctataattatgctgaattaatgcttttccactttttaattttgtcattttattttaaacttcaaaacagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaacagga

SEQ ID NO: 1014 - DNA, 90095 bp, Homo sapiens; identical to SEQ ID NO: 1013

SEQ ID NO: 1015 - DNA, 90095 bp, Homo sapiens; identical to SEQ ID NO: 1013

SEQ ID NO: 1016 - DNA, 90095 bp, Homo sapiens; identical to SEQ ID NO: 1013

SEQ ID NO: 1017 - DNA, 60508 bp, Homo sapiens
attttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtaggacactgttcacaggtgctttcaggtcgagctcttgcaactggactgaggaaatctggggactttggttggagatgacagtaacagatgtctgtcaaagatagtggctcagtcagacccagaagactggaatgagagtttgggttggggtgatttttatagggttctaaacagacgaatatcttatggggatgaaatccaaggatgtttcccctaatattcttcatagactcttatgtcaaattatcactattcttccaaaccaaacattagacaattctaatattaatatcaatggacacttgaaaaaacattttaacagacattatttaatgcagtgctcctaaaatggcaagtctcagttcccaggggatcacaaaatttatttagtgtctcgtgaccagcattaaaaactggattagaatataatagaatagaaatattagtgtccctcaaggagtaaagacaagtggtatttcatgaaattttgtttcagttacatgtgtataagtatgtacgagggatatgagataaaatgtatctaaaaccgtaggttgtggtaaaaaaaaaaatgaaaagagtttgggaaacacgaattaatgaagtagtttcacagcaggtttctcccaatagtccatgaaaaatcagataagcacagagttgagctttaggcccaggctcttggttttctctgaattaaaacatcgattataattaaaacacagtataatgtaaatcatattttaatattttttaaaacagaaattcatcttttaaatttccagcaagaaaaaactcgagtcatttttataataatgataattgtgaacatgtttttggtcatagacttggtagcataccattttgtttaaatgcgatgtttaaaagtgaccgacactgtatttagaaatggaaatgagttggaaggccggggaagcaaattttctatttacttcaatttaaccaacatttaataaacatttactatgtgtcagccattgagttagatgccaggaatataaagaaaagaatatagtctaatattttccctcaaagagttcacagactaatcacaacaatcacaaaagtatacatgtgtatgtggtgtcaggcactatgcagtttccattctttgtcttagttcatctttattacagcctctcatgcaggcactacattctttcagctttgtaaaggaaggaacagaagcttaaagaagttccatgtctttcccaggttcatatacctaacaagttgtgggtgaaatgaatccagatttgtctgctcagagggcactcttaggtagtatctcataccatctcaagttcagcgtggaagataagcctgtaaacaaaagaaatgattgtatgtgcttccaataagtgccataatagaagtgtgtacagaggtaggagaggtgaattccacctgggggaactggggcagacctcccagagtaggtgaccagaagtaggtgatcagctgacaaggcagggagaggcactgacatcacaaaggcctgatgccaggaacagcaaacaactttgcagtaaagccctgccatttagtgaagaaaccatggattaagaaataaaggaaggcaaaaaaaaaaagtgacttttctaggcactgcaattcaacagacattcattaaacatttactatggtcagcattgtgccaggaatgaaaaactggatataaactggaccctttcttaggagcatcagaaactcactgtgagattatgggggagtgccattgtttttatgcaaacctgatttcccatttgggggtacagtggttctggtcccaaactccttagagctgcactggctaatatgccacatgtggctattcaactttaacttagaattaaataaaatttaacagtcagactctaagtatcactagccacattccaagggttcaatatccctatgtggttagtggctaccatattggtaggtacagaacccttctatcacctcagaaagctccctcagatggcactcctttagagaaggtgttgaaacctggagactgtctaaccagaagaattttactttcttttcagggcttctcagactcccctggagtccatccatgtgttctcatttaagaactcgtccctaaacttccatggagaaccgtcacaaaggaatcctaattctcatactctttgataggctaattccaaaataaagattcctaaatctaaattttaatatgtattttcccttttaaattgtatcaaaatagaaataaatttaccttttcagaaagcatactctaaattaaagtcgaactacctctactccctccacatcttattttctgccaatgttgtatttgtttacttgtttacttatttttgtcctaacccttgacatccccacttcccaaaacacacaaacaagagaaaggctgggccttcgtatgtgtcttttcactttcatatgttcagaccctaacacagtgactgctaaatagcaagtgtttataacacacacacacacacacacacacacacacacacacacacagagagagagagagaacatgagcatatgtttataaataataatttgtaatgaaagaactatcctaatacttatatcatcaagacagactgtgttaataattacttattaactatcaattaactatgattaaaatcaggattttgctaggttctttaggaaacatgtcttttaatgacactcaacttaccgaaactgcttctcagcaaccgtattttacactcagaactaccttctgagatagcaacagtcccatttttataggagagattgaaataggaaaagcttagccagttaagatctcatggtcagttaactgtggaagttgttctagtccaaccattttggaatatttggccatgctggttctttggttgtaaagttcctttgtaattacttctctatttgtggagatttaggagacacactatgaaatgctagaagtgaatgtgctttgagaatagaaggttttttttgttttttgagatggagtctcgctctgtcacccaggctggagtgcaatgacatgatcttggctcatcactgcaggctccacctcccaggttcaagtgattctcctgcctcagcctcccgagtggctgggttacacgcacctgccaccacgtccagctaatttttgtatctttagtagagacggggtttcaccatgttggtcaggctggtcttgaactccttacctcaggtgatccactcgcctttgcctcccaaagtgctgggattacaggcattagccactgcacttggccaagaatagaagtattatttaatattattgtgtacggttctcatatttttactgatgttctactgttttagcatgatattatctatatctttgtgaaagctttccattttgatctagattattccagagactgaaagacagggatattattatctgacttgacttgggactcctttgtatttcttgattatgaaaataattgttttgttgaaataatgcttaaagattttagaattgtcatatgaggagaaaaaaagtacacatctccttggatgctacagaatccagattctatcggtttttgatcttgggcaaattacttaaccttactagacctgtggcagagagaaattgggctaagggaggaaggggagttaagggaataagataggttagaggataaaatctaagtgtacgtgaaactaatgcttttaatactttttagtttttttcaattccattcactccagaaattttcatcgtatttggtgatgaaatagatcaggattttgcttctattttatcttttctttttgtgtaataattccatatttttctccttccattttgcggtcataagacaaggcaccatttctaaaatattttgtccatcagacatactcgtttttttgtttgtttattttattttgttttgtttttgtttttgttttttttgagacagagtcttgctctgtctccaggctggagtgcagtggcgcgatctcggctcactacaaccaccacatcccaggttcaagtgattctcctgcctcagcctcccaggtagctgggactacaggtgtgcaccaccaagcccagctaatttttttgtatttttagtagagacggggtttcaccatgttggctaggatggtctcaatcttttgaccttgtgaaccacctgcctcggcctcccaaagtgctgggattacaggcgtgagccactgcacctggcctatgctgtttttatatggataagtcacacagaaggaaaggaaattgatttttgtacagatactgtataccatgtgttctgtcaatcatttcctgggttaatgcagaaagcattattttcaacatgtaatatgtatattctgaaatttggcagtgtagaaaagccctaaattctaatgttcataaactattagtcatatacttatggagacttttagatataaagaagaactagaagattatctagggtggagtcttctctttacagatgaacagagggaggcccaggtagggtaagtaatggtttttaaatggcatgtaactagattcaggaacatgactgccagggacctagaaacctcttctgttgggaagacttcccaagagaagcaatacccacagggaatttagaggtaagtggacattagtgagatgaagccctggaaggggttggctgtgttgagaaccatttcaggctcaggaagcagcaggtgggagaagtcctgagtctggaagcggcaaggcacattcaagaaacagagatgtccgaacatgcaaaatggctggaaaagaaagcaagggtagagtcatgcagaagcttgcaggcccagttataggttatgtgcaagcggaggccgagaagggggtaacaaacacaagtaggaggatgcagagaggggctttgaagatcatgtttttaagtatcacacacctgaaattacccccagagagcagcaattcagtgcatgggctttgagattagactcctagagctcaagtctcatctacttaggtaggtaggagtaaagttgcttaactactatgtgcctcatggtactcatttgtaagtgggggttaataatgttacccacctcatagagttttgtgaggaataaatgagaacatacaagtgcctgctactacgaagaactctataaaagttttctgcaaaatgtggtaatagtaatcataataattatagtaatcgtttcaactatcttttgagcacagcaaagagcattgccaatttgaaatccccaaagccccaaaaaaccacgtttttctaaaagtttggcacacacttttttggtgacagaacctgacctgaatgaatgtgaaactatttatggtctttacttattgcacttgctgtgaatattcatacgtttccctgtggaaaatattgctgtatttgattctgggttctgttccagactgtgctgggagggatatataaatagcactgtattctgttctgaaatcctgaaaattctgacttctaaaacacatacgactgccagggtttcagataaggaactgtgaatctgtatcatctcactcaatcctcagactaactcttgatatcgatattatcatcccaaccttgctgccatgaaaaccaagatttatcaatagtttgaataatttgctcaaaatcccactgttcataagagatggaattggaattttggtctagaattgtctgacaacactttgaagagtcagacacatttgtaaactttcctatctcttatttatgtctattttttcagcatttgcataatttcaattttttattttctaaagagccatagttgatgtttccaggaaatagaagcattttcataacctgatgattttctattacctagaggttttctaaataagggactcctttaataatgatggtagtaagaataattgttattattcctattttaagtcagctataatttatcgagcacttctgtgtgccaaacatttagcaaagcacttggcacacattatctcatataatccttacatcaacccaatgaggtaggtgttattattctctgttttattagaagaagactgcaacttaaagacattaaggaattgccagctgcacacagattgtaagtaacagagcaggaatttgaatccagtagatagattgcaggcactgtattcttttttttaaagctcctcctttgttttataatgattaaaataacacatacatatacacatggcaaaaactacaaacagtaaaaaaaattatgcaatcttctatcccagaatataatgtaaaaatatcacctctcacagtcaccaccacctactttcttctgtatcatgcagaaatttgtctttgcacgtgggcacgtgcgcgcacacacacacacacacacacacacagagttggtgtttaataccgatgtgaatatacacattggtctatagcttacctttttcatatagcaccatattgtagaaaatttccataacagcacatagaaatctaaataattgttttacatctacttaatagtgtatggatgtaacaaatttattgaagcagactcctatggatgaatatttagatcgtttccaatttatggctcttgcgaatgtgctgcaagtgaatatttttacaaaatactttttcatagaggttcaagcatatttctaaaataaattttcaagcagtggaaaatttatgctgggtgaaaaggacattgaagtttaaaaaactggaaaatattgacaaatttccccccaaaaatatttgtttccccaacagtgtgtattattaaactttttaaaccctcacacatttgaagatgaaaactgtaatgttttagtttcaatttaaatttaattattggcaaaggtgagcacatttttctgtttacaaaacacggttatatttctaacattgactattcctttcctttatccctttttccatagcttctcaaatattttcttattggttttcaggagctctttatacattaatgagatgagtctgtcctctatgttgcagatatttttctgaatttttaatttgtcatttaattttatatatatatatatatatatatatatactctaaagaagttgtaaacttttatgtagttaaatgtttcaatcttttcttagagcccacactcctaaccattacgccaaactgcctctctaatttccagaatgatgacattcattccagttttgttgtcacttttgttcaggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtaagcatctttgattggcagttttctccttcaggttttactatattggttgttgaaatcccttgaactaattgcttcccttttcccaggcaacttcccattttctcctcctgtgcgcctacctcctcctacatcctcacctttgttgtgtagtcaaagatctgtaggaaaagactgttagagtatttagcttaatgtttaagactgttagagtatctagcttagagtgtttagctttcttccttttcacaacctcacacgtagctaaagggaacttatgattaaattgaattttttgtaggttttgtttgtttttgttgtttttttaaaaaagaaagaagaaagtgatgaacacatctcttttaaaattaagatctagaagaatacaactttattcaataaatatttaaaaatatttttcatgtactttagttaattgagaaagagagaaagaaagagccaagtaataatagcttatattacaaaaaaatattttaacttggcatggtggctcatgcctgtaatcccagcactttgggaggccgaggcaggcagatcacctgagatcaggagttcaagaccagcctggccaacacggtgaaatctcgtctctactaaaaatacaaaaattagctgggtgtggtggcaggtgcctgtaattccagctactcaggaggctgaggcaggagaatcgcttgaacctgggaggtggaggttgcagtgagccaagatcgcaccattgcactccagcctgggcaacaagagcgaaaatccatctcaaaaaataattttttttttttttatttagcctaggcatggtggctcatgcctgtagttccagcactttgggaggctgaggtgggtggatcgcttgagtccaggagttcgagactagatagagcaacatgggaaaaccccatctctacaaaaaatacaaaaattagtcaggtgtggtggagcacgcatgttgtcccagctacttgggaggcagaggtgggaggatcacctgagcccgggaggttgaggctgcagtgagccgtgatcatgccactgcactccagactgaatgacagagagagaccctgcctcaaaaaatatatattttatttagcagtaatacagttctgttatggatgctatagagaaatcataacaaaattgcaatccatttaagatggataaaatataataaatgaaatataaaaatgacaatgtaggccgggcatggtggctcacgcctgtaatcccagcactttgggagaccaagacgggtggatcatgaggtcaggagaatgagaccatctgactaacacggtgaaaccccgtctctactaaaaatacaaaaaaattagctgggcttggtggtgcatgcctgtagtcccagctactcaggaggctgaggcaggagaatggcgtgaacccgagaggcagaggttgcagtgagccgagatcacgccactgcactccagcctgggcaactgagcgagactccgtctccaaaaaaaaaaaaagacaatgtaaaatcccatgtgattactgtctcaactaaggcacagataatcgtggtatttattcattaaacaaatattttgggaacacctaccatgggtcaggcactctgctaacatctagaacattgaatactgaataaaaaccatctcttgagcagaatctttcggatggtgtgacacactggggttccctgatgttggtggttgccacagaaataaacagaggacccagtcacataagatcggctcaaggacatttcaaacctttgaaagttcaaatgatcagattgtgtaaagccacattagtcacttcttaaaaactgggtatgatattgttagaattttttttaaataaagaagcatttgtacaccaactttacaaactaaagcagatctataaagaaaacttaaaagatcccacttatggccttcagaatgtccttaacctttttgtggagagtcacgtctgaataggtaaatgaacttatacattcgttggaagcatagattaagtcttctctacctatattgctactcatagcacctagcacagtgcctggtacatagtaaatatggaatgtcttttgaatgacacaatgaaaaaccatgttcatcactggtacgtaattaatcagcctctactttgcaaaaacacattaaaatttttttttacaatacttaattctttcccatctccgaatgataaaaagtaaatattaccctcgattcctatatgaagtggcagatctttttgagctggcagagctgtggagatcgagatctgcttatgttaaagattttaaaatggtgtggaataaagcaggaaaacatttctaattggttagaaaaataaaataggccggacgctgtggttcacttatgtaagtcccagcactatgggaggccgaggtggggggatcacctaaggtcaggagttcaagaccagcctggccaacatggtgaaaccccatctctactaaaagtacaaaaattagctgggcatagtggcacgcacctgtagtcccagctacttgggagtctgagacaggagaattcctcgaatccagaaggtggaggttgcagtgagctgagattgtgccattgcactccatcctggatgacagagcgagactccgtcaaagacagaaaggaaggaaggaaggaaggaaggaaggaaggaaggaaggaaggaaggaaggaaggaaggaaggaaggaaaaaataaagtagtttccaaatgacaagccttgaactggaattaaaataaacaaaaataaaacttctacagttaggtttgagaaaccaactgctgatctacaggaaagaaaaagaacaaactttatagtagctctagtcaaaaagtggctggggctcttacactggagggcaaattaggaccaaaagatgaagcttataggatggcatcttttgaggcctaattcaagaattaattttttagcactaacatgaattgtcccaacaatgagattggctttttgccttaggtggtaacgaacttctcattattacaggaattcaaaaagaggttagataaacaggtttgagtacaggagatttgtatgttaggtgggacactgtattagctggcttctgaagtccttccttaaattctgtgaatctgtagtaccatatttataatattctaatctgcctgtttcatcttctaagcaagtttataaatttcataagttaaaaagtgactataattcatgtactccctcctgttgctatgaactgatgaaagggaaagctagaccatggtttttaaaccttgacactattgacattttaggctgaaaaactctgttgtggggggatgtcttgtacatactgtgggatatttagtagtagccctggcttctatccactagatcccagtagcaaccccccacttgtgacaaccaaaagtgtctacagacattgctaaatgtcctctggggttacaatcaccccagttgagaatcactgagagagactattcagtgaaaagtataatatagagcttctcaaacttgagctacacctggagatttcttgagggaagctataatatttcttgggtgcctctaatgttgacttaaattgcttttaatgaattacttatgctatcaagcaattatagcataagctatattatattataatagctatattatattgtgtatcatcttttatacactgaaaaatttctatacacaaaggaacaaacacaaatttacaaaattacatacaaacaaaactacaaaaccaataaaataatgaagtatattagattgtatggttttgttgcccaaaatgttaccaaactcaggttcttttgagtttggtatcactagaccatgtgtcatatgaggcctcaattctccactgcttttctctcttcgaagaattgattcaaccaaacctttgttcatccagagctccatttggccatccctgagctgggtacatctcaggcatatgaagtttgcctttgccattttgtcaaagctttttttttttttttttttttttgagacagagtcttgctctgttgcccaggctggagggcaatggcatgatctccactcactgcaacctctgcctcctgggttcaagtgattctcctgcctcagcctccccgagtagctgggcttacaggcgccctccactatgcccagctaatttttgtatttttagtagagatggagtttcaccatgttggccaggctggtctcaaatccctgacctcaggtgatccacccacctcagcctcccaaagtgctgggattacaggcatgagccactgtgcctggcctgtcatagttcttgacaaacaagtcatatttcttgctgctaatgggcacaaacaaaactgagggtgattagtttgaatatcagtataagatgatcatagatatgatccagagaatgctattattagttttttaaagactggcataaaataaaaatgtaaaaaataaatttaatatgtgtaaaggccttagaaaaaagtgtggcacatagtcaaaactcaatagatgtctattgttattattgttatggtcctagaattgatttacatatcgtgtaatggcaatgtgagtgttttctgcttatattgataaatattgatgctcaaatcatcgtgagttgtttaacaagatttatttgacatagattcagattacctaaagccacttcaacttgtctgtgtagaccagtgctactcaaagcatagtacctggaccagcagtatcagtatcactagagaatttatagaatgtggggttttaccccagacttactgaatcagaatttctgggaaaggggcccaagaatctgtgatttaaccagcactacatgctaaagtttgagaatactggcgtaaaaatcatatccaaaatcttcctaaggccactcatctggccaagcatcttggttttgtgttgtgagtgtgaaacccacaggatgggaaaagagaataggaggaatgctactctccatgaggtcatcaaaagcacaattcagtagaataaaatgtagacttgaaacctggactggaaagacacaaagcctaatctaagtcatgtttcctgctgggagagaaagaagcagaaaagaacacgcataatttattcggaaaatctgattcaaaagaaaaattccaatatacatacttttgaacctacaaatttcagtgctgatgacatgctaattctttttttttttctgaaacggattcttgctctgtcacccaggctggagtgcagtggcgcgatctcagctcacaaactccgcctcccgggttcacgccattctcctgcctcagcctcccgagtagctgggactacaggcacctgccaccacgcccggctaattttttgtatttttagtagagacagggtttcaccatgttagccagaatgatctccatctcctgacctcgtgatccgcccgcctcggcctcccaaagttctgggattacaggcgtgagccaccgtgcccggccgatgacatgctaattcttatggtaggcattttggaaacattctctctgatctttacagcaactatggaaagtaggaattattgtgtctattttaaaatgaggaataagcatatcatttccaaaacaagctaagatatagagatgccagtgctaatagcttgtgtgatgtgtttactatactttagtaatacacttattaattctcatatcttatgtccattttattttattttcttaaatttatgattgacataataattgtacatgtttatggggtacaacatgttttcatacatgtataattgtgtaatgatcaaatcagggtaattagcacatctaacagcttaatttatcatttcttcattatgagaatattaaaaaacctctcttctagttattttgaaatacacagtacattattattaactctagtcatgctgctatgcaatagaacatcagacatattccttctatctaactgtattcttggacccgttgactaatttcactgtccccttctccccccatcctcctcatcctctcataactaccattctactctctatttccatgagaacaacgttttagattctacatataagtgagatcatatggtatttgtctttctgtgcttggcttatttcatttcatgtaatatcctccgggctcatccatgttatcacaaatggcaggatttcattcttttttatggctgaatagtattccattatgtatacataccacattttcttgatccagtcatccattgatgaacgcttaggttgatcccctatcttggccattgtgaataatgctgcaataaacataggagtgcagatatctctttgacatactgatttcatttcctgtggagatataccctgtggtgggattcctggattatatagtagttacatttttaattttgtgaggaaacatcatactgttttccattatgactacacaaatttacactcccaccagcagtaagggttgacttttctctacatccttgccaaaacttgttatcttttgatttattgatagtcattctaaatggagtgaggtgatatctcattgtagttttgcattttcctgatgattagtggtgttgagtgccttatgcccattttatggaagtggaagctgaagcataagttgttaatctatttacccaagttttcatagctaataagagcttcaaaactatagcttataatctaactccagagcctgtatgattgaccactaggctatgatgccttttattggttgtccactaagtgattgttctgctcttcagttgtttgctcaagggtaatattgactaattcaatggcgagaggaagaaaacgaagcagtccgtttagctgttaaagaatcagtagtgtctaagccaagggaatgaatccctaaagtcactaaccttggatagcttacctccttagaagagaatttttctttctgtcttgtgaactgtgcttatgaccaagtgaaacttggtccacctgcgaagagttctggggcatggcagggtaaatagagtgagaccagtgggccaaggacaaccctggaaaacacttaccttaaaggtggtcaggggaagagaagcccacaaaggatatagaatagaagtaatcaagatagaagtctacaaggaagtgcaggatcacagaaggcaaggagatggagaaagtagtcagaagagagccaacctttggggaggtttaggaaggagaagctggatttggacataaatatatttttaagagcagagaaagacaaaatttttccattgattttgatttgagacgttgcccccatggtgtcaggaaaaggacaagcatgcaagggagaggatgggttggaaccaggcagggcccatgttctatgccagggattggcacatttttttctgtaaacatccagacaataacaagttgaggcttcacaccacagcagcctctgttgcaactaatcaactctgctactggagtgcaaaggcagccacatagaaaatgagcatagctatatttcagtaagctatacttacaaaaataggcaggaaaaaaaatgacagtgggctggctgcagtttgctgaacactgttcttgaccaatgacttttttttttttttttttttttgagatggactctcgctctgtcacccaggctggagcgcagtggcaatcttggcccacagcaacctccacctgggttcaagtgattctcctgcctcagcctcccaagtagctgggattacaggcaccagccaccatgcccagctaatttttgtatttttagtagagacggggtttcaccatgttggctagggtggttttgaagtcctgacctcaagtgatccacccgtctcagccttccaaagtgctgcggttgcaggcatgagccaccgtgcctggccttgacccatgactcttaagggttggtgtacgaattaactggaagctgtgtagtgaatgagcacaagattcaactcacagcccctatgtgagagaaatgtaactttattttttaaaattggatttaattcagtctagagctcggtggaaactttatttcattttattcagtatcattccattcacccccgccaaaattcttctggcggtttatctaagtaccaggattaagggagggttgtggagggattgggcactggggagtggggctctggccccacagctgtggggctgggtggggcttggtgccacagctgttgacacagtctgagatctgttggagtgctgttgtatttggtcttcagtcaccagtgggaaaggtctctgtgacaccatcctggggtactgagcacactcttccatcacgtctggccctggctgtctccttcattcagctcaggtgggtgggttctgatgttgcatcagtgctgtgttgggatgcctggcttcccagagaaaccatgctgccatttcatctgctctatgccatgctgggtgcagagaaccctgggggtttctccagttctacccaggaaagggcataagaatcctcgtcttccaggatcccaaatgacgtggagtttctataatctctcaatccacctatcctaggattctgtctggggatagggagttgggagggacagagctcaggaccttctcaggtacctaacatgtcttagctctttgacttcccctttagttgtctgcttcctcccgacttgaataagttttatctggtcttcaggattgggggcttaagctctggcgtctgaaaagccaaaaacaggctcctttatcttccttatgtgttctcctgtgaaaacaaatgaaaattatcctaccttagtgaatggaggaatgaggaagggctgtgaggaaaaccagaggagaaggacagaatagagtggaatgcatatcagaggaccaatgcctcatgcctgcaggtcttgtgagagctgctcagccaacctggtttccccgctgaccccgcagcccacttcccccatgcacatctcttgatatctgcactcagcagatgcaaagcgaattatactctgtaactttccatcaaagggagcacgggctttgcgggctgacaagctcacattgaatctaggctctgcacttcttggctgaataaacaagttacttaatatttactggttagagttcagcaaaataaaacagaaaccaacaattcaagcagaaaagaattaatacagaagttggaagagtcagagtaacaggatctatgctaagtttctgggagatgctcagagccacactgcagaactggcccgccggttgcttttctgccaaaatcaagaagatggggactcaggaagccacctcaggactgttggctccaggaagacaccacctcagctgccatctagggatcaggaagttgccttcactggcaatcactaactccagagacggggcttgcctgccaaatctgcacctgcaaacaatgaataccctgtcccctgcctttcaataccctcaaagctagtgactggaagccagagtgctgccacagcaaaactccacaatcccgcttaccagtagaaacaacggaagaacagcttgcttctcctttccaaaagtcttacaagggcatctctatgggagagcttaaatcatatccaccatgttagctgcgaaggaagtctgggcaaggttatgttctactttcctgcctctctggtaataggatgtgcactagactagaagggaggtgcagaagatataaagctagcgaattcttaagaccgtgcaatatttattcctctgagcctcagatctgcaaaatagggatattatctattttgtgggacatttgtgtggattgtacaagatttatattacattatattatatattagaatttaccagctctcttgctttagtatttcactgaagatttgtcagtcctgtgatacttaaaacaaacaaagaaaacacaagagaatttaaaaaaaaaaagcaaccttagaaacaaaacaaagatcagggttaaatttcctcattacattggtctctttttctggttccactaaaaatattttaatttgtctcagtgttttatttgtcataagtatttatagcatcaatgagagaaatgatggttttcaatttttgtaagtaataacttgggaacacaagcatcacgcagaatgacaatgactgccactttctcaggactagattaaatcaagagctttcttttgccctcagttatcagtgcagcatatggaaatgtgctaatgtctgaatgaattttgattcaaacctcaaacctcaaccaacaaaactgatcagcatctaactgaaaatttcaaatggctgcatttccaaataggtcagtgtctgtcacatttgtttcaatgccaagagagtcttcacacatccgagaatggtagaattcctaaaagatgctgtctgagtaaatgagtgaccctactgcctttctgaatatatttttgtgtaggattgtgaaccagcattagacttaggtctgaagttttaaaaaagcttccaaaagtattgaaactattccagtatagaatagatgtagtgtttccaaaggatcctttgtttatggacatttgtgaaagctgaggagtgctgacctatatataaacttattgacatcctatttaagatcaagcaaggtctgattttatacaatttaataatgatcctaatgaattctagaggtcaaattatcttggagtatgatgcaagatggggttccaaactatttcactgcattggaacccttttgtagtaagtgttatgaaaatcgtgggaagagtaggaccctgaaggcaaacaacatgctttccaatcccagctgattctcttcccaggtgtcctaaattacttaacctttctgatctttagactccccacctgtaagataaggacaacaatgaagatgagataaagatgaggagatgatgatgatgatggtgatgatgataatggtgatggtgatggtgatggtggtggtgataatgatgatgatggtgatggtgatgatgatggtaattatggtaatgttggtgatgtgatgatgatgatagtaataatcatgttgatagataatctatatcaagtgattactatgtgcaggcactgttctgggaggctttatatgtactaatttgtttaatcttcaggacagtcttttgaagcaggtatctgtagattgtcatgaggattaaataaattgatacctgtaaagtacttaacagagttcttcccaatggaaaatcctcaatcattgcctgctattattactattatcattgggttgttgtgaatttaaaaaaatgggatattatttttaaaatatctagctctgtacctggcactctttttaaaaagtttttttttttttagatttcaatagcttttgggggtacagtcgtacaaatggttttttgttacatgaatgacttgtatagtgatgaattctgagattttgttgtacctgtcaccagagtgtatacattttatccaatatgtagttttttatcccacacttttctcccctcctcccttttgagtctctgaagtctattatacactctgtatacctttgcttactgatagcttaggtcccacttgtaagtgggaacacatggcatttggttttccattcctgagttacttcacttagaataatggccttctgctctacccaagttgctgcaaaagacattatttcattcctttttatggctgaatggtattccatggtgtatatataccacagtttctttatccactcattggttgatgggcacttagattggttctatatctttgcaattgtgaattgggttgcaataaacatacatatgcatgtgtctttttatctaattactttttttcctttgggtagacactcactagtgggattgctggatcgaatggtagatctactttcagttctttaagaaatctccataacgttttccatagaggttgtactaatttacattctcaccaacagtgaaaagcattcccctttcactacatccacaccaaaatctattattttttgactttttaaaaatgggcattcttgcaggagtaaggtagtatctcattgtcattttaatttgcatttccccaatgattagtgatactgaacatgttttcatgtgttttttggccatttgtatgtgttcttttgagaaatgtctattcatgtcatttgtccactttttgatgagattacttgatttttcccttgctgatttattgagtttcttatagattctggatactagtactttgtcagatgcatagtttgcaaatattttatcccattctgtgggttgtctgttcactctgatgattatttattttgctgtgtagaatctttttagtttaatcaggtcccatttatttatttgtttgtttttgttgcatttgtttttggggttttagtcttgatgtacctggcactcttacatgctcagtaatcattagatgtgattttgttggtgaattcttatttgttattcctctgttcattcaacctccccagtctgggtcatacactgttttcaaaactctccctcttcctattagttaacccaattctttattcagcaaatattattaagtaccagtttgtatgccggagtctattctaagcataggagatgccttggtgagcaaaccagaccaaattcttgccttcatagtcaccattctaaagcaaaagcagaaaaatagtctacataactcagctaaaatagacaaaaagagaaaacagtcaagcaaacaaaaagattaagaaatataaaatcagtaaaagagtatcgaaaagaatacgtagaaaaatgcaatggtaataaaatgatttccagggaatatgaactgacatttcacataaacatataggtgatgaggcaagacaaactaagatgataaaaactaaatttaaacaagaaaaaatgtttaaagcaaacatataagcaatatgtataagtagtggttaaaagaaacgtcttaaagcataaattactaaatgagaaaagttataaatctacactcaagaaaaaaatggaaataggcatttaagcagcagtttggaggtgaaaggtttaaccccacagagcaaacgaattcacttgggctcaggtagctacgagcagcatcaggcacctcccagtgctggaattcacctattagaaacccagaacacccctaggaacctcagggaagatgctggggaccaggtgccggtcactgtgggccactagcttctgggggtttgcctacctggcactttaaatggtcactgaaggtatccaaagccaaactccagcacagcttggctgtcctcatcataacccctgtcctcatcctctcagcagaaacccagtaggtctgatggtgtcagtgggtttttgctttctactcctttagcctccttcatcacttaataagcattttgtcaaagaaatgagtgcatgtgattccaaagtcaaatggtaagaagggcatatcattagaaaaaagccccactcctaccctcttcaactgctcctagaggcaacccctaagaaccacttcagttttctttgctttttgtattttattgtttctttctttgttgtgtggatagtctttatttatttctgtagtaccatcttccctcccaacaaacatggaagaaaaaaagaaggggctggtgggaagaaatgccctgggggacacacctctccaatctctgcagttttgaagagggagtgttgaggtggaagtcttggggatatggggaagatggccagcccctcctcttgtctcccaggtggctcttggcagccttttaaagcttaaactcatcagttattttggagacgatgcttttaaaagacttggaagtctgggatatatgcttaaatggaaacttcttgagatatctccaaagcaattttcacacctccatcttccactgtactgagttctcttggtcccactgtggctgcatgcacagcagcatgcagttcttgtacagtctctggagtctgaaggagttccattttgtcttatcaatgatctgcacagctacctctttcctagttagggtgtgtcaggccaactgcatggtgaccaagttaccctggttgatggtcgtgatgagccagtagttgccaatatgggtatcctcagcagagatgcctgagaggtcctgcagtacgttggagatagggcttggagtcaaggtgtcccgaggtaggcttaaatttgggaaaagctgattaaaagcttggtccaaatcatgtcaaaagaatataacttccaaaatccacctgatgacctaatctttataatgaaatcaaaacacaatgccagagaaaaataaaaataaacaaaaacaaatgctaacacactaaatttaaaaagaaaaatgagaaaaaattcttacaaagtctttgtatagttttggtattagggtaatgctggcctcataaaataagttagaaagtgttccctctgcttctattttctggaaaagattgtacagaattggtatcatttcttctttaaatgcttgacagaataaaccagtgagaccatctgggcctgttgctttctgttttaggttattcattattgattcaatttctttaatagtataggcctattttgatgaccaatttctccttgttgagttttggtagggtatgtctttccaggaatttcatctaagttagcaaattagcaggcttggagttgttcatatttctttatttttcttttaatgtccatgggattagtaacgatgggcctctccttcatttctgatattggtaatttgtgtcttctctctctcttttttcttggttagccttgctgggcttggttagcctagccttattaattttatagatctattttattgactctattaatttttattgatctatttaaagaaccagcttttggtttcactggtttttctctatcattttcttactttcaatttcattgatctctgctctaattttaagtattttttttttttgcttattttggatttaatttgttcttttctagtttcctaaagtggaagcttagattattgattttagatcttaatcaatatatgcattttaatgctataaatttctctgtaaacactgcttttgtcacatcccataaattttgataaattgtattttcatttccctttagttcattttcacttagttctttaagtagtcacctctatgtcttctatttgcattatgtgtaaccttttagaaacctttgtgatgtaagatatgttatattcctatatttctctaaatcaaagttaatctcttctaagctcacaactctcccggctgatgtgaaattcatctggtctatgtttgagaatactccttcctccaggatcgtgcgcaaacctcaggatcatgttcaactttgaattggtcccttcaaagtgaacaactcagccacagtccagcatggacatcttaccccagggttttcaaggccatggttcttagtatcttcctgtccttgtctcagagctacatcattagagatctgtcactcctctagaagctctttattagtgctggttcaatactcacagaacctcccagactcatcccattcccaattctacaagcattgcccttcacctccaacacctttgagatgatgcaatataaccgtttcaaagagaggtcgaaaacaaaaatcctatgtgagagttatctttatttagagacagaaaaattgcagcttttgtcccagcaagtgaacaagagtttccgccctcttgggatggaaaagaaaatgaaaaagcaatagaagcaagaaaaaagcacacataaataccttgatcagttatcctttcatcttaatgctcctacaattattgcaaaacaatcatttatgaactcaaactggggacggtaacaaatttgttatgggctgggcacttgccatgctgtgtaaaacctgggtagattcatgtctcaagataatttttaaaaatgtaaacttcctactaaaaggacagcataaggcagtggttaagagcacagagtcaggtgggcacagtggctcatgcctgtaatcccaacagtttgggaggttgaggcaggaggattgcttgagcccaggagtgagagacctgcctggacaacatagctagactcagtctctataaaaaattaaaaattattaatagctgggcatggtggggtacacccatagtcccagctactcaggaggctgaggtgagaggatcgcttgagcccaggagtttgaggttgcagtgagctatgattgcaccatgcaatccaccctgggcgacagagcaagaccttgtctaaaaaaataggaaataaaaagagtgtagggtgtgagcttatcaaggttcacatctaaactctaccatttgctctctgcaggaccttgagcaaattaacttctttgtaactcagtctcctctttggtaagaaagagataatagtatgtgatgttccccttcctgtgtgcatgtgttctcattgttcaattcccacctatgagtgagaacatatggtgtttggttttttgtccttgcgatcgtttgctgagaatgatggtttccagcttcatccatgtccctacaaaggacatgaactcatcattttttatggctgtatattatccctaaaacttaaagtataataataaaaaaaaagaaagagataatagtagtatctgcctcattggattgttatgaataggaaatgaattgccatttaccattttagaacagtgcctggcacaaaataagtgctgtataagcggagacagacctagaagctgtctctatttaggtcatcttgaatggaaggatctctagttactcacctctgtgtgtttgctgctattttaaaagcctgtagacccttaaagttttacaacatcaaccaatattttattgattgcaaagtaatgggtggcctactaccagtggctatcagtatcagtcactggagtctggcacgtgcatgtgtatgtacacatatatgtgtatgacttgagaatagggtgtggtatgtggcttctaccagtataaagaagcatgagaagtgcctgaactcaggaagcagaggttgcagtgagctgagatcacgccactgcacttcagcctgggcaacagagtgaggctccatctgggaaagaaaaaaaaaaaagaggcagaaaagcagtgtgcaatattctgcagaatcgaggaatccatgtaaaagtaccatcctatagctattttcttgctaccccagggatcccattggtgctacacattccccagatggcaatgccaaccctgtctacttatcctgtattaccagcaaggctctgttcctcagtgaatttcctttccattcattttcaaatgacttttctgatatgagcattgttgaatatgcacaagaaagaggcagaggtatgtgtatggatagatttgcataagtataaatacagtatatgtacccatatttaaatgatataatgataatattgtgttgctattcagagtgaaagctaattaattcagctattgagatgataatgatttctttttcagttaataccagagtcaaaaaaccctgcagaatggttctacgcactgttcctttgactcatcttggaagaaagacctttattctgttaactattaagctgtctatcagtatctatgacagttttaaaggaaatcattcctgggaggggtagaagattattagtaggaaggctgactcatgtaggctcaagtggacattgaggtcatgatttggtaccaggaaagaaaaagtcctctttttgcttttagtctcttaaaatgcatgctttggtatttgcactctcaatatcaacactgatctgcagcacaaagtctttttttagactttatttggttggatttgacatttagaaaaatgttaagatctttcctactgaaatttacaccagctgaaaaattcacaagcaagtccatgactttcttaaccttgacatctctaacttttccttcagcctctgttttcatatttcatgagttaccaaaacctgatgttctctctgtttcctcctttctcttctgtcccactttagttcaggcattggtagcctctcagttgtattatggcaatagtctcctctctctagtctccaatacgcgttccacctttaccttgctccgaggagcttcccaacatacaggttaggtcatactgtcccctgtcaaagcctttaatggcttccctctttcaacatggtaaagactcaactcctttgcttggcattcaaggacacttaatcacattctgttcctgttacaactgcttacccatctcccactaattctctccatactctacccaaccgccaccaagatggagtatctaccctttcttggaattttcataacaccctgtgtttgctcatttttccgaatgtctttcctccctcatggtccatgtttctaaaaccttacttattcttcaaagcccagatcaaattctatttccttcatggacccctccctgattctggctactcttaattaatcaggttcactcccagtctatacaatgccttttcttcggggcgcttgacttctagcagttgggaaatcctcatattatacttatcttgctagaacaatttttaagtgccttctgctggaaaattgtcataagaaatatgcagctctacatgggtgcagtgtaattgctgcctctcctccttaaatgtggcacaatctttacaagcatatggtgtggacctgcttctacatttcaataatttattccttgtttagctatctcatcactcatattttatattatgctgtaaatttacttctgtttattccaactaagtatgcaactctgaagacaaggaatgtcttattcatcttggtatttcccaggtcagagaatgcagctttcagatagttggtacttaacagtaaactattttactctcttgtaacccaagggtggcaattgcaagatagtaaagagtacaggctttagtgcatgactgcctgggtttgaaccttcctagccaactactaaccatgtgatcatggccaagatacttaaactctctgtacctttttttcttcatctataatatggggacaaataatactatcttcatcataaaattgatataagaattacatcagtaaatggaggtaaagtagctcaaacaatagctactaggtgcttaataaatgttagatattattccaacagtctgttaaaataggaaggactcctctcaattttgacagagacatgaagacactagatgctacattccaaggtgagcccatctggcagaaatttcacagtggatattcaagaaccagttaaacatctcacttattttgagggaatgaagagatcaggagttggaaattatagagaggtcttataaagattttggagcatgtgactagtgtgctgtgtgaatcttacatccctactgcaaaggagaatgttggaaatgggagtgtctgtccctcgggccaccactggaacgtgtagtaactttgtgagaattggaaaatggtgtcccctcatgcccccaaaatgtatactaaagaggtcctgttgccccaagcccaatgaaagagtcttcaagacgatcacttgagtaggttgacatgtatcccctgaagctgacagacatggggactttgtgtctcactttcacccgagaagttgaaaggcaggaagccgggtggctgactgctcatggataaatgggagagatttctctgctccacagagattgttagatcagagaaagccattatggggttatcttaggtccatgtgaagagaaccacatagagtgacctcagtgtaaaaattgtggagtgaatcgccagattcctagatgttgaaggagacacataccatgggctagaatagatatgtatttgccctcatcaaaaaagttcagatgaggctgggcgtggtggctcatgcctgtaatcccagcactttgggaggctgaggcgggcagatcacttaaggtcaggagtttgagaccagcctggccaacatggtgaaaccccatctctactaaaaatacaaaaattagtcggccgcggtgggcggcgcctgtcatcctagctgctccagagggtgaggcaggagaatccattgaacctgggaggcagagactgcatgagctgagattgtgccactgcactccagcctgggcgacagaacaagactctgtctcaaaaaaacaaaaaacaaagttcagatgaaagtatcccgaagatgagaggtctctaaacaacccaacccaatggagaaagagacaactttgaaaacttgctatgcacaaaccagcttacagaaatactaggcgagtaactgccttcctgtcatttcttctcttacctctcacaatcctctcctgaattcaacactgcctccttgactctgaaagtgtcaggaactgtggttagtcagatggaggagaaagcagaaagtggggaaatggagcagcagagttgaagtcggttacctcccttcttcactctaggcatcttacctgttaacaggctgcagctgtgctataccttctcgggggagatggttgcttttagctcaaggttggcatttttattattatgccaggctggcatataaagtactgaattgaaaccttgaatgcgattttctccctgaatgcctggttaacagcaactcactttccaaaacttagctcagtgctcactccctatcctgacctcttcatcccaaactgaggaatctgtgtgtctgctctgccgcagtgcagcttttagagcccaggcaacatgtaatttcacttgtttagttgtttgtgcgtctttgtcctcagccagcctttaaactcttggagcccaggggtgaattgtttgcctttgtaccctctgcacttagtgctcactggcatagaattgtcccccaataaagatctatgaaagtaatttgtcttagaaaacaaattcacatttttcctaagagaggctataattcaaatttgtctttatttctgagagataaattaaaaacaacaggcttctcaacaacacaatgtcacataaagtatttgtcactggtgtgctcaaggatggcctgggtgctctccagcagttggtgagaaaatgtcctggcatctctcaatccaaacctgtttttttcctgagaagctgtgagaggactttttacacttttcagtgtttctcccacaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgtatacaggtattcacttcaagcaattacatttcactaaaaatctcttaaggaggcagatgtcaggtaactcatcacgagagtgctacttcacatattaaagaaggaacctactaagccatctaagttcttgaaaagggtaatgaaccactgaaattgtccaaactgtcaactaaagagcattttagtcacccgaaagaaatgggttttttttgttgtttttctttgtcgcagtgaactatacatggagcccagtggcattaacataccattcaaataatgtgctttaatgagctacgaatgacatctaaaagtttcctctaaatttgattttaatatacttattatttattgcttaattagcatacaaattcactattgtggaaaaaaatgagaatgctttataaggtataactgcctctgaattgtctaaatagagttctaaaccaagtcattttattaaggatctgtcttctcttagtgcagctttgaaccaatttgtataggtttacacaggaaattaactactcccagttttaatataattttgtctttctatctgataaagagacactgtattaactgctggctttgtgaggaactgtaatcttcatcaaaaattggaatgcatgctagtatataacataattaatttttcattctgcaaattctacagaccactcagattctgagatatgtcctgtttctcctcaaaacacaaatagacaaatgtcaccaaggggatgacagcattcaggcagggaatgccaaatgaaataaaagccttcagaaggtgactccagttctattgttaccaaactgtacgggcaactgggatggacccagggaaataatgcatgcaggttgggggaaaataggtctgtgtaaataatccagctctgggtggatgaaaattttatagtagctgatcacaatctcatcttagcatacatgaaatgagaacctgcaataggggctgctgctggaatccaatcttgcaatggaaacacttactctgacactgcacagctcatatagctcatcacttaaatatgaacttgttccagctggagcgctgaggacattttgcatgaagccacatatagcagtctataatatttatgaacacaaactcatccagtaacagatgcggatatttcatggttctataaaataaattccctgtacaaagaaattcctggaactttgttttattggcattgagaaaagagtaaggacgttaaatgggatgaagggaagattgttttacattatttttaatagctctcttttttttttttttgttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccactgcgcccggctaattttttgtatttttagtagagacggggtttcaccttgttagccaggatggtctcgatctcctgacctcatccacccgcctcggcctcccaaagtgctgggattacaggcgtgagccaccgcgcccggccttaatagctctctttaagtgtaaatcaatgaggttgattgtatgatcattcaaagacattttaaaagtcaccttgtattatttttatttttaactgtattctcaggaattggcactgttcttaaaattaacaggattttaaaaatttccctaaaggatgttaacatttgtttttctcaataagtttatatgtatttaatgtgaaattcaatatccttcttctggtacagtatgtaaacatggatgaaaataatattaatggcatgttttaaaacaccaattttcacagtcccctagagcaggaacagggagagtgtcattcaccttttcattgactgaatcccttgcatttgtacaatgctttcatatcacaagttctttatataaagctcatttaaaaatgattattgcttttattttgtgtagattattgcttttaatctacacaaaactctatgaggtagatattattcccattttacaaatgaggaaactgagactcacagaggttaaactacttgttcaaggttaagtctcaaaccttggccttccctttctaaaatgcataaaaggctagcgttagttctgtgccattgcataggggatcttctgggccaggtacatatcagtggttttatgaccacacacccaacagtactttctgtgattggtgaagtctctatgcttatttgttttaggcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggtaataatatgcaatggtgtctgccaagactggcaggaactgagtttctaggtacatagtgagctggccaggaggctttcaaattaaagccacaggcacagctgaatttctagtccaattgttcattaaaatggattcctaatacatgctttgatgtaaacattcaaatagtagcaatgcataaactaaaaagtgaaagttttccttctctctgactccattccagtcctactacctagtgtttgccagcagaaatgatttggtgtataaaatggattttttccaactgagtattgatgaccattttttccctctttttgagaagacagtctcaaactgggaagaacatggtctcaatagaggctgtggattaatccttataaatgagtaaaacagggtgaatacacgtatgtggatgaatagagaaaagtcctacccactggggttacaaatttctcaagaaatccattgagcaacttaggacaaaataggggaacagcatccaaggtgtttagacacacacattgtgataatgcacaggacatttgatggaattttattttgccattagctgaaaaaccagtaagctatgattgtccaaaccacacccttctcaatatttattacattattgacaaagaaaactttatccacatttagttttacaaatacgtatttttgtatttatttaagaaaaagtattttatatgaaagcattattttgccatagtgcttcatcagtaacactttggtataagaaaacaaagagttgacataattattcacactcttcaaaagatgctgtagagggagaaagagatgtttggggtctgaattgtccagattgttgactctctattttaggggttgacaaactttttttctttaaagggctttggccacatggtatctacaacagctactcaactctgccattttagtgcaaaagtagcagagacaatacataaacaaatgagtgtgactgtgttccaataaaactttataaaatccaatggatttggtccatgggccacagtttgttgatccctcctccacatgaatactctcagatgacttcaccaggtggaattcatgtagaatagtatatgaatatagtattcatagtagtcatactatatgaaaacctttcattagttataattaaagcttgaactttcagtgaccttcaatatgaatgggctcaatagtcttcatatccagactaccatttattcctaagaaatacacaagtggaatattttgttattcatattttatagataggaaaattcagtgaaatgtgatatggcctgcctgaggacccagagaaagaaattatacactctcttagaactcatagttcctgctgtatttatgcctttttttttttatgatttctgctattaggtccctccagatgaatgcacatatagaaagaaggctttatacacatcttccctaacaccttttattttcttgccagtgtaggagaaaactgaactcaccccagatcaacagactcttctacattttattatggattcatataacaaacagaggatgcctcaggaaataacaaataaaattgtatgtataatatctgaaaatatgtgggtttaaagttaatattttctggagtttttattgccttggaggtataatttatatgtgaatatgttactttgaaatgattagagctgagaattcaagttagacttttaaactctcagcaacattaaacaattcaagagtatgaagtctcccacctatcttgataatggtaattgccctccaaagatctgagaaatagtaagatgggttttcaaattttatcatctaaacctagtttttctttagtctaatggttttatattatcattttcttatctactttttaatcattggtttttttcttaaaatttagttaaaagaagaattcagtgcagaagaaaattttctcattttgacggaaatggcaaccaatcatgtacaggttcttgtagaattcacaaaaaagctaccaggtattttttaaataatcaaagttaatatttattgagagtttaaatatgtgcccacagattagattacctattttacatacggtgttttaattttcaaaacattcctgtgagatcagctctattttcactattactttgccaagtattttcacatgtacttatttcactgctattctctacaatagtcttgtgacattgagaaaggcaggtctgttctttgtaaaatgaaaatcatttaatatctgatttaaagtaactgtcgaactactatagacataagatattagaactagaaaggatatttaaaataatgtataataattctttcaaatcaatagattaaaaattgaaactttgcaaagttgtcattcacccatttattccttcaataagcaattgttgatacctactctatactaagtgcctggctattaccttcagggagagtgatcaaaggtgataataataatgataaatacacatacatacacatacacacgaagtgctgtttgaacacagaggaactggttgctaattgtgtctaggaaagatggagagacttcagggaggatcatatttgagttgagtctaaaagaaaaagaagttttccagttggcatggagaagcagcagcattccaagttgagagatctgcttgtttttttgtttttgttttgttttgtttgagacggagtctcgctctgttgcccaggctggagtgcaatggcatgatcttggctcactgcaacctctgcttcccgagttcaagcaattctcctgcctcagtctcctgagtagctgggactacaggcacacaccaccatgcccagctaatttttgtatttttagtagagatggggtttcaccatattggacaggctgaattcaaactcctgacctcaagtgagctgcccgacttggccaaagtgctgggattacaggcgcaagccaccatgtctggccgagaaatctgcttgttataaggcactgaggcatgaacaagaataggattatttgagataggagagaaaattcagtgtggttatagtatagtgtctgtggtgggctcctaggttagacaataaggtaagttggtaccagactgatgaaggcctaactaaggaatttaatctgtgtaccctggacagtaaagagatttcggtggtttttgtagcagagggaaatgaagtttttgttatacagaaatgacttaatcaggttcatgtaagatgaatttgaatggaaagggtctgggggcagggaagatcaagtagtatgctactgcacaagtccaggcaacagggcttgaaataaagcaatagcagtggggaagagaagaagaaacaaaaagaagagagattcaaaaatcgatagggcttgaggaacagttgtatgtgtaaggtgagggagagggacttacttatccacactcattctgatggtgccagtatagaaactagaatgtgggagtcttcttatatcccagcctcaaattctttttgccacattattaatgctatctaagctaatgggttttagttgtttcagtgtttattaaaatattggtgtattgaaatcccgtagtctagaagagtataataaataccttgtatagcagcataatactataatattaaattatagaagataacttctgacataggattttagttaaacatgttaatttgccttctttttgccagcattatgctattattttattaaatgtgtcacagatagacataagcctacataaaactcataaagtgtgaggagaaatttctcactatcattgaaacactaatatgctctcatttctttattaacaatgaaagaggaacttaatttactatatgctaattaaactgaaggcaagctcaataaaaaactggattatataagagtaaaaactgtggaggaaagaactggaaaaaggagatatttttggttatttatgggaagagattttttaagttcaaatggtcagttggttttgaatcaagaaataattgaagacaaataaaaaccttattcataagaaggtagcttatctgaaagcaatagcaatatcttggcatctcttaattcccagtgcctagcctcgttcctgagggagcaagtacaattagtgtgtgttcaatgagtaaagcagaaggaaaaaatttaaaatatggaaagaaataaaaggcaaaaacccttgagaaggaaaaaaattgacaataatgacagagatagcattattacaagtagtaacaatagggatataataccagtactgaagggatattttgtgaaaaactgaattgaatcattccattcagtattcattgagcacaacctgtgccaggcactgtccaaggtgctggagtccctgagggcaataagacagggcccctttcctcaaagaagctcttagattctctcggatggtggctcaatttttagcgttgctctcttctctatactccctttgctatttagttcttcccaagccatttaggccctgatggtgttatctctattcatgtgagtgtatgtgccagcatgcacatgagcttgtgttttgtttcccattcattcattcaatctgtcaattatccaacaaataattcttaggtacctattatgtgccaggaactggggatacaaaagtaaagaaaaacaaggcctctgcccccaagaaatgtacactccagtagaggtggcagacaattaacaaataagcaaataaatctataatatcatgtcgggtggtgataagttctataaactaaaataaagcaggtagagactagtagtggtggggagtgtattttagattggggaatgctggagcagaggcttgattgcaggaaggagcagggcatggggcatggggttatctgggaagaacattaatctctgaggcaaaaagaggcttgtgtgttcacagcagggccaggtggtcagtgtggctggaacacaaagagtagagggaatgaggagtagaaaatgagttcagagaagctgttgggactgtactatttaagcctggataacaactttgaattttccagggagtgttatattccatcaggttggcaattcttaccatatttttctgattttcccccaccctgtgtgtcgcagtgctgagttcagagcagatacatcaacatgactttggttggctgtttttgggaaatactacccgttctttagcttgactaaagactcatgagttagccaaatattctgggtgcatataaagttttcttctggcttgtagatgcttccaatctgcagagttgaccctgtcacatcaggtgtgactaacataatggctcaaagaaaatctacctgtgtctagtttctgagggtttcttcatctgaatcagtgtatctatgccataatatatgtatctacttggacttgacatctccctttgcccagcttgtttaataaattctgctcaatgaagataaaagcctctattttattggcgagtacaaatggactcaactagactacccaattttaaacaactacagaatcacttgatgtaaatgttttatcaatggcaatgatggtgatcatgaaatattgttactccttgataccaatttgattatcatcattacctaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtaagtgatttggctaatggtaaaagagtttgtttctaggagtaaaattggtgtgcttcatgagggtggggctcttgccaatcttatgcaatgttatatgcctgttgtgcctagcatgaagaatggctctaaaaagatatgtgttaaattgataagacttctagaggcttggttcaaatatctctgttgtaataacaaagtagcaaaactacccctttactgcactaagatgaagagccaaaggaagacttttttaaagattggaaaattcatctgattttgaacaactagcacaaaggagctaggattcttcagccaagaaaaagattatttaaaatcttctggtatgtaagactaagtatccagctattatatatctgtatcaaaataaaataagaagacattttaatagcaacatttatatgtcatttactaggtctcagacacttttctttcttttttcttcctttcttttttttttttagacacagtcttgctctttgcccaggctggagtgtagtggtgtgatctcggctcactgcagcctctgtttcccaggttccagcaattcttgtgcctcagcctcccgagtagccaggattataggcatgtactaccacacccagctaattttggtatttttagtagagacagagtttctccatgtttcccgagctggtctcaaactcttggtctcaagcgatcagcctgacttggccttccaaagtgctgagattacaggtgtgagccaccgtgcctgactaaagttaactttttttttcttttctttttttttttttgagacagaatcttgctctgttgcttaggctagagtgcagtggcatgctcttggctcaccagtttcccctgggttcaagtgatttttttgtgcttcagcttcccaagtagctgggactacaggcgcatgccatcacacccagctaatttttgtatttttagtagagacagggtttcaccatgttggccaggctggtcttggactcctggcctcgagtgatccacctacctcggcctcccaaagtgctaggattaaaggcatgagccaccacacccagccggtttcagacacttttctaaatatatgatttcatctaatcttctcaaatattctatgaataaatactattatcattcccatttttcaaatggaaaagctgagacagagaaaggttaaataactttcccaatgacagagaggaagtctgacttcagaagctttgtgtcagcccaatgcagtggctcacgcctataatcccagaactttgggaggcagaggggggtggatcacttgaaatcaggagttcaagaccagcctggccaacatagtgaaactccgtctctactaaaaatacaaaaaattagctgggcatggtagtacgtgcctgtaatcccagttactcaggaagctgaggcaggagaattgcttgaacttgggagatggaggttgcagtgagtcaagatcgtgccaccacactccagcctgggcaacagagtgagactcagtctgaaaaaaaaagaagctttgtgtcttaaccactatgctatagtacctctcaagagacgagataatagcacaagttactcagtgtttaacttattgtggaataacactgtgacagggaagctcaagagacattgagatgaattaccaggaattctgtgcaatttatcttaggagatccttaagataggatgagttcttattttcccgagagatttcatatatgggttgggagtggggaatgaatgagatgacttctcaggatgttttctttctaaagtcttatcattaacaaaagcaaatttaaagacttttaaaaccgatattttaagatagagattagagggaaagttttcaggtagttctgcatctgtgatataagtgaaataattttttaaatggaaaattatttttaaaggcagtttctccatagtcattatgtttttttcctagttaaaaacaaaaagcataattagcatcattggtagatttaaaaaccacacactttaaaaagatgcattattcttaatatattaatttactagtctaacaaatatttaagggcaaggtactatggtagcagtgaagagagaaatcaagcatgttctttcccctaagaagcttacagtctaatgggaagagattaactgtccatgattatgataaaatatggaagagaaaaacagagagatgatgactcctagttgagagagctccgaaaaagttttattggcatttgagctgggacttgaatgagatttgatttggatatccagggtgcaagagagaaggaccagcaggagcaaagagaaagaggcaagaaagctcagggaatgcacacaaagaagggtgagtagctgagctgactgaattgagggttacattaaagggaaatagaaaggaataaaagaatcagatgattgagggccttggatgctgggctaatgattttgttatttcccaagtaataggagagatggaagatttttgagcagaggagggaaaatgtcaaaattaagctttacaaattttctagcagtgttagggtaagccagaacagaagtcacctcttaggaggcaagaagtctcaaagatgtcacgcttgctgccaggagaaatggagagaagagaaaggatctgggagatatatcttcgtggcttatcaacttttgaaagacattatgttgtcaagaaatatggattttggttctggacagattgtgtgtgtgtgtgtgtgtgtgtgtgtgtccaggctaaggggaaaatgttgaatcaggtaacctccaaggcaccattcagttctacaagtcttactgcttttcctctcttaaataattcaattttcctgatgggtggtttagctagtcactaggccagctactgaagtatcctgattttaaagccataatcaataattgacagttcaacttaggaaagaattaaaggacaggctgaattttcacatgtatgggtataattgttgttttagactattgaacatacactggtggttctctctttatgcagaaaactacaatggcttcaacaggttcagcagcttagctttgtcatttatttgattctggcttccatggactgtggcggtgctccctttaagaaaatcccagttggccgggtgcggtggctcacgcctctaatcccagcactttgggaggccaaggcgggtggattacaaggtcaggagatcgagaccatcctggctaacatggtgaaaccccgtctctactaaaaatacaaacaattagtcaggcgtggtggcgggtgcctgtagtcccagctactcgggaggctgaggcaggagaatggcgtgaacccaggaggtggagcttacagtgagccgagatcacgccactgtactccagcctgggggacagagtgagactcggtctcacaaaaaaaaaaaaaaaaaaaaatccatcagtcaaatctaattcttacaaaactaataaaataaaaaggaatgatgactcatgacaaaacttattcattttactgacaggtctctactctagggaatgtgtgtttggtttattcatcaagagacagtggtgattaaggatactgactgtggaatctggattgaatatgggccccactacttattagctacatgtcccatttttttaaagctgttgaaatagacttcataaccaatttgatctctttgaaatcatgtttaactttaatatttattctgcagtcttgcctcaagtttgataataaaatcttgataagacagggttttcttctttttgagtcagtattttatcccaagcacctagcacatgcctggcttggactgggtgctccacaaaattctgtggaataacgaaaaaaatgaatgaaggtttgtccggagctataaaactggtctgtttatttacttttcagatggttgtttccctgaatatcagagttgttaatgtccaaagctaacaagtaaccaacaaaaagttggttaaacattcttctagacattgcctgtagtagttaatttggggaacagatatcttttttgcatttgagtgtaagaaaaggaaaaagacagtttggatatggaagttctgttgtgttctctctcctcctcctcctcaaagatgagtcatttaaagttgattcaggtgccagacaatgaaaaagaggggtgcaatgtctgccatatgaattgaaatgttttgatgagagggcatctgcaggagaattatctggtggttgttctatctttctttctctgtctctttttctctcctggatgctcagcttcctttaaaaaaaaatctttgcctggctccatcagatctcctgggtcctgagccaagtcagatgctgccatttccatgatgaccactgggttagtaccagattccttccccagcctggctgaggtggggaaaatcccttccactgtggttcagctaaaaggggaaaaatagtcttccaaaaaagtttacaaggctactaagaggagaattatgtttatagaaaggcatatataaggctgagcatgctgactcacacctacaatcccagcactttgggaggccaaggcaggaagattgcttgagcccaggaatttgagaccagcctgagccacagagcgagactccatctttacaaaaaagttaaaaaaattagctgggcatggtggcatgagtctgtaatctcagctagttgagaggctgaggtgggagggtctctagagcccaggaggtggaggttgcagtgagctgagattgtgccactgtactccagcctgggtgacagagtgagaccttgtctcaaaaaaaaaaaaaaaaaaaaaaaaaaaaccaaacggggggcatatatgcgtaatgtctggatctattaattacggcaccagaaagataattattcagcacctactgtgtgtcaggctgtattatcagtgtttgtgtgagctttgggtcctacaagaagcagatatcaacatgggactaaatatgtcagaagttaattgggggaaatgcctctgaagaataaagggggaggaagcaggtggagtccaggagactgtacactactatgctgatctgacacctgtgaaagtggagcaggaaggcatgattgggcatgaagagcatcagatcacagcacagtcctgagaaagtctcagctaggccattggagagggacctagtccgagctgcccactgaatggacaagcactaacacacccactatgctcattcaccagttgagacaagactggtgaaagtgtgtcctcagcactcacagggcggcagctggaggctatcagccagccagactccctactgtgggctgtctttaagggtgatctgagtgggtcatctccatggctaacattttgcttcacgaaaaatattgtttgctctttgtagcactttgaggtagatattatcaattctatgccagacctagaccctgttaatcccaataacaaaatatcagtcccaagtatctgttccctctgatattactctctaactttccagcttgccaccttccagtaccctgactctagggattctttgttccaaatcaacgtccattgccgggcgcggtggctcatgcttgtaatcccagcactttgggaggctgaggcaggtggatcacgaggtcaggagtttgagaccagcttggccaacatagtgaaaccttgtctctattaaaaatataaaaaattagcctggcgtggtggcaggcacctgtaatcctagctactcaggaggctgaggcaggagaattgcctgaacccaggaggtggaggcagcagtaagccaagatcgtgccactgcactccagcctgggtgacagagtgagactctgtctcaaaaaacaaacaaacaaacaaacaaacaaaatcaaaaatccatttgttgaccctccatccactaaccctccagccattgactctacttccttttgcctgaccacactttcctcagtacttggcttagagttcgtggttcatcaatatgatcatttccttagatcattcaccagatatcctcaactctttgtctttctttcacctaagaaaaccctctgcctgactgagtacgactcttaacctactctgtgcttgagcctgagaactgaaacagtatgactggcttacccaaagttagtgatcaaacacttcaggtggacctcagtactttccatgtatcccttttctctagccaattcactcttatacttatggaaaattgtcttgtaccttctctttcttcaaatttccaacatctcttcccactcattctcaactataactttgttgagaaaaggtgtctttcaagaacatgccataggagttggagctcaaggatatgtggtcaaaccccagcttcaaggaaatgtaatcaagcttagagaaagatgaactccccgagcttagtcaatatgtcaagacagagattgtcacaagaaacaaagctggagccaagttcctagaattagatgcacacagagctccccagggttttctgagagttgacttcatccacatgatccactatggctccctaccattttggtaacattccagcaagtggggagggcaaaggggaaaaagagtggcacaccttccctttaaaggaataatcctgaagtggtatgcacaacttcacagagttccccagagttttctgagtctgggtcagaattgaaacctgttgaggcaagtggtgtggttctagccgtgaagacacaaaagcttccaaaaccaaagtcaggcagttacaccttggggctcccatgatttctggctgccacatattgctggagcctctctgtcacaaatcagctacctccaacagaagcaattgtcttattcctttgttttatttatttatttatttatttatttattttgagacagagtctcactctgtcgcccaggctggagtgcagtgaccgtgatctcggctcactgcaacctccgcctcctgggttcaagcgattctcctgcctcagcctcccaagtagctgggactaccggggcgtgcccccatgcttggctaattttttgtatttttagtagagacggggttttaccatgttagccaggatggtctcgatctcctgacctcatgattcgcccgccttggcctcccaaagtgctgggattacaggcttgagccaccgcacccggccctgttcctctttttattatattaagcactttataaacacttgttttttgcctgaagaatacttatgagctgagtgcggtggctcacacctgtaatcccagccctttgggaggccgaggcgggtggatcatgaggtcaggagattgagaccatcctggctaacatggtgaaaccccgtctctactaaaaatataaaaaattagccgggcatggtggcacgcacctgtagtcccagctagtcaggaggctgaggctggagaattgcttgaacccggaaggcggaggtttcagtgagccaagattgcaccactgcactccagcctgggcaacagagcaagactccatctcaattaaaaaaaaaaaaaaaagaatacctctgatgatcagttgtagggtagagatgatttgcatcccctaaaccttcagaacaggcaaggctttctgactcatgtcatctctcatcagaatatctcctcatatttctcagggtggtggctcattagcctccctcctctcacttgatgagacacttagcttcgaatcttatcattttcatttgactctgcctgtagggcaactatccggtagcaatggaagatcatttccattaggacctgtatttgtttatttgtttacttttttttaacaagcttttattgagtacttctatgggataggtacactggcggtacaaagatgaataagataaagtcataatcctcaaggacttcatcttctaggggaaatatatttgaaaagaattaatcacaatagatttcatgcataatttaagttagaggtttggctgctgtaacagagacaaaaaataaagagtgcttaaacaagatggaaatgtatttctatcttatactagtctgggcatgaggagaatgggactgatagggaatcttcatagtgtccctctgtgtcatagttctatccatacagatggatgtcatgctcatccatccacagagagttgacttcatcttcttggtccagtatggctccccaccattttggtaaaaacacattccaggccgggcacagtggctcacacctgtaatcccagcacttcgggaggccaacgtgggcagatcacgaggtcacaagattgagaccatcctggctaacacagtgaaaccccatccctactaaaaatacaaaaaattagccgggcatggtggcatgtgccggtagtcccagctactctgaaggctgaggcaggagaatccctggaacctgggaggcagaggttgtaatgagcacagatagtgccactgcactccagcctgggcaacagagtgagactccatctcaaaaacaagcaaacaaacaaaaacacattccagcaagtagggagggcaaaggggaaaaagaatggcacaccttccctgtaagtgaataatcctgaagtgttacacataacttctactggcattccattggcaagaacttaacttcttcatcacaccttgagacaagagacctgtaaagagaactactaatgcaataactgggtgagaaatgatgagggtcttgctggttagaatgcatataatcaaaaagaaaaaaatcttccatgtaatttcataagtttcagaacttgtgatacctcaagtttcagaaaagctaaagaatgaagttttccagaatatgatctgtataaataaatatgcatgtttctagtttataataagatactttctccaaatatcaaccatatattgtgacaataaaaaccatccaaactcacatgctgctgcatattttatctataatgttttcatttattaatatttatgaatttccttctcccagtgggttttcagaacattgcctcttccacacaacacataaaaacctgatctcgcaagatgacctttcagactaactttttattcttatgctaatacaatcattcttatttctattatacatttaattccagagtaacataatgctcaaagttactctgtttatgcctatgcaactctttaaagaatatgatgtgaaatctcttttcttgttcttcaaattcatactcttttgtttgctgttattaaatcccaatcacatacacaaagataactgtctctgagatgcttttaatgagaattagagtatttatgttaattgaggctttagaacgtatatctgatataatttgtgcttgagttgtttctatacaattctagtgcatcattgattttattcctaatgtaccattacttacaaactaggggtttaagttggaattgttaataaaaataggaataatcatagtatataaaatattatagactgaaataggtttgctaacactgaatgagtttatattttgttttgttttgattttttttgagacaaagtttcattcttatcgtccaggctagagtgcaatggcacgatctgggcttactgcaacctccgcctcctgggttcaggcaattctccagcctcagcctcctgagaagctggggttacaggcgacaggcaacatgtccggttaattttttgtatttttagtagagatggagtttcaccatgttggccaggctggtcttaaactcctaagctcaggtgatctttccgcctcagcctcccaaagtgctgggattacaggtgtgagccaccgcgcctggcccaagtttacattttaacattaaggaaattagcaataacctctcagagatcaaagcaacttgttctgtccatttcaaatataaataatccctgacatttatagtagttttgggcctttttccatccccacaagggacataaataaaatattcaattcagtaagaatttaccagtatgacaatatatctcatgttttgcaatgttttgttttcacatgcattatcctgttagtgctgctcccaatggccctcactaggtgagtgttatttataaaatatcctattttatagatgtagaaatgggcttagagaggcaagatgacctgctcaagttcatacagctaatcaaaagagtgcgaggaaattaaggtgggtattctaactcagagcccagcactctttctatatgtggcatctgtcactcaccaatttctaatatttgcccaactatctgctagcagggaatataaagtaaaacatggtttctgcccttcagttgagagataaagtataagcagttgttagcaatttcaaattgctttaagtcagtgatcaaatgaatagacaatgaagtcagagaaaggagataatcttgttagggtgatgaagttgtagcccttaatagtaccatactaaaatatactgtgcttatttttgttatatgatttcactgctttagccttttcagcttgcacaaaatgaaaacagttaccagaactatgttttccaaagatgcaaatctaagctgattatcagttcagatactgtctttgagaggggttagaaatgtaaagaaacaaatgatagactatttataagaagggtaaatgctttagttaaatttagaaatcttaacacctctacttttgcttttgaaagtggtcacatgctaacttttgcatgggcaaatttaggactcaaattataggaagaaaccttccttggattaagaggaaacattaaagaaatacaagtgaggttatttccattgcccctaggcagaatccattgttcctcagctgtatttcccaagctttttgtacttgctcggttttagatattatgtatttatttatgtcaagtcgccccttggtatccacagaggattggttctaagatctctcttggataccagttaatggctgctcaagtccctgatataaaatacaacctttgtatataacctatgtacatcctgttgtatactctaaatcacctccagatgacttataatacctaatacaatgtaagtggtatgtaaataattgcttcactgtattgtttagggaataatgacaagaaaaaagtctgtacacgttcattacagttgcaatacttttcccaaatatttttgatctgtggttggttgaatccatggatacagaacccacagagagttaactgtatctgcttcttccattaacctgttaattgcctgaggacttcatattcccagattcccagcactaatatagtgcctgacacatagcaggaatacaaatattggtgaattttgttgagttgaatctggaacttgacagtccaaactctggtaactcctaagccctggtgagacctaattaggccggatagtttttagccactaggactaatgggaagcatatcatgtattatatattttaaattaaatattttatacttaaagtagttcttttttgaattgctagtttgatggcagctgtttacttaggaccaagagtatggcacaaatgactccctggggaaagtttagcagttgaaatagaggacatagtccaatctcttagcaccacaagaatatgtccattgccttaatggcatcccttgtccccatcacatctcacaactatgtcaccttcatcataaagaactacgaaaacatactactgcctgatttaacatgcatttattaatctcctattatgtcttcagaaggatgctagttattagagatgcagaggtgaataagaaatatctggccagtcacagtggctcactcccataatcccaacatttaaggaggccaaggtggaaggattgcttaagaccaggagttcgagaccggcctagaatacatagcaagtccctgtctctacaaaaaataaaatgtctggatgtggtggtgcatacctgtagtcctagccactcaagagactgaggcaggagaactgcttgagcccccaggaggccaaggctgcagtgggttatgattgtgccactgcactccagcctgggtgacatagccagattctgtcataaaaaaaaaaaaatctatggagcaccctttatgggtcaggcagcatggcagccactggagataacagtaactgattcccactcttcttttttttttgagacggagtctcgctctgtcacccaggctagagtgcagtgcagcgatcttagctcgctgcaacctccgtctctcgggttcaagcaattctcctgcctcagcctcctgagtagctgggactacaggcgcgtgccaccacacctagctaatttgttgtatttttagtagagatggggtttcaccgtgttagccaggatggtcttgatctcttgaccttgtgatccgcccgccttggcctcccaaagtgctgggattacaggtgtgagtcactgcgcccggccgattcccactcttataaaatgtatatggtatttcacactccagtgagaaggagagatatgaattgtgataagttgcaatagaactgaacctagaaaaggaagtaactaattctgcttctctgtgacagggaaagctccatagaggaagcaaaatttgaacttggccttgaaccatggatggggtgccttagtctaacagggatcctgccttgtatttcaggaaaaagcatgaagacataaaaagtgtatcccacttgttaggggagctgtcagaatgctcttggccgatagctacagaaaataaactcattatggcctaaaaaagtaagaaaatgtatgagctcaaacaagaaacccagaggaagggtgacagcagaattggttaatttaggggcagaacccaccatcggaaacacagatccatctcatctttctgctttgctatccttggcgtattgaccttccccacaggctggttctcctcctggtcatctaatggccacagcagtgctaggcactatgtctgggcacaacactggtcaaaggaaaaagaaatgctgtcttcctcagtatggaaatctttcttaggaacttcccagtagactcccctttagtctcatgggcccaaatttcactgctgtccctaactacaccaacctctgatgtgggaaatgagaccaacagtggctggaccttgggctggagctgggatttgcctctaccatagtgtatggccatggggcagggagggggaagggagcctgtgcaggcaacaagctgaatcagctttaggagccttagatgaatcggtgttattagttcctagggaaactattgggctgctgagagattagtttgaaaggaaagcagaaggcagatgtggctttgtgtgccgtgtcagggatttataccttgacctctgtgctatggagtgatgtcatttctagaaaagtttcaagttacatggttttaaggaaatagtatcatttttaaccagatgctcagtccatcttgaggacgtcatcagaataagtcatatagaggtatttaagatactaggatatatgtctagtgtaatatgcatacttgtaaataacacacacacacacacacacacacacacacacctgcttcatttttgttcccaattacgactagaaagctaattaggaaataaaaacttttaacatttaaaacacctaaagcagtatagtgttaattctatcaaatggttattctctcaaagaatatttctgatcattgaacataatttattaatcacagacctctttttaaaaaagggaaaacaaataggaaacaggagcagaaacataacattatttttgcattttcagacttttccatggcaaagtctttggtagttaagttagaaaatagcccccccttgtgaccaaaaatcaggtaattggtcattcaagcgaaaatgaagcaaattttaagcaattctccaggaagaaggaagcaggaaaacaggaaaaggctgtccccttcaggatgatgttagtgttacatctccagtgttagaaattgctggttcacaagccctttgtttatgttggcatggttaactctgattgttgactctaattccaaaagtagatttatatttatctatcttgtaggaaaattattttttaactctcccattatttcttttttacattttctctatattcactcttggcttttacaacatgcacaagatgaaataatcattttaaaaactttaaccttattttccccaaatgttatcaattgtaattagatagctaatggaggcaacatctctggagggtgtgtggggatttagaaaggcaaatgaaataggaaatttggtaatcaaagaaatttctaaaaattttaatattttcaaatcagctgtcttgaatatccctaaatcttcatgtactatttaatttaatggcatagccataaattattattttaggtaaccacaactgaggagtgtagtctctgaatgctgaagaaagcataaagattgacatttttttgaagatgaaaaagaacagccttaccaagaaaatagagaacttagtttagctttaatacctggaaaaatactgaagcaaatcactgatcagccagtttgtatttatccccagtaatttgcagaatttgttggttttttaaaacctacatggctttgtaaagacaaaagttcacacgtttaatctaagacttaagatgaactgaaattaagatggactaatgtgttgattcagttctcctgaataatgataataatagctactattataattatctactctgacatttattgaggatttactatgaacctggaattgtgctaagcactctctatatatctcatataacactactgttatatggagtacacattatattacacgtgacaacatttcacagatgagaaaatgaagtcttaaaaaatttaagtaatgtcccaagaccaagtcgtggagtttggtttcaaactcagagctagcttatgacctcttaaccactaggtttgctggaagccaggactggtattctccaggctcacattctccaatcctctgcactttaagttgtatctagttgggtcatgggtatttagttcattctgtaacagctggataaagggcaatcttccacatgatgtaatccccaaattgctcaacaaagacattgttgttaatagagtccactggggtcaattaaaaaatcaaagtcaaaggggagcagagggtggtattttgaccagagaggaaaacggcaaggatttaatttgggaagactgttttttaaaaaatatttaaacatttattgtgctcaaaatttaaatccaaaaaaattaaataaatcgtataattctctttataggctgggtgcggtggctcatgtctgtaatcccagcactttgagaggctgaggcgggtggatcacctgaggtcgggagttcgagaccagcctgaccaacatggagaaaccccgtatctactaaaaatataaaattagctgggcatggtggtgcatgcctgtaatcccagctactcgggagactgaggcaaaagaattgcttgaacctgggaggcggagtttgcggtgagcctagaccgtgccattgctctccagcctgggcaacaagagtgaaactccgtctcaaagaaaaaaaaaacaaaaaacaaaaaacaactctcttttaaagtacaaaataattcatcaccttcctttattatttacccattatttcatctaaatgtttgtagctaagattttcttaaagcaggttacccatgattacagctgcctgagaggcctgtctcgtggcatgtatatatgtttcaccaaaggcaatttgggaatgtgtgttggatcaagattcagataatgtagacttgggttttccatttattatgccagtaaacttagtcaactcagattacccattctgagccttactttctcaagtctgaaatggggatagtaatactggcttatcagtacttcctgcacaggattgttgtacagaatcaaattcgtttatatatttgaaaaatatctacggaagggatgggtgtaattattgaaaagaagaaatcctagcatacttcgggatcttttactaccatttgcatcactgtaagatagagaaaaatgagagctgtgtccatgcatgttagaagtaatttttttcctttttgtattcattttattttaattttttttacattttattttagattcaggaggtacatgtgcaggtttgttacatggtgcgttagtctgttttgcattgctataaaggaatacctgagactgggtaatttataaaggaaagaggtttatttggttcatggttctgcaggctgtgcaagcatgacaccagcatctgctcagcttctggggaagccccagggagcttttactcatggtggaaggtgaagggggagcaggcatgtcacatggtgagacagggagaaagagagatgctaggctcttttaaacattcatatttcacagtaactaataaagtaagaactcattcattaccatggggagggcaccaagccattcatgaggggtctaccccaatgacccaaacaccttccaccaggccccatctccaacactgaggattacatttcaacatgagatttagaggcaaaaaacatccaaactatttcacatggatatattgtgtaatgatgtgatttggacttctggtgaacgcatccctcatccaaatagtgaacattgtacccaataggtaatctttcaaccctcaccttcatcccaccctcctgccttttggagttgccagtgtctattatttccatttgtatgtccatgtgtatccattgttcagtgaggacatgcggtatttgattttctgcttctgagttatttcacttatgatactcttctaacagtgagaatttaggctttctggtaagtataccttagatgataattgtactctttagcgtctggaatcaaagtttattctggtttgctcagccaaagctctttaactctggatctggtttggaagaaatggagcagtctattctcatctggaccaatcccaggaaacatcctcatctcaattaatccataagtcacatcacaggtttttgtgttggttttgttttgtttttctgtcaccacgattctccatccaatggctcttgtggaataaagcaatgcacagaagtggcactaagaagtctgttttttttgtttttgtttttgtttttagagatagcatcttggcccgggcgtggtggctcacgcctataatcccagcactttgggaggctgaggtgggtggatcacaaggtcagggtttcgagatcagcttggccaatatagtgaaaccctgtctctactaaaaatacaaaaaaaaaaaaaaaaaaatcagccaggtgtggtggcacacacctgtagtcccagctacttgggaggccaagggacggaggttgcagtgagccaagatcacgccactgcactccagcctgggcaacaagagtgagattccatctcaaaaaaaaaaaaaaaaaaaaaaaaaaagagacagcatctcactttgtcacacagactggagtgcagtagcacaatcacagcttactgcagcctcaacctccaggcttaagcgatcctcccacctcagcctcctgagtagctgggaccacaggcatgtgcccactgcacccagctaacttttgtagtttttgtagagatggggttttgccatgttgcccaggctagtctcaaactcctgagctcaagcaatcttccagccttggcctccttaagtgttgggattataggcgtaagccactgcacctggttagaagtcttaaatgacaaagaggagtgagctagataaaagagaaaagggatatttcaagtagagagcacaacatgtacaaaaactgggcaatgtgaattgtttagggaactacaagtggccgaggtggctagaggaaaggcagtgtgatagagtgatagagtgcagcttagccgtagccactgtcaggactttggagcctgccagctttggtttgaaacctagttccacctctctcagccgagtgcctttgggctagttatataacctctctgtatctacctcacggggtttagaactattaaatgaattatggtatattaaatgcttaaaatattgcataatacataatgagtactcctactattactattgttattgtgaatagttagataggcaggggacaggtcctagaggctcctacgttaaaaggaagaaaattaaaactatatgcctaaagccatggggaggtttagaaggtttttgtaagaagtagagagaaagtatgtgatgtgatctgatttttagaaaggtcattccaatgagaggtgacagcgtgctggcagtcctcagagccctcgcttgctctcggcacctcctctgcctgggctcccactttggcagcacttgaggagcccttcagcccaccactgcactgtgggagcccctttcagggctggccaaggctggagcccactcccttagcttgcagggaggtgtggagggagagacgcgagcgggaaccggggctgcgtgcagcgcttgcaggccagctggaattccgggtgggcgtgggcttggcgggcccctcactcggagcagccggccagccctgctggccccgggtaataagggacttagcacccgggccagtggctgcggagggtgtactgggtcccccagcagtgccagcccaccggcgctgcgctggatttctcaccgagccttagctgccttcccgaggggcagggctcgggacctgcagcccgccatgcctgagcctcccacccactccatgggctcctgtgcggcccaagcctccccaacgagcaccaccccctgctccacggcgcccagtcccatcgaccacccaagggctgaggaatgcgagcgcagggcgcatgactggcagacagctccacctgcagccctggtgccggatccactaggtgaagccagctgggctcctgagtctggtggggacgtggagagtctttatatctagctcagggattataaacacaccaatcagcaccctgtgtctagctcaaggtttgtgagtgcaccaatcgacactgtatctagctgctctggtggggccttggagaacctttatgcctagctcagggattgtaaatacaccaatcagcaccctgtgtttagctcaaggtttgtgaatgcaccaatcgacactctgtatctagctgctctggtggggccttggagaacctgtgtgtggaaactctgtatctaactaatctgatggggacgtggagaacctttgtatctagctcagggattgtaaatgtaccaatcagcgccctgacaaaacaggccactgggctctaccaatcagcaggatgtgggtggggccagataagagaataaaagcaggctgcccgagcccgcattggcaacccactcgggtccccttccacactgtggaggctttgttctttcgctctttgcaataactcttgctactgctcactctttgggtccacgctgcttttatgagttgtaacactcactgcgaagatctgcagcttcactcctgaacccagcgagaccacgagcccaccaggaggaataaacaactccagacgtgctgccttaagagctgtaacactcaccgcaaaggtctgcagcttcactcctgagccagcgagaccatgaacccaccagaaggaagaaactccgaacacatctgaacatcagaagggacagactccagatgtgccaccttaagagctgtaacaccgcgagggtccgcggcttcattcttgaagtcagtgagaccaaggacccaccaattccggacacaccaatacgtggatagggatagatcaaagggaatcaaactaaagataggaaggccagtaaagaggcaactgcagtaatccagaggaagagagatggaagcttaaattaagtaaatgccaggtgcaataaagaggagagggagcaccaggtgagagtgaggaggagaagccacaggcctgggtgcctgaatctcagttgtcaggcctgggcagttgagtggtgtggataccactcaccgagaatgggaacgccaggaaagaagtggatttggagaaacgtgggggagcttagttctgtggtgtctttgattttggacatactgggtttgaagagaacagccaattactgatgcttagtaggtaatggcttggtgcttcaggaagagatcagaaccctttgataagaaccctggcctggctgggcgcggtggctcacgcctgtaatcccagcactttgagaggccgaggcgggcggatcacgaggtcaggagatcaagaccatcctggctaacacggtgaaacccagtctctactaaaaaataccaaaaaattagccgggcgcggtggcgggagcctgtagtcccagctactggggaagctgaggcaggagaatggcgggaacccgggaggcggagcttgctgtaagccgagatcacgccactgcactccagcctgggtgacagagcgagactccatctcaaaaaaaataaaataaataaataaataaagaaccctggcccatttagaaatgaagctgtctatacttccagactgaataacaaccactttttgttagttgtttaagatgtgatctctgccttaattatcgatagtcatattcaaaagattcactaaatcccatctggaaaatggagacgtttttgagattcttttggcaattcaagagcattatcattgattattagtagtgactgaaacaaagacactgacaaaattagacatacactcattacactcattgttttggctatattttgagaattttgtcaactgattgtcttcacaatgtccttcctttggacatataataaaaataatatagtcattatttgaatgtgtgcatatagttgcaaaattaccatgtgtttatatgtataatgtgtttctagttttacactgtttagtcactcaaaaattgtattatgattgcaactttcccccacaggtatctctgatgaatatataacacctatgtttagtttttataaaagtattggggaactgaaaatgactcaagaggagtatgctctgcttacagcaattgttatcctgtctccaggtaattccaatgttacattttaatttttatgccatttttttcagtatactagtaataacgtttattgaaaaaaatctggaaaacatagaaatataaagaaaaagtaaagtagcctataattctgctatccaaatagaaccattattaacctttcagtgcacttcttttcagtctttttaaaaaatatcacacttattcatttaataaatgtatattgaacacctactatgtactaaccatgatgctaagcaccggggatgcaacaagacacagctcccatgcagcttgcattctggtaggatgagaaagataataaatgaagaaacaatattttttcagaaggtggtaaatgctacaaaaaatataatgagaatataaagaaagagagtggcacaaaaatggtattttaatttgtggtcacaggaggctttttttaagtgggtggcattggagcagggatctaaatgaaattacatactttttaacataataaggaacttttttctgagtttatatttcttctaaaagtcatttcccaagtcattaaaaaattacattggtaaagttgtaatatgtgctacatattccattgtatgaatatacaatcatttacttaatctttaccacatgtttgtatattcaggatatttccagtttttttgatgttgaaaatgtttcttcaacagttttttttggttgttgaaatgatacctctttccatatttttttctatattttttggttactttaataatttgggtgtcgaatgatgccatgctcatgatttgtagagcataataacaatgttagccttaggccatttttatacattatcttgaggcagaagctagttgttactttgctttaccataaaaattatgacttgtgactaaaaaactattcagcagaaccttctaaagttatgtatggatatgtcctatgacccagtgatttcacttctgagaatatactcaacagaaaggatgctcacgtccaccctacaggttatctttaggggttttgattggaaggggaattgggaggcttctgggaagcattacatgtgttgtatcttgatctcgttataattacgtgtgtgtgcataaaaattcatcaggttgaacacttaattttcacattttgtgtacaacatttaacttacacttcaaaatagttaacgttgctataattatgctgaattaatgcttttccactttttaattttgtcattttattttaaacttcaaaacagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaacagga

SEQ ID NO: 1018 - DNA, 60508 bp, Homo sapiens; identical to SEQ ID NO: 1017

SEQ ID NO: 1019 - DNA, 142990 bp, Homo sapiens
ataatggaagctttattggaaaaggcagaaggtagaaaaacatctggaaggacaaaaagcccaccaggcaaccaaccagtcaaccagtaacaatgtacaggcttgagattggggtattgatcaattgccacttaggccacacataatcactaccacacacaatcactatgtgtgattttttttttccctcaagagaatgtattaaaaggaatgcttcggaattaaaaataaaaattttaaaaattaccccttttaaaaataaactgaataatttgtaaaactatggagagtatggtgatgaacacaaaggctatgactttaagtcaccttttctgggaaagcaactggtttagaagattaaactatgcaaacaaaaggcaaagattctgggccgggtacggtggctcacgcctgtaatcccagtacattgggaggccaaggtaggcagatcgagaccatcctggccaacatggtgaaaccccgtctctactaaaaatacaaaaattagctgggcgtggtggcacgtgcctgttatcccagctactcaggaggctgaggcaggagaatcacttgtacctgggagtcagaggttgcagtgagctgagattgtgccactgcactccagcctggccacagagccggactccatctcagaaaaaataataataataaaaaatttaaaaaagattctgggccgggcgcggtggctcacgcctgtaattccagcactttgggaggctgaggcgggcagatcacgaggtcaggagattgagaccatcctagctaacacggtgaaaccccgtctctactaaaaatacaaaaaattagccgggcgtggtggcaggcacctgtagtcccagctacccggaaggctgaggcaggagaatggcgtgaacccaggaggcggagcttgcagtgagccgagatcatgccaccgcactccagcctaggtgacagagcgagactccatctcaaaaaaaaaaaagattctgaaccatccattctctgggttgcacttaaatttttggcttcattagggatgacttggagctgctatgcttgtcatgcaaaatatattcctccatgttattttccatttgctaatcagttggatccatttgagtcaaactgtgcctttgtagacttggttgcttcttttggaagcttctttcaaagtttctttctttagttgcttctttcaaactaggttacagaaacaagagctgaattagacagctgcagaaagcagatttctactttcaaatttaagatgaaaaatatgaatattgagagtatttctttcatgttgaaatcaagcaactttcttggtaaaattctatttcttaacgcagtcagtaattggtgggtgaggtgaccacatgccctgaggaggcaggtaggcccatctagagcaggagctgggctcatgcagatggatctttgaccctacctctgttcctcatagttggatgaccctggccaactcacttcaccctgttactttccttatctgcaaaattcatgtctccaaaattcccttgtggggttgctgtgaggatgagttgaaatgatgtgtgtggtgtcacagcatgatttccttgatccatggaagttattaagttgttggcagtccacttcttgcttttgtggagttgtatttttgttctagctcttttgttcacagacggggtgactatgtaatttatcatccaaactgggaattaataaatgaaaatgaaagactaagtggaggagagtctgggctcaaaggtgtggtcaggactcttcccaggcaaacctgaacatgtatggtcaccttccctaatactaatgcgtagtcagactgagcagcctgtgggagaaagctggctgccatcattctgccactcactgctggagggacaacaaggcagaagcagtctggcgggccaagctagaccttgtctgtgtcgggaagacttacatcatgtgctggtaaagaactaacaactgctgggcacagtggctcatgcctataatcccagcactttgggaggccaaggtgggaggattgcttgaggccagaagtttgagaccagcctggaccacctagtgagaccttgtctctacaaaaaaaaaaaaaaaaaagttaaaaaaaaattagctggtcctggtgacatgcacctgtagtcccagctactcaggaggctgaggaaggtggatcacttgagcccaggagttagaagctgcagtgagctatgactgcaccactgcactccagcctgggcaactgagcaagacactgtctcaaaaaataaaaagactaacaacctggtctttgaaaaatattgagtggccaggcacggtggcccatgcctataatcccaatgctttgggaagccaaggcgagtgaatcacttgaggtcaggagttcaagaccagcctggtcaacatggtgaaaccccatctctactaaaaatacaaaaaattagggtgtggtggtgggtgcctataatcctggctactcgggaggctgaggcaggagaatcgcttgaacccgggaggtggaggttgcagtgagctgagattgggccattgcactccagcctgggcgacaacagtgaaactccataaaaaaaaaaaaaaaggaaaaaagaaaaagaaaaagaaaaggaaaaattattgagtgaagaagcctcttcccttcctcccccaccaccttataatttggcaaagggcctccatctgtggggcctagattgttttctaggagataaaaatagccagcatgtgtcaagatagcatcaaacctgcaggggcaggtgaggactccagaatggggttataagcaggtcttttttttttgtgagccaggctacatgccaggctttatgctactgtgtttatttctctttgttacttgccagcacagtgatactagaacttgcagaaatttaagggtaaccggtattactttaaaataccttttcccaggctcccactgcagaccttcaaaatccatgtcccccaagattctgtatatttaaactggtgtccagagcagtttctatgacctcaaaaggttgggaaacattgccctcatgttcagaaaagtcctttaaacttttcagctttgacttagttgtggagagatgttgaaaaatgccttttgtcatcccattgcctgtacctcagatatgaaggaagaaatgacccaaggaggcttcgatggagccaaaatcatcagagggagagtctcgggagaaagatgaatctccagggcaggggccagggtttgttggtctctctgcttctggcccctgcagttactctttttcagtgtcaacctcagaggagctgagctttatttttattataaaagcagagattatctgtcactatactttatcaatcctttctcttctttccccatcattcttccagaaagaattgttcatactccttgtctctgcttccttaatcttcattcacttctgactgcagtggaatgaagactgacctgggtaacctgccctatgtgactgtgggcaggttaatgaactactccaaccctcagtttccccactgtgacttgtaaaatgaggtaatgcaagaaaaatttccaacatagtccctggcagatagtaaatacttattttttttatttttatttttttgaggtggagtctcgctctgttgcccaggctggagtgcggtggcacgatcttggctcactgcaacctccgcctcccgggttcaagtgattctcctgcctcagcctcccgagtagctaggactacaggcatgtgacaccatgcctggctaatttttgtatttttagtagagacgggggtttcaccatattggccaggctggtctcgaactcctgaccttgtgatctgcccacctcagcctcccaaactgctgggattacagatgtgagctacctcgtctggccagtaaatacttaattttaaccctttccctttccctacctctggccccaaaacagagataaaatttcttttcctaaaatcattagtaacataattgatttttttttctttttttttttgaaacagagtcttgctctgtcacccggtctagagtgcagtggcgcaatctcggcttactatcacctctgcctcccaggttcaagtgacttttttgcctcgcctcctgagtagctgggattacaggcgtgtgccaacacttcgttaatgtttttgtatttttagtagagatggggtttcaccatgttggccaggctggtaaaatcattagtaacctaattggaaaattctatcatttttcagggctcaatttacttttttttggtcaacatttaagactatactcaattcttgaaattcctattcttttcctatatttatgccactttttctagcttttccctcctggttccaaaaacatcatctctagcctgcctagtatcagaggcactccctgcccagtgtcacatgggcagtcatttaacagccatgatatcctggccccacataatcatttgctccctaaatagggacttgtatgaataaccacacaaggatttcactgtctttttcctttacatacaccttacatttaggtgtattaatgaaattatgcagccattgaaaagtatcatgttgaaagctatggaaagatgcagaagtgattaacatcttcagtagatatagtgcaatgcaaaatgctacatgttaaaaatcagggtgaggtgctattcaccttaagaagacaccataaaggccaggtgcagtggctcatgcctgtaatcccagcactttgggaggctgaggtgggtggatcacgaggtcaggagattgagaccatattggctaacatggtgaaaccccgtctctactaaaaatacaaaaaattagccaggtatggtggcacatgcctgtaatcccagctacttgggaggctgaggcaggagaatcgcttgaacccaggaggcggaggttgcagtaagctgagattgtgccactgcactccagcctgggtgacagagcgagactctgtgttaaaaaaaaaaaaaagaaggcactataggccaggcatggtggctcaggtctgtaatcccagcactttgggaggccaaggcgggcagatcacctgggatcaggagttcaagaccaccctggccaacatggtgaaaccctgtctctactaaaaatgcaaaaattagccaggcatggtgggatacacctataatcccagctacttcggaggctgaagcaggagaatcacttgcccttgggaggcggaggttgcagtgagccgagattgcaccactacactccagtctgggcaacagagggagactttgtctcaaaacaaaaataaaaacaaaaacaaaaaacaaaacaaaaacgaaaacaaaggcactacagccgcctaacacaaagatgatagaatctcatccctacgctgtagccacacacaaccaaacccaagatcccccaaggaaaacggatgaatagagaacactagcaaatgagaattaagcatcactttgctacaaatactccagtaaactgggcctgagcactgctttgggcttccagactgtaggcttcctctatctcccaggcataaatagactcttaccttagtgagagcacatcagacattagccaagtgtggtggtgcgtgcctgtaatcccagctacttgggagactgaagctggagaatcgctttaacccgggaggtggaggctgcagtgagctgagatctcaccactgcactccagcctggtgacagagcgagactctgtcttaaaataataacaataataataataattctctgatgactcttcaggaaattctcctcattttaagagttatgctatgttgttctgtgaaaatgaagactaccagcacttctgtgtaaactctaggaagagtttgactataggagtatggtaatacttgctgtgtaaagaaaggatggaaagctactttgttttgataaagtaaaatgtattgaagtgcctattttgagtaaattaaaattcagagtacttaccatttcagctggtctcaacagcaaatttttagaagtctgaaatacatcaataccgtgaaataggagactcttacttccttaagacattcatgaaatcactgggttaggtgctagtaatgcaatgatgagaaaacacacacacacacaaacacacacacacaatcccagctcttatggggtttacagtcaagtggggagacaaacattaatcaaataattacacaaataaatttaacaaactgcagagtgcatgatggaagagcagtattagatggtatgagatgattaacagggtctgttaattggccagaaacatctgggaaagctcacctgagactgtcagttgtgctatggttggaggatggggatgggaggtggctggtgagggcctcgttagggaaggaactaagggtgcaggagccctgctgctggaagcagtatgagcctcgggtaacacaagggctaacccaaatgcctacacagagtaaggattgtgggagaggaagaagtgacatgcctctcaagtattaaaattcagttttcatcatttaaaaatagagtaacaataggcaaacagtttgtgtttttgacagggattgtaagagtcaataaatgatcactgaactcctaggagggtcctaaaactgagcgtttgaattccagaatttaaatgctgggtagaaaaggatgacccagcaagtattcctgagtctgaagaagaaaagccaggagtgagtttagtgttactaatggcagaggaaaagagggccttttaaaaaggaggcagtggtactcagagttgaaggctaccaaaagatcaaggaaaatgagaactgaaaaaatatctgttggagttagcaacatggaggccaatgacattcacaaaatgcttaaaatgcactgatattgtataattagtttcaaccatcttctgaattatctgtgtcttttgcctgactgggaggggtgtgggttgctttagatcaaattccacacttctggagatctgggggcattctagcaacaatccagatagtgttacaaacaagaccattataagataaacacattttaacaaggcatttattacccaatgctttaatattagagagactcaactgggctcatgttaaaaacaatgaagcatctatgtcttatgcaatgctgtataggaagtatctgataaagtctagatcctcagaacaaaaattctatgcattggtctattgtctttatttaagacaaagagtgtgcttaaggtacaggtatctaccagctactgaaaactgcagaacccctatccatgatgtatccttatttatagaatgctctaaaaatgctctaaaaatctcccataaaacaggatgaaagtagttttctaatccaaaatgttatcataattgacacttctcagggtaaaaattagcacataatggtgagtgagctcagaaagattcaaaataaacaatttatacaaatcgagctctccaacaattgcaaatatacagtatctattagtctttagctgaattaatcatttattttttatttttatttttatttttgagatggagtttcgctcttgttgcccaggctggagtgcagtggagtgatctcggctcaccacaacctccgcctcccaggttcaagtgattctcctgcctcagcctcccgagtagctgggattacaggcatgcgccaccacacccagctaacttttttgtatttttagtagggacggggtttctccatgttgtcaggctggtctcgaactcctgacctcaggtgatccgcccacctcagcctcccaaagtgctgggattaccagcgtgagccatcacactcagcctaaattaatcatttcttaaggccctcataaagttactgtttgtaaaaaataaaattctacatatatgggaatttagaaaaacatttaattgtcataattgaatgtaattaatcattgttaaaatatcaaagcaataatacatttcagaggatatatatgtaatgatttttaaggctctagtgaagcatactctaaaatgtagctaagcaatctattaacaccggccttttacagaatacagttacaatcattctaacaagataaattggctgggcgcagtgactcatgcctgtaatcccagcactttgggaggccaaggtgggtggatcacctgaggtcaggagttcaagaccagcctggccaacatgtcgaaatcccatctctactaaaaatacaaataattatccaggggtggtggcaggcacctgtaaaccttggcaggctgaggcaggagaatcgcgtgaacctgggagacgggggttgcagtgagccaagattgcaccattacactccagcctgggtgacagagcaagactctgtctgagaaaaaaagaaagataaattatacatatgattgatatacaagcaaattatatgtattcacacatatatagtttccttttggaagattttaggaaaatatttgtcacaattaatgatttttatattttatttataaattgagtactttgacaaaatattatattaaatggttcagtaagactgaaccatatatgatgtacttttatatgttattgcatttttaaaaatctgtaattttcaataacaaatctcaaaatatgaaaataaatttcttggtttggcacagtggctcatacctgtaattccagcactttgattggccaaagcgggtggatcattggagtctgtgagtttgagactagcctaggcaacatggcaaaacaccatctctacaaaaaaatacaaaaattagctaggtgtggcagagggtacctgtaggctagggaggctgaggtgggaggatccattgagcccatgagacctaggctgcagtgagctgcaactgggcaatagagcgagagcttgtctcaaaataaataaataaataaataaataaataaatttcttctctttaaatcttggacctagtcatcagatcaatctttctaaaattttgttttcattcatgcatattattcagtggctccccacttcctacaaaatgaagttcagctctttgttctgacatgtaaaccatttcaatatttggcttcaaacattatttccaaagcaggccatgctcctcatctccaccctgagcttgtggtgtgttcctcaccttgaaagctcttcctctttctcttcttcaaatcttgtgatttttaaagatgcagttcaactcccacccacctcccttatgaaatcttcccttatgcttctagtgccttcctctggccttgtcttcatcacttattttgggttttaaacaacgactattatgtacttagtaacagtacttgtgtcccttttttttttttgagacggagtttcgttcccgttgcccaggctggagtgcaatggtgtgatcttggctcacggcaacctctgcctcctgggttcaagtgattctcctgcctcagcctcccgagtagctgggattacaggcgcccgccaccatgcccagctactttttgtatttttagtagagacggggttttgctatgttggccaggctggtctcgaactactgacctcaggtgatccacctgccttggcctcccaaagtgctgggattacacatgtgaaccactgtgcccgaccttgtgtctcttagccgaatgggaattacctttgatgcctagcacaatcctgagaattataaaatttgagtgagtataaaattataagcatatactagtattaccttaattacctctgacctattttactttattcttacagcttttctatctacagaaatagtataactaaacgtcaagtttactattgcttaagtgtctctcattctctttcaaagaaactgatcttgctgttgtctccatttaatgcatactcttcactgtgcaactgaaatatagagagtctggaattttcctcaaactagggactaattccctttaatttcatcaagtcttaggtaagttcctgtgttttgtgataaatacatttttaccttccttttaatggaatatttgaatgttcaatttctccaaaaatacagaactttaaaaaacccaaaaaacagtaaggtctttctttcattgagtttgatgtttattgtttttctctcctttctccaagcacaggggaagaggtataaaagcagagggatatatgcttttgaaaagccaccctgggctagatgcagaaaagcagaaattatggtgctagcttcttttactgcataggcagtttagctctgcttaagactattgtacttgagtcctaagtttacaaatctagggaaatcatgcttacaaatgagcatggttttctttttgcatataacagcaccaattacttattaaacacctactatacatcagacgcaatgttggttgctttatatgttacctaattttcatgatcaaatgtatcatgatttccattttacaaatgaggaaaccgaggcttagagatgctaagtaactttaacaactagtaaatggcagagctagagtttggatgcagaactgattccaaagcctatgctcttttctctacatcttgcactgtcagtgtcttttagtggcaggaattctcactggggaatgttggggcttgcatctatgactctggcagctaaatggaaggatagaataataataaaaaagttccattgtatctagggaggcttaccagaccccttcccctatgcacagttgctccaggctttgttattagatgttcctcactctgacaatttacatttcagtgtacactaaatttggcactgtcccttttgttatggaacatctgatcatttctgtctgggtaggtggggaggaaggctgagaagtttttatctttgtcaaggcccaggaatgaaaacaacaccaggaagtaaatcaatgcaataatatacattttatattaaaaatataatatgcagtatattttatatttaatattagtatataacatattaatatataaacattatttaacattatgcattttatatatattagaaattctaccctgtaaaaatatatttctcaaggggccggcattcgggggcggggggggcaatacatttatcacacaatatgaaacttacataagactagatatatctatagtcttcgtgctgtgctgatatataaattccaagtttcagctgttagttacttacttggagatcagtagaaggaaatttcagtgtgacaagaatgttgacaatccctgtgctatctgtactaggatctagttccactgtgctcttccagggaaggatgtagctgtgtatgcaggttttagttggacagtcatctttttctagtggcagtttcccagtcgctgttctgtgtattaggaccacgggaggagagaaaaggttattcttccttctccatttttccacacttaagagaatttaatatactgtgttttctagttagtagttaattttgtgtaatagtctagagattgctatacagatttaatgtgttttacacttagttgggcaaaagtgtattagtatctaccaccaaccagatctaactacataaatatatattatataattatattaaggataatttgtgggttttgcgtgtgaaccctaaaaatctgagccatgtcccagttaatttagaaagtttattttgccacggttgaggatgcgtgcccatgatacagcttcaggaggtcagaacccgaggtggtcagagcagtttggttttgtacattttaggaagacacgagacatcaatcagcgtgtgtaagatgaacactggttcagtccagaaaaggtgggacgacttgaagcaaaggtgggacaactcaaaacagggggcgggcttccaggttttagggagataagaggcaaatcactgcattcttttgagtttctggttaccctttccaaaggaggcaatcagatattcatttatctcagtgagcagagggatgactttgaatagaatgggaggcaggtttgccctaagcagttctccgaagcttgactttttcctttagcttagtgattttggggccccaagattttcctttcacatgagttaataactgtccagtcttgtgaaatatcattttaatattaggatatctgaaatgtttccatatggctgggtgtggtggctcacgcctgtaatcccagcactttgggaggctgaggcctgaggaacacttgagcccaggagtttgacaccagcctgggcaacatagtgagactctatctttacaaaaaataaaattagccaggcgtggtggcgcatgtctgtggtcccagctacttgggaggctaagggaggaggataacttgggcccaggggcttgaggctgtagtgagccatgatcatgctactgcactccagcctgggggacagagatagaccctgtctcaaaatcaatcaacacacaatgacaacaaataaatgagatgtttctacagatcactttgtttttttagaaacactaaattaattaattaatttagttattgagacggagtcttgctctgttgcccaggctggagtgcagtggtaggatctcggctcactgcaacctccatctcccgggttcaagctattctcctgcctcagcctctcaagtagctgggactacaggcatacggcaccatgaccggctaatttttgtatttttagtagagaccaggtttcaccatgttggtcagtccggtctggaactcctgacctcaggtgatctgcccgcctcgacctcccaaagtgctgggattacaggcgtgagccaccgtgcctggcctaaaaacactaaatttagtaaggtactggggtgcagttttgtcactgacagttatggtgctgtagaaagagcccatatctggaagctgcctttagcctcagctctgcctcttgcttttgtaccttggaaaagtcacttcacctgttttctcatctatataggatgaagatcataatttcttttacacagtgttatgagactgaatgacagaaattaaaagaagtgttctacgaaggcaaagttaggtttcttatagcaggaagggagatgcacacagagaagtgggaatctcaggagacggatgtggccaggggctttttacgggggttgggctaagcattattagtcaacgggctgtactgctatttatggtaggttttgaataccgtttctccaaaataacctatttcctccccaaacccaaacttcctcaactgggatcgaactcaatcctacagcgtgttctgagattctatactcgcctcacttctcccaagatcgtaaattctggaggagccattccttcatcatccatgtttgcatccttcacaccgttcactggttaagtgcttagtacgtttgctattgggcaaggtcctcaaacgggaggtggacgtcagaatagtcaggttatcgactgagtaactgttagtggtggataatttaaagccaatttgaaagttcatcctttcccccaaaggcaaaaacaggcgttccttttcttaaaagagaattttaaatagaattgggtctctggtgtcctgcctaaagcccgcaaagaaagagggtacggttgggggtgggggtgatgggggatactgaacccttttctggttgcgccttgcccggagcccccggctagagccctggcgctcctggcgcgctcccaacgcgaatcggtgactccgcaggccgcgcagtgcggaggtgcccgtcccaccctcccccttgtggggtgcggggctccatttccccaagccgctggggtcggcttctggtcttgagatgcggatgaagtggtgtgaagggttgggcttttttttttgttcctaaaaatgcaacgaacaaaaaaaaaagtacaacaatccaaacccaaccatcttaattgcacggcagcttaactgggagactttcttcccgggcggccccacccgggaccgcgccgcttcagtcgagcccaccgtctgggcaaacggcgtccacttcccggagccgctgcccagcctctgcgggggggctttgggcgggcgcaggactctggaagggagaaaagcccgcagcccggccctccccgtcccaggcggcccgcgcgggtggacggcgggagcaggcggcggttggagacgccggaaggaacgcggtctcaccacccggctccctccgccaaggcgaggcgcggccggggaggcgggacacaggcgaagcgggacggggaggcggggccggaggtgcaggcggaggcgggcgacggggaagggagggggagggggaggggaaagggagggggagggggaggggaaagggagggggaggggggaagggacgggaggggagggggaagggacgggaggggagggggaagggacgggaggggaaggggaagcgggagagggaagggggcggagctagccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccaggtcagcagggatctgcgtgggttgggggggctggcgaaggccgtctgagctccagtccggcagcgcggcagaaaccagcggggcactgtcatgggcctggggaggagcggcctgcggagggcgccggggcagtgtgtctgtggtccagaaaacctgctccgtccggagccttcctggccccgctaccagcgtctccacatcccctagaaaagaaaagacgggtgtgggccttaggttacagcgcgccgccagcgtttggttgcatggcgccgggggagggcgccctaaccgagaagctgcttaatacaaagagctccaggctcctggcggttcaccaggtctaaacagccgggctttatttgtgggggcgattgaaaaaattgagggtcaagattggggtgctgtgcaaataaatgcgttaatactgttctttttcttctttctttgcagtagcctctagttcgttagtcaaaacgtgaaaaaaaagacctgctttgccctgggaaatagtaaccctgccaaatacatcagcttgtaggagacagaggtaaactacaataattttcctgtgttatcttttttttttaaacacccaatttcaataggccctagaaccttccaaaatggaactgtgtgtagaatacgtatgttcccatccactttcattggtggtctttgttctttgcatattttgttaaaacttagaaaaacagaattcacgtttagcaattatttatgtggtatttatcttaaatatagccaaacattcatattacaaaggaagaaaggggcttccacacttttttcctacttttttttcccttctcctatgcttagtgaattgtcaggctgctagggcttgtagaacagggcttgagttttctagagacctttatataataggcactttaaaagcagaatttcatttacataggcactccttctagtagaacttgatggagctgttaaccggctatacttccttcttgcacaatgggagcgtccctatccctccctaaaaatacgttttttttcctttctcccagctggcttactaaacctccctgggaagtcctttcctaaaaccgggctgttctgttcattctatacatttatgataggttatctggccttaattctgtcacagcttttgttcagatatgctcattttcatgacactgctttgtacctgataccttatgtaatatttgttttgccttgccttgaaatcacagttcaagtttagaaccttttcttgcttgatacactgatgctccaaaataacaccttaaatgtgtagagtttgccatatgtaattaaaccttatttatgtttgtatagtttcgtagtttatggaattctcacacatcacacaggagttgagaaattacttttaggcagctagaaagggtaaaagagttctcggtggaattttcctttaataaaaagcagctcctggccggtgactttgggaggctgaggtgggtggatcacttgaggtcaggagttcaagaccagcctgaccaatatggtgaaatcccatctttactaacaatacaaaaattagctgggcgtgggggtgcgtgcacctgtaatcccagctactcgggaggctgaggcagaagaaccacttgaaccgggacgcagaggttgcagtgagccaagatcgcgccactgcactccagactgggcaacagagcgagactctaccaaaaaaaaaaaaaaagcccccaaaccatttattttctaacagaaagcctgaaaagtcaagctgcaagcaaaaatatgcaggctagaagcttttatatgtaaatgtagcctgctgtatctggaagccaggtacattcaatatggggtttctcactcccttttccttgtcaccctatgtgggcgtctgggccgctcccttttccttgtcaccctatgtgggcgtcttggcgatcactaggtaaaaccacgggtgcaggtgtcatggcggccccaggtagaagctacatttgcataacaaaaaattagggtgggagggccagtctttagacgggctatgtaaatgattcacctggtcaaaccagtcccctgggccctatgtaaatcaccacctcctcaagcctctgtacaaaatcgattgcgtttcaccccaaacccggagaccctctcttgggtgatatttctcagcgtgaggaacctttccctattaaattttccgctcctaaacccactccttgtgtgtgtccatgtcctgaattctttcttggctcgagacaaccacgggtgtatcccccaggcaatggagccatttcattatgaggtaaatactataaaaatcatttttaaatttttttccaagagatgggattctcaactgtgttccccaggctggtcttgaactgggctcaagtgatcctcctgcttcagccttcagagtagctgggactacaagtgtgtggcaccattcccagatataaaaatcctaattttatgaaggataaaactggtgcttgaacacaggtactcaaaagcaggttctgtgctttccccttcactagagagcctgttaaacctagtttgtaaaaactgcaaaattttagaagggattttagagagcttatgattaaaccccttcattttatgaataagaatactgagttcttgagtccctttctagatattgctaaggtctaagaattagaaaactcaggctgtgatgcctagtttgctgtgtacaactgatgagtctccacttcttgagtgctgggggtgtcttagtttttttgactcctaaaattaggtgtttagatgatttctaagatgcttttaagcccagtatttctattcctaccccataacttttattaccatttattgcctatacatatatattggtaagacacagatgcagactaatgttaactgccttaaacttttatattttaaactcgggtaggtatggtaacaagtgtgtcttattgttttttactaagtcctataaaactatggttttatttaaggttaggaactgcatagagaggtggaccactctaatacatcattggttagagttcataaagtgatataaaccctttctagagagaaacctagtcatcttttcaacagccttaaaaatgtccttactgtttgacccagaagtacatttaaaggaattgtctaaggaagtaattagagctgtggagcaagacttttctctataaggtgtttacctaaatgttacaataccaaaaaaacacaacaacccacaaacaaaacaacacagcaacaagaacaaacccataaatgagcaataagaaagcatatccacaacatggactgtcatgtttttctagaacatatcatgatgggggaaaggcatgtaataaaataaggggataggatacaaaattgtattatgctaccagttctgttaaaatgtgtgcacatgcacggacacatgggattggaataaagacaccaaaataatagtagtggtgatttcttgctgatgtgattatgggtggctttttctctctattttctgaattttctataataaaaactaattttataatttaagaagacacaaaagctagttgcatggataacttcggtttcagtatggtgtcaatattttatggttttaattgtggtaagaacatttaacatgagacctatcctctacacagatttctaagtgtacagtacagtggtgttaactatagacatgagcagatctctgaaacttacttttatgtgtcttttataaactatttatcataccttctagaataacagcacctggccgggtgcagtggctcaggcctgtaatcgcagcactttgggaggctgaggtgggcggatcacctgaggtcaggagctcgagaccagcctggccaaaatggtaaaaccctgtctctactaaaaatacaaaaaattagctgggcatggtggcaagtgcctgtaataccagctacttgggaggctaaggcaggagaatcacttgaacccaggaggcggaggttccagtgagccaagatcacaccattgcactccagcctgggtgacaagagcaaaactctgtcccaaaaaaaaaaaaaaaaaaggcaggaaagagtccaggctaaactatggtatggagaagagaatgaaggaaaaggaaaaagtttttcttagtgctctgaactagcgaggtaatgagtgacctggtttatatttctgagaatttcaccttagtctgacaaccctttgtgaactttctgagtaagtgaacttaccaagctagtgaacattctgtactagctctattttgccttgtcaggatctctgctagaaatatcttggaaattttaactactgtttattctaggataatgccagaaaaggttggttacttactgtcttatatggacacataggtaacttttatattgtttgcaagagccacataacaattattttagatactatatgtaatatattaattttcatttttagaggtattgaaatctgatatttcttactttgtcctgttttgatcatatatatgccagaggtgctatgtgtaatacattaattttcatttttagagattatatctgaaatctgatctctgtatcttactttgtcctgttttgatcatataagtcaccgggacagtctctaaaagaatgaagagtaataacacattgatacagagtatttaaaataaaaactttgtaaatacttttcatataccttttaaaatagctatacaaatgaggagagaaactagtatgtataagtggtttgtcagaggttacagactgagagccagacaagtatgtcagtctcctcacaggtctggattcagagacttccagtaatacattaaaaaaaaaaatttatgaaagatgaaaccataggctgggcatgatggcttatgcttgtaatcccagcactttgggaggccaaggcaggaagatacttgtggccaggagtttgagtccagcctggccaacatggcgaaaccccgtctctattaaaaacataaaaatgagcctgacgtggtggcaggcacctgtaatctcagctacttgggaggatgaggcaggagaattgcttgaacccaggaagaggaggctgcagtgagacgagatcgcaccattgcactccagcctgggtgacagagcaagactgtctcaaaaaaacaaaaacaaaaacaaaccatactacagcagattaaacttcttatgaggcttatatttagctaatgttttcaaagttttactttctaaactcaatatggttttttaataattggctctttagtttttccacccattttattgtgaaaatgttcaaacagagaaaactcaagaagaatattaaagtattcttacatcctctacctagattttaatagttgttaattagacccttacttagtttcaagaaaacatttattaatggatctctcttttttttttttctttttgagatggagtctcactctgtcatctaggctggagtgcagtggtgcgatcttgactcactgcaacctctgccgcctgggttcaagtgattttcctgcctcagcctcccgagtagctgggattacaggtgtctgccactgctcccggctaatttttgtatttttagtagagacagggtttcaccatcttggccaggctgatcttgaactcctgacctcatgatccacctggctcagccttccaaagtgctgggattacatgcatgagccaatgcacctggcctaatggatctcatactacagtatagtaaggtgcagtggctcatgcctgtagtcccagctactctggaggctgagatgggagaatatagtacactatttgaaaataagattaactagtgtgctgagaggaaatgattttttttaatgagccattttattataggaattatttcaaagtaacatttgtggctgtctcagttcagtaaagcttagcataatttaatgtctatgaagtgagtttcaatgtttgctgtctagccacctgatagatacttaggtactgttttgaaattcttgccttcaaagatgcctcaaaacaggatggaaatttgagttaaatccttaagataaaagcgtgatatatttattggcttttctttttgttccctaatgggaaatgaaaaaaaacaaaaaacatgggtaatattttgaacaactttatattgctaacagccagtggaatttaaaaccttagtaggaaagtttcttttactaataggttttataaggagaaaatgaacttttgtttcagagtgaatgaatgagtactttctgcagtataatcattttgggttgatctcttaaaagaattctagaaggaagaagtccaatacatatatataaactctattatgacacgtttactttgtaagtattggcttttccatttttattattttagtggttgtgttatggttctcatttatagaagctgttgttgccagatactaattgaggtaggattcataaagcactttttgtaatccttcttctttgtggatagcttgacaatttgttcaaaaaaataaactcatagtggtggtatgcaactttgttaaaaataaaactgtaaatcaaaaagtgaatttcattgtatgtaaatttaaaagtatgttagaaaacatcaatatggcaggagaacaagtttgacttttttccgcaactagtgtctactaccacctttctggatactttaaaaagttgtcagcttttaaaattgttggtataaaacatttgggaagtttttaattggtatttgtgcttcaaaatttaagacttttctaagtattcagaaatattcaaaggaagagatgaattttggaaaacttgtttgcctttatgtgcttaatctgactttaagttgaaatttgaacagtgaataataattttgtttacataaagttttttgacttctatattaggaaaaaaactagcttgaggccaagtgcagtggctcttgcctgtataatcagcactttgggaggctgagtcccgactgcttgagctcaggagtttgagaccagcctgggcaacatgctgaaacatcatctatacaaaaaaagtacaaaaattaactgggaatggtagcatgtacctgtagtaccttacagctactcatgaggctgaggtgggaggatcacctgagcctggggaggtcaaagctacagtgagctgtgttagggtcactgcattccagcctgggcaacagagtgatactccctcaaaaaaaacaacaaaacagactgggcacactggctcacgcctgtaatcccagcactttaggaggctgaggcaggtgaatcatttgaggtgaggagttcaagaccagcccggccaacataatgaaaccctgtctctactaaaaacacaaaaattagccaggtggtagtggtgcatgcctgtaatccgagctacacgggaggctgacgcaagagaattgcttgagcctaggaggcagaggttgctggtggggaggttgccagtgagccaagatggcgccactgcacttcagtctgggtgacagcccgagaccctgtcttaaaaaaaaaaaaagggccaggtgcggtggctcacgcctgtaatcccaacacttagggaggccaaggagggcggattacctgaggtcaggagtttgagaccagcctgaccaacatggtgaaaccctgtctctactaaaaatacaaaaattagccgggtgtggtggcgggcacctgtaatcccagctactcaggaggctgaggcaggagaatcgcttgaacccaggaggcagaggttgcagtgagccgagatggtgccattgcactccagcctgggtaacaagagcgagactccctctcaaaagaaaaaaaaacaaccagaaaccccgaaaaagaggtggaggggatgtatccttttttgttcatgtcaaaggagtaagctgggttgattacttcagattttgtgttagccatactttaagattttgtaagttattttgctgtgaagagtaccttttatttatgatattaaaggctttaacttaaattatccttcaaaactttggaggcaacaaagatgtctaccatggtttcttggatcaggtattagtcacttgtggaagtggtcacatagttttgtcttagagaaagttttgattataaagagaaggcataggcagggcatggtggctcacaactataatcccagaactttgggaggccgaggcgggtggatcacctgaggtcaggagttcgagatcagcctggccaacatggcgaaaccctgtctctactaaaaatacaaaaattagcctggcatggttgtaggcgcgtgtaatcccagctactcggggagactaaggcaggagaatcacttgaacccaggaggcggaggttgcagtgagttgtgattacaccactgcactccagcatgggcaacagtgcaagactccatctctaaaaaaaaaagagagaaggcataaaactaaaggaagaaaggaagaagagaaaaggaaatatttagttttttttttttttttgtgatggagtttcactcttgtgcgatcatggctcacggcaacctctggcctcacgggttcaagcgattctcctgcctctgcctcctgagtagctgggattacaggcatgcgccaccacgcctggctaattttgtatttttagtagagacggggtttctccatgtgggccaggctggtctcgaactcccgacctcatctgcccacctcggcggcctcccaaagtgctgggattacaggcgtaaaccaccgcgcttggccagaaatatgtagattttaaagtgaatgaaaataagaatctttaaattatcaaccaaaatttgtaagttaagtcactaaaaatgaaattagaggatctattgtaattttgatgcaatttttttgaagatactttccaaatagtattttttcccctctggttcattttaagagctgtatgttgatcatgaccttgggatgactgtttattatttctaagttttcctgtgtgtgacattttccttttcacttttgatcacatttgtttgcctgaaaattcttcttggcccctgtcgttgtatcctcaattttcttcatagtttctctttgcctttggtgccctttttctcctcctcatcccacccaatcacttggtatattctttgttttcttcttatttaatatgcttggatagtattctctggaagtattaacattgcaaggatgagtaaattaggtttcttttattgagtgttgcccttaccactttcctgtttctattgccttctcaaaaatctggcctttgtgtagaattcttaggcaaaagatgatagtaatggaagtgaaaagtgtggagcaggactggggttggcagatcatcaaaagtttgacttcattgttctgaaagtttgtgtgtcttacagctgtgtggtaatctctttcagaagacaaactaagttgagtctttatagccattctctttccaatgcttttcagaggttatatgatttgtcatatcacaaaggatttttcagaaaaatcagctaattacacctttttttgcaatatgacactaaatttgagacagaataatctttgctttagttctccctatgttatgtattataaatacatgtatcttacaatctactataaaaccataaactggctgggcgtggtggctcacacctgtaatcccagcactctgggaggctgaggtgggcggatcacccgaggtcaggaggttgagaccagcctgggcaacatggtgaaaccctgtctccagcaaaaaatacaaaagttagctgggcatggtggtgggcgcctgtagttcccagctactcaggaggctgaggcagaggaaccgcttgaacccgggaggcagaggttgcagtgagccgagattgtgccactgcactccagcctgggtgacgaagtgagactctgtctcaaaaaaaaaaaaacccaaaaaaatagggcccagcgtggtggctcacgcctataatcccagcactttgggaggctgaggcaggtggatcatgaggtcaggagttcaagaccagcctgtccaagatggtgaaaccccgtgtctattaaaaatacaacaaaattagccgggcgtggtggccggtgcctgtaatcccagctactcgggaggctgaggcaggagaattgcttgaacctgggcagcagagattgcagtgagccgagattgcaccactgcaccccagcctgggcaacagtgagactctgtctcaaaaaaaaaaaaaaaacgccaggcacggtggctcacccctgtaatcccagcagtttgggaggcgggtggattgcctggggtcaggagtttgagaccagcttggccaacatggtgaaaccccgtttctactaaaaatacaaaaattagctgggcgtggtggcaggtgcctgtaaatcccagctactctggaggctgaggcaggagaattgcttgaacccgggaggcggaggttgcagtgagccaagatcacaccattgcactccagcctgggtgacaagagtgagacttagtctcaaaaaaaaaaaaaaaagccataaactaattaaccctgcaagctcagcttgtcctttaaatactgtttaccttctagatatagtccagtcatgtatggctgttgaaattactgttaaaaaagtattcgcttttttttttttgagacagagtattgctgtgttgcccaggctggagtgcagtggcgctgtctcggctaactgcaagctctgcctcctggggtcacaccattctcctgcctcagcctcccaagtagctggaactacaggtgcctgccaccacgcccagctaatttttttgtatttttagtagagacggggttttactgtgttagccaggatggtcttgatctcctgacctcgtgatccgcctgcctcggcctcccaaagtgctgggattacaggcatgagccacccgtgcccggccaagtattcactttttatcatagatggcctaccgattaagtcatatgttattgttgataatgtgatattgttgataatgtgatatgtgcatatatccctgagtaaactgaatgtagaaatatgtagtactctttggttttacaactatagagatgaatgtatatttaaaataaacttgtggcctgatgcagtggctcacacctgtgatctcagtgctttgcgaggctgaggcaggaggattgcttgaggccagctagtaagacctggtctctacaaaaaaaaaagtagccaggcgtggtggtgcatgcctgtagtcttagctacttaggaatctgaggcaggaggattgcttgagcccagaagtttgaggctgcagtaagctataattaggccactgtagtccagcctggacaacagagcaagaccctgtctctcaaaataagaattaaaaataataaacctgcattgagaaatggtattgcctgtattagggatctcaaatattttggtcttaggacacttttacactcttaaaaattgagaatcctggcctgtaatctcagtgttttggcagtctgaggtgggaggatcacttgagcccagcaatttgagactagcctaggcaatatggtgagacctcatctctacaaaaaaaaactacaaagaaaaaaaaaattagctgagtgtgatggtgcgtgcctgtagtcccagctacttggaggttgaggcaggaggatggcttgagtccaagaggcagaagttgcaggggactgagattgcactgctgtactccagcctgggtgaaaaagctgtctcaaaaaaaaaaaaaaaaaaaaaaagagaatcccaagaactttatgtttgtactgtcgatatttactctattagaaattaaaacaatttttaaaaaatactcacgtaaaataacaatgataaacccattacaagttaacaaataatttaggaaaataactattttccaaaacaaaattaagagaagcatggcattgcaatagaggcctgtaatgaatggctatttaatagaagacagctggagtcttttgtctgcttctgtatttaacctgttggaatatattattttggttgaaataaacgaagaaggctgggtgtggtggctcatgcctgtaattccagcactttgggaggtggaggtgggacgattgcctgagggctggatttctagacctgcctgggcaacatagtgagaccctgtctataaaaaaatccacggccaggcgcggtggctcacgcctgtaatcccagcactttgggaggctgaggcggatggatcacctgaggtcaggagttcaagaccagcctggccaacgtggtgaaaccccgtttctactaaaaatacaaaaattacctgcgtgtggtggtatgtgcctgtaggcccagctacttgggaggctgaggcaggagaatcacttgaactcgggaggtggaggttgcagtgagccaagatagcaccactgcactccagcctgggtgacagagtcagactccgtctcaaaaaaaaaaaaaaaaaaaaaacaacaacaacaaaaaacactaaaactaaaaattagcaaggcatggtggtgcacacctgcagtctgtagttacttgggaggatctcacttgagcccagtatttcaaggctgcagtgagctatgatcatgccagtgcactccagcttgggtgacagagtgagacaccccatctcttaagaaaaaaagaaaagaaaaggaaatacacaaaaatctaggcttacacagatatgtagttggtaaaggaaggaatattatttaaatagccttttcaggtaatttaatctttttttttttttttttttttttcctgaggcaaggtctctctctgttgcccaggctggagtgcagtggtgctatctcggctcactgcagcctctgcctcctgggctcaagggattctcatacctcagcctcccgagtagttgggactacaggcgcatgccaccatggctggctaatttttttggtattttttttgtagaggtggagttttgctatgttgcccgtactggtcgtgaactcctgaggtcaagcggtccactctctgcagccttccagagtgttaggattacaggcgtgagccactgctcccagcctgaatcttcttgtgatactatacaaaaactcagcaagtgctagtttctttgttggagtatggaatctgaaattgtttatgaacctgttggtctttcgtgaacttcaaatggatcttttacccatgcctgatttgtaacatgcattagtgacttgaaatagtattcactgtgttttgcagatctccaaatattgacacatttcattatacagtactcctttcccctcagaaaatcctcacattcattaatatcactgcccatctcatcataaaagtctttaattaatgggaagctgtcaggctcataaatatcaaatgttttccaaaattctaatttttacataaaacccagccttttcattagcaagagatactgtcaattgttttctttgaagtagcaagctcattttttttccccagaaaatgtcaggtagctaagtctgaatagccatagtttatcatttgttctttcagaaggtaaaaatggtgttccatgaaaaaaagcagctggtttaacttgccgctcttcacttaagtgctttttctccagacaacatctgccggtatgcagaagtgctttgtgcgtactgcctattttgtcacgcaatatattaaaaaactgtacacaggctcaagacttaataaaatgaataatttttactgctgcatcaagaacattcttaagtgaaaccggtactccaaccccaatttgggtggtgatgaagaatacaattcagcgcttcttacagctttgctcgatccctcctaaggcttcagcagtgtctacacaccattgcttttacaccattggtacaaatgttgacatggtgcaaaaagcaagtaacatcttagtgtcattacgaaaatagttttgatctcacagatgccctgaaagagggacatccaggtttctgcccaccacattgtgaaaattgatgattctagataatacaaaatggcttctgttactgttctggtggtttaaaaacaacaaaaaacctcatttagttctctacctagaagagtgaattgcaactctcatcttgtgcttttacctgtgattttaaaaattgtaatcttgcctttgaaacaaaaatatgccaattcataataaagtctacatgagagtacatgtttggatttatatttctgtgcttctttcttttatataacataccatttcatatttgtgggcccagagtaaagagctcattctgttacagacactgaatagccttgtttttgtcagtagtcagctctgttttaaaacaattgcttgggtcctgctggctcaacttgcagttgtcctagtcctgagtcttgtcttagccaaagactgttgttggaaagcccacacaaaggccttgtgtataggatgccctactattaaaggagcatgttctagtctcagtggattaaatttgctttggtgtgcattcccttaccaaatttctcactactttgtttggctggttatttcagtgaaaaatcattttaacgtgaaggcagatttcttctaattattacatagtcctagtggtgacggttattggagtaaaataattttttttttttctggtaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaaaaaaaaaaaaaatatatatatatatatacacacacacacacacatatgtacacatacatatatatacatatatatgtatatatagaacacatggcaagagcaggaaatgggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaaaaaaaaaatatatatatatatatatatatatatatatatatatatatatatatatatatatatagttttactaggttttcatggataagtttttaaatgtaagacaggaaagggatctatttgatgtctatcttcagatatattggcagttttccttaagctatttagttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgctttgtagtttggtaattcttagattttactattggtttctttgcttagaatgagtttctaaatgtgaactacaaaaaccactctacttcaagcatgatcattagaagaaggttagggatgtccccaagcatcattttatcccttaaaactacagatagtttaggtttctgcctgaactaatctaagttagctttttcttcacatctcataaactaatggtgggaggacacaaagagctttatgaaaacatttttgatggcagataaggacggagtcataaagctgtatccatgcagatgtgttatgctgacattattgttattattgagatggagtttcactcttgttgcccaggctggtatgcaatggcgtgatctcggctcaccacaacctccgcctctggggttcaagtgattctcctgcctcagcctcccgagtagctgggattacaggtatgcaccaccacacctagctaatttttgtatttttagtagagacggagtttcaccatgttggtcaggctggtctcaaactcccgagctcaggtgatccaccagcctcggcttcccaaaatgctgggattacaggcatgaggcactacgcccagcctatgctgacattattaaagccaacagatagctaatctgaaaagttcatgtgcatttttttctttttttcttttgtttttttttttgagacggagtctcgctctgtcacccaggctggagtgcaatggcgccatcttggctcactgcaagctccgcctcctcatgtgcatttttcttgaattggttctgtgtactgcatttgttctgtggagcacctcagtgaatagaagattttgccctttccactctccagaggcttttgaccccaagttgtgctctttgacaatggagagttattgcgtaaaaagtgacaataaaatcttgacatttcatatctgcaaaatttcacttaaaaaaaggtaaatttcataggagtaagtcgcaaaggaaaatccataatgtcagtgctaataattgataagattagatctggaggggaaattgtaagtgcacagcattcattaaaatatttgattcaatcaactaattaatagcaaattcaaaacaaaattggaaatagttatataaaaattaatacaatttgtttgatcaaatgttttctttagaaagtgatctctcaaaaattgatgagtgttggtttacttctaaatatggaattgaaatgactttcagaatcacagcaaggtctcgattttcagcacctgattactgatttggtagcctagcacggtggctcatgcatgtaatcccagcactttgggaggccgagatgggtggatcacttgaggtcaggagtttgagaccagcctggccaacatggtgaaactcaatctttactaaaaatacaaaaattagccgggcatggtggtgtgcgcctgtaatcccacctgcttaggaggctgaggcaagagaatagcctaaacctgggaggcagaggttgctgagagccaagatcacaccactacacaccagtctgggtgacagagtaagactccatctcaaaagaaaaaaaaaaaaaatcactcatttggatttgtaaagtaaatgaaatttcaaaaaaaaaatctgtcttgagaaggtatgatgcctttgaggttgtaagtcaaatttatgtgtatagttttgctagttattaaagggatgctttataattaagcttctttttgtgtgtcctaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtattttcccacttatgtttgtttcagcatttatttatttatttatttttttagacggagtttcgctcttgttgcccaagctggagtgcaaaggtgcgatctcggctcactgcaacccccacctcctgggtacaagtgattctcctacctcagcctcccgagtagctgggattacaggcaggcgaaaccgcgcccagctaatttttgtatttttagtagagatggggtttcatcatgttggccaggatggtctcaatctcttgacctcgtgatcagcccgcctcggcctcccaaagtgctgagattacaggcgtgagccaccgtgcctggccccagcatgtttttatcaatcacagtttcatttctgacaaggcaccaaatattttatttatttatttaatactctttatataatactctgtcaccaggctggagtgcaggagttggaagctgtagtgaattctggtgtaatcataactcatgcagcctcaaactcttgggctcaagtgatcctcccacctcagtctcccaagtagctgggactacaggcgcataccaccatgccagggtaattgttttttattttttgtagagacgaggtctcacatgttgtccaggctggtctcgaactcctggccttaagtgattctcccactttggcctcccagagcactgggattacaagtgtgagccaccatgcctagccaaggcaccaagattttagcttatgattcttgaacctcaataatttaccttataagtgattagaagttctccctacaaatcttttctgaaaaacagctctaatgcttaattttactcttggatttaatatacaagttgtaattacaaagagttcttagggtatggtaaagtcaagattaatttaggctgcttttttttttttttgagacagggtctcactctgttacccaggttggagtgcagtggtgcgatttcagctcactgcaacctccatctcccaggctcaagcgatcctcccatctcagcctcctgagtagctgggactacaggcatgtgccatcacgcccacctaattttttgtatttttggtagagatggtgtttcaccatgttgcctaggctggcctcgaactcctgacctcaggtgatccgcccgcctcagtctcccaaagtgctgggattacaggtgtgagccactatgcctggcctatttaggtgctttaaaaatgtatttgaaatcaggagcctgaagtagtataaaatggtcacaagaaagcagcttgagaaatacatggtttaggaaatcaaaatctgtttctaatttgtcctttataccatttacaagtgacaaacttcagctttgctttataaacttttgtactgattctctatcataagtaatagaaatgttcacatcaatagagaattacaccactagagactatgctggggtaataaaagatttgctaagagcactcaatctcttatattctactgctatttttcctctgtgctagggaagttgactgtaatggcaagtttagcaacgtagaagctaccgtgaggaaatcttcaaaaataaatttatgaaattgtattaccttcctggaaccaaaggacccatgggagacagcaatgtggcatcagacttagcatttttaaacaaatgctcagaaataaagataggacattttaaaattactaaaaatacttagctttctggaatatcaatgacctagtaaaaaacgtaagtactgggctggcctggtggttataatcccagcattttgagaggtcaaggcggaaggatccttgagcccaggagttcgagatcagcctgagcaacagtgagacccccatctgtctatgatttaaaaacaacatcaacaacaaaaaaccccaaaaatcacaattaccggctttgctgtagaactatatacctcaagacttactaggatttctggctgggtgaggtggctcacgtctgtaatcctagcactctgggaggctgcggtaggcggatcacctgaggtcaggagaccagcctggccaacatggtgaaaccccgtctccaccaaaaattacaaaaattggctgggcatggtggcacgtgcctgtagtccccagttacttggaaggctgaggcaggagaactgcttgagtctggaaggcggaggttgcagcctccgccgagatcatgccattgcactccagcctaggtgacagagtgggactctgtctcaaaaaaaaaaaaaaaaaaaaaaggatttcttttgggcctattataaatgaaaagtacaaattttatcaaaacacttcatcatcgaaaataccttaatatttaactaaactatgagatccaatcacaaaaatattttcatggataaaaagctaaaatcttacatgggtgaaaatggaaaatgatattacgcatggcacagaataaaaacagaactaaacatgtagcaaaataaataggaccttgctcccaaaactaaaatgtgtttaagacttgcctaaccacacaaggcttttaggtaggtagtcttctgtaccttcagatttcacaccaacacctcaaaatccagaaatcattaaagcaaatggctttttattaaacaaatggctttttatcagtagggtaaaacataccaaataagtgtttcatttcatattattcttcatcatctcacaacacttctggaaagaatgtgaatttcttcaggttcatgagtatgaggccaaataggagagatttgttttaccctttttttttttttaagcaggatttcaccctgtcacccagctagagtgcagtggtgctaccatggctcactgtaacctcaaaatccagagcccaagctatcctctagcctcagcctcctgagtacctgggactgcaagtgcatgccaccatgcctggctaatttttaattttttttgtaaagatgaagtcttactatgttgcccaggctggtcttaaacttctgggctcaagcaatccttccacctcaccctcccaaagtgttgggattacaggcgtgtgccactgcacatggtctacgctttctgtaataagagacctccaaggaaatctggctgcaatgtttaaggttccatgagttcttttaagatgaggactgagactgctatagtggtctatgtcatactcccccatagtgctgggcatctaacaagctcaagtgaactgaactgaaacatttggaaactatagtctcagtgaatagatgcttggaaaaacaagatttatagtagattcaaagatggaagaggataatttaaataatacaatctgaaagagttgactcaagttacagattacagaaactaccccagagtattttcaattagtttacttggggccaggcgcagtggctcgcgcctgtaatcccagcactttgggaggccgaggtgggaggatcacttgaggtcaagagttcgagaccaacctgaccaacatggtgaaaccccgtctctactaaaaatacaaaaattagccaggtttggtgggaggcacctgcaatttcagctactggggaggctgaggcaggagaatcgcttgaatctgggaggcagaggttgtagtaagctgagattgcaccattgccctccagcctgggcaaagaagtgagactccattaaagaaaaaaaagaagtttatttgggtaatgccatatggaaaggagatgaaaatatagatgtatatggggatataaacttgttgcagattacacaaaattatatgtttaagcagagaatagtccagttaaaattgggatatacttaatttgctaagaacaatgtaatgctaccagcatgcttaaaattaaaaaaactaagagaatgtaagttcaaaatgagtgtcacatgactataattgatagtaaatcttcacttacctccataacttaggagtcatgaaaagaaagaagttagcagaccaggcatgtaaatcagatgtaagtaggatggaatacagaaatattcctagttctgggtaacccaatttgaggtcattttaagtttactgaatttggattaatcaattggttcaataatcaaggtaaaatggtccaaaagatcctgatatatccagaagacatattactgaggttttacaaggctaatttgaaatgcagattaacattctaggtttccttacatatcattaaaatagaccatattaaaaatcaatttcagaagctgctttatgactggaataaaaaacaattaaagatgtagagtaacattgtatttctgtctgatgctgggaggctattttttcatggcaagtaataactgggtaaacagagagatactttaactttacaaataggaatcctagaaaacaaggttttgctcctagaaaacaaaaatagttcctttcaattaattttctaaaaatggttgcattggtcactttttaaactcctacaatctaagcagcactgaattcctatttgatttttttttttgctaatagttttcttcagaagcaaacctgctttagggtgaaaaaaagtttcagaccttagacagaaccttcatttcctcttaagtatgtttctccatcaaaaacaagtattcaaataaagaatctcaattatctaaacctatttttggccatcttccggaatttcttgttaaatctcctttgaaatgccacagttgcactcttggaaaacttgtcttcctggttttcaaatttctgtttattattacagctcttcagctagaatgccaggtctttgtgctgtactgtttcttgaaactggagactagcacacttcccccaattcaattacttgctttccatttgagaaattaaagccaggtcaattttataaagttttaactgactgaattatttggactttaagttctcaatttcattcccttagcctaatactgggaaagatcttggttttattgagagaaggtaaggtttaagagtattaacacatttcagtcattgactcttataattgatataagcgtagggattttctaacaggcacacgcttgagatatgacactctaaggaaaaaagggagagttcttattcaattctagaaatgtttaagattacatactaatgatatagtttatttacataaatgtgtgttcatattttttctaaaagaaagggaccgactgtccttcataaagagcttcagtcagcttttctacccttatcagccttatgtaactgccaaatttacctctccagcctgacttttacatagaattccagttctgtatatccagccaccttaaatgaagacatttcaagctgaacgcctaaatatcaccttaaatacattgcagaaatggaacatattttccccctcttaaactagtttcttttcttttttttttgacagagtcactctgtcacccaggctggagtgcagtggcatgatctcggctcactgcagcctccactgcccaggttcaagcgattctcctgcctcagcctcctgagtagctgggattacaggcatgagccaccacgtctgactgatttttgtatttttagtagaggtggggtttcaccatgtttgccaggctggtctcgaactcctgacctcaagggatccacccacctctgcttcccaaagtgttaagattacaggcatgagccatcgcacccggccttaaactagtttcttaactatctcctttctttcattggtaactccattgtcttccagtatagaaaatgtataatcttttacacctcccttttatccaacccatcatgatattcaacaactttttcctttgaaatatcttaaatttattctttcacctccattctcctgccactattgctgttcaggtttcttcacccctagattactacagtagtcacatgcccagtttccttgctaccatattttatttcttagacatttctatatatagtattgccacatttaattccaaacaaatcaataggctataatgcctccctattccctgctatatcaagaccaaaatcctctaattggttttctaggcaaaggctcaatagcctagttctaacctagtaatacaaattcatgtaacctttgccttaggttttatggcacagatcccaggttacttctgggggaatgttgcattcaattttggcttaaattcctacctacaaaccagacaagtccattacttgacaactcaatgcattttaatttacaagcatgcaggccacaaattataaaatgaagactttttactgagtcagcagaaacaactgttcaattctcctgtaagtccccagttacttacagttttctgctgaggtgatcatctcatgtggcatttattgccctctactaaaatgagctattatctgacactctgctctgtacagacgtgtttctgtttccattttcagttccttctccacatggtctaagtaccagtagtttagtcagttctcaccttttttgaggggaaggcggcaatggtggtatcaaaatttacacctggaaaacaggtcataaagaaaatcaatatagaagggaaagtgctttaccacaggaattattatttaattgctggttgaattcttgacttttggttaaaaggtagatataacaaatatgtaaaccaccctcaaagccaaaccaaaaccaacagcaacaggcttttcaatcaatgtaatttatacattgggttctggaaaacagaaatgtcctataaattttatataaatgctatataagggtacataaaaatgaatccttattataaatatgacttaaatgtcatagcagtaaacaaatggtacttatttgatccacaaatttctttgccttcttagatttttttgaaagttttggtgtggcttggtttctttttgaagggccgagctgggagaaggaggaaaggcatttggtctcctataaaattgtccaagaaagtttatgagaaagcctatatcactcaataaggtggctccagtaagtttaggcattcaaaaacattccattaattttagagttaccttaaagaattacagcagatcctcaatgcttttgtttctgtgattacggtaatggcatttcttgaaaagtatttttaaatgtaaggattctttattctactaccacctcctatctcctcagagatacacaaataaaggcccaaaaataacagttaaactttatagaatttcacacttcattggaaaggttagaaatgatcatttagatcactaatgaccccccaaaagataacaaaatttcacaggcctgattattcatacccctacccacactttgctggttttgctgaaaaaaaaaaaaaaatgacattttaaggtacctgagacctgaggaatgaatgttaatagctcacacagaatgagaagagctctgatcagtgaagtagtaaaaggtagagggcactcctaaattatcagaaaataacctgcatatttctgtatttatctagcaggtatgcagcctttctaccactttaccataaaggtattactcctgattttcagcaatcaatggtcacttattttacacctactatgtttaagacactagactaggcttgcagaatatacgataaagaataagatggccccttcccataagacagcatgcatttgttctaagtcaggtatggaagcttaaatgagagaaatggtatttttggctgaggaggaaaagtgaactggaaaaatttcatgtagggggtaaatagcttaagttttagacaattgaagatgaaggaaaggacattctaggagtaaataacttgagttaaggcttggatgaaaatctgagtgaggtttgaaaaagtattatttctctttggcttaacaacagttattatggtattcattgacaattactcccatagtggtaaagtcaatcttacttaaggcaaaaaatatcctagatatagcattttgcctaggcaactctttcctctcaagatttctcacctgatttgctgagttaaaagccacagactcccaattatttagggtaaacttatttatgcctaggtttccttccagtatttcttacaagttttttgtttttttttcttcaaagcaacacaccatggctcttgaagggctgcaggcaatctgaatacccttgttttctttgattagaaatgagggtaaattatgcaaaggaaggaaaacaatctcaaacatgattatactcatttccctaccaattccctagtatctactctttgccttcattatactgtatctactttactccttgctacttcatcatgtcttggttcatgttgttttctgcactcgcaagttatcattccttcatttcacataatcaatcttaaccactttttcagcccagctcacctttcatatcctcttataagtcttctctgataagtttaagtccacatttccttcaagcttctaccacacttaagttagcaagccagagtttacattccattattctctacttgtttcttgtatgttagtataatattctcatacaggttacagttctttgctgacagggaccatcttttataaactatagtgaagtaccgcacctagagtaggcccttaataataaagataatgtcactttaaaaatgcaagcaggaaacgcttcaggcatttaaaagtagtattttaacaataactatttttgattaaataaaactatattcattcttcttttcagaacttgaagcctcaaattatcacctcagatcatcatgctattaaaaagtagatgtgcatatgaataaaactgtccaactctatcacttatacacaacacagccatgaacaaaagcagcagccattcttgataatccaatcccctctgaaacaaacaatttctggcagtaggagacatttacaaatacatagccttgctaacaaccactaggttataacggaaaaggtttgtaatttgaatcctttagagtgtgcatctttcaaatgtgtagtgaaatcataaatacaatgtaattttgttcagtttggaatgaagtgaaattttgcttaaaggaaatgaagattattcaagttgaagctttagttaacctgcattagtcactagcattctacttccaaaaaaaaaaaaaaaagtcaatcttaggaaaaattgcaatcaaacatcaaacatccttggcttaaaacacattcagcacaatttttaaaacctctatacctacattacagaatatagtagttcacccttattcacaggagataccttccaagacccctagtaaatgcctgaaactgtggatagtatgtaactttatatatatatactatgtgctttcctaaaaatatatatgataaagttttatttgtaaattaggtacagtaagattaacaagaataatagtaaaataaaacaatttaacaaaatgcaagcatcactactcttgtggtttggggccattatgaattaaataaggattatgaattaaataaggattatatgaacacaagcactgtaatcctggggcagtgggtctgataaccatgatggctactaagtaactaacaggcagatagtatctacggcatagaaacaatggacaaagggatgactgcgatcctaggcaagatggtgcaagatttcatcatgctactcagaatgacacacaatttgaaacttaaacgttgtttatttctggagttttccatttaatatttccagacttcagttgactgtgtgtaactacatggaaaatgggagacactactgtattacataagacttgataataaggtatgtctttatttataaaatgtaatgatattcagcatatactttattaaggcaagaaaatatattgaaatattaccatttttattaatgttttagaaaatattcaaacaaggtttaaaatgattatactccagaagctttacaggtgttaaataaaatttttttaaaaactaggccaggtgcagtggctgatgcctgtaatcccagcactttggagggccgaggcgggcgggtcacctgaggtcaggagttcgagaccagcctggccaacatggtgaaaccccgtctctataaaaataacaaaaaaacggccgggcgcggtggttcatgcctgtaatcccagcactttgggaggttgagacgggcagatcacaaggtcaggatggtctcaaggtcaggagattgagaccatcttggctaacacggtgaaaccccgtctctactaaaaatacaaaaaattagccaggtgtggtaatgggtgcctgtagttccaggtactcgggaggctgaagcaggagaatggcgtgaacccaggagacggagcttgcagtgagccaagatcacgccactgcactccagcctgggcgacagagcaagactctgtctcaaaaagaaaaaaaaaaaaaaaatcagctgggtgtggtggtgcacgcatgtaatcccagctactcaggaagctgagacatgagaatcgcttggtccagggaggcggaggttgcagtaagctgagatcgcgccactgcattccagcctggtaacagagtgagactctgtctcaaaataagtaaataaataaaaataaaataaaagtgattgtaaacttcaattaacagaatcatccagaactccagattgccccattgattcaattaaatttttgtctgataaaacttttagaaattctttttcttttttttcatttgcattgcctttcctttaacaacttccagtgggggtagttttcctttttgttaatcacgtctcacacagtcaaggtgtcgatctgacaaagagtaagagaaatgaaatctaacatagtttctataaatggtaaagttaaacacaatttccagaactctaagatgatgttgaattttccacataaatctatgagattatatttaatttttcccatctgctattttaagtaatatgtcagtatactaaatatctctaaaatgaatatattgaaggctgactctcttctaggattataaaaatttgggacaagacagagccaagttcaatatcttatttaaaatttaaaggcttagagaaagacagtaacttaaggtctttcaactaagcaatgacagagccaattctcaagtatttgaatatgaccacaattaacttctctgggacaggaacagtttaagcttctgtttacactgtcatttctcgggcaaagttaccaagctacctaaatacttctttagcataatcacaaatatgaattttattataacacattataatcttttattctgtttcatttcatggccttctaaacgtgtgggtaagctttagcttcttgtacatgctcaactgttatcttaataaaatgcatcctgatgaaactgaagagactagcaacagaggcaagtgcctctgaacaaagagacatgttggatgaatgaatagctatacacacataattgaccagtttgagactttaaaaatgagggcaatgcagaaaataacttatagattctcaacataagaatcatcaaattaatctaatgaacattttcacttctaatttatatttttactttttgcatattattcttaattcttgtatgaattcttcaatgaattctaagttatttctttagacattcctatggttaaagcattttcccccataacagcaagtaagataattgaaagattagaaaaaggattatttaatctaaaaaattcactttactatttctatgagaacttttatcttttcaactgagagaagctaaatacaaaaatactgaatatgaaaagtaaatactttgaaaaacagagaaggccctaagattaagattgtttattggaaataggattcttaagatttatcttttaaaactgccatgctaaataagtcagattgaatcattattaattcaaatagatatcatctactgtgtcagatgttttcattttgttttctttatatatggaagaaaactgtttagctaaaatatagtagataccacaaattgtaaaattatacattctaaatgaatacattaaaatgaaaaataagcagcacaattttatataaaagattataatactaggctgggcacagtggctcatgcctgtaatcccagcactttgggaggccgaggcaggtggatcacaaggtcaggagttcgaggccagcctggccaacatggcgaaacccgtctctactaaatgtacaaaaattagctgggcgcggtggtgtgtgtctgtaatcccagctacttgggaggctgacgcaggagaattgtttgaacccgggaggcagagattgcagcgagccaagatcaggccactgcactctagcctgagtgacagagcaagactgtctaaaaaaaaaaaaaaaaaaaaaaaagggaattctcaactacttttttaaaaaggagttctctctatggaaggcctaatttggaaatgtacttgggtccctatacaaagtcgtccagaagccagatgatttcccagtgtagtccaaaagccagatgatttcagggcaaagcatttgaatgctatggatttaggtaggcaagatccagaagcagagtactgtgggtctgggtgggcaggtagaattcagatgctgggaaaaacacaaacgcaatgctaggaaaaagggtcatgccttacaattcaggtgggacagatacaaatgaaatagtttcttaatgaggtagaaagaggaagttattaattcctgttcttgttggattctaacatacaagctaatttgaattcatcagcctaagcaaggttgccttggattttgaagttttcttaaggaataaactgtagagaaaccatagggccaaccagatggatgatgaaatggaaaaaacagcaattaaatacttttagaaagtattacaaattaataccttaaaaaccctgtatcttgagctagtagcaaaactaactggaattcctgacctctgcagtgccttcttgcaacatctcagaaaaaacatctgggaatccattttagtctgctaagagacttaagatttacatcagatatattgtcaaggtttctcttgtccttgttaccaaggaggtaaaagaagtgttgtaaaatttattcctcagctggcacattatctcagtgagaaatagagcccttacaaagacttatcttagacacaaaactacattattgtacttggcaagtaccatttcatgcttctcatttttttcctctgatcctttaatgaaactgtgatgttgatgatctataaatttgatctaattgaggctagaattctactgaaaagataatttctgagtagccataccaatactgatatcaatgtattttttaatcagagaattaacatattactgaatgtatatgaggttaccagcctatttactagtcaccaaatgacctgagttcaataagacagcctctgggctcaagcttattagccttacaggctaatagcagggaaatatagaagcatgtaaatcatgtgatgatttaacataagcaataatgagactgttttaagggtgatagtacagaaaaggcagttatttatttattttttttgagatggacttccgctcttgttgcccaggtgaagtgcaatggcatggtttcagctcactgcaacctccgcctcctgggttcaagtgattctcatgcctcagcctcccaagtagctgggattacaggcatgcaccaccatgcctggctaatttttgtatttttagtagagatggggtttcaccatgttggccaggctggtctcgaactccagacctcaggtgatcctcctgccttggcctcccaaagggctgcgattacaggcgtgagccactgtgcccagccagcagttattaatttttaacacaagtgtatatatgtgggagatggggttgcccttttgaggtaatacctaaaaaactgaaggatgaataggaatttgctacactaccattattgctctagaagagatagaatgaaattagtgattgttattaagccttgtcataagtccagatctttaaattgacatgaaatattaagaaaattctatgtctagaatttggattatttagtttgcagccttttagttgcaaaaggtgtattttctcttctagattttggtaaacatccagagggacagtgtccttaagtgacatttggtgtgcgcatatatatatatacacgtatatatatgtgtatatatatacgtgtatatatacacgtatatatacgtgtatatatatacgtgtatatatacacgtatatatatacatatatatacgtgtatatatacacgtatatatatatatattttttttttgagacagattcccactctgttgccaaggctggagtgcggtggcatgatcttggctcactgcaacctctacctccccagttcaagcgattctctggcctcagcctcctgagtagctgggattacaggcatgcaccaccataaccggctaatttttttatttttagtggagacagggtttcaccatgttggtcaggctagtctcgaactcccaacctcagatgatccacccacctcagactcccaaagtgctgggattacaggtgtgagccacggtgtctggcctggtgctttaatgctttaaaaacgaccaagtatgacctgtacattgtgtagacttactctggacagtagggtgaaggtagttttctcagggaactatgccattacattaaggactctaattaaattcatttgtctgtatgtatatccatgtaccacaaatacacacatgacatgaacacatatacacctcatctccaatgttactcaaatatatttctcattgcatgactccctggcggtgggaccagtggagaatgagaagataacttgtacttagtattttcacatacaaacctatctttaagacattacaaaaaataagttgtaaaaatgtcagtgtgttattagtctctaattttttttcccttctaaaacaagttctcaaaagcctatcatactatctctgatttctatttcaatggaagcagtcagtacaatgtgtgaagacctgggcataaaagcagcattaaactagtattaaacaagacaccagcattaaacgagacaataaagtaagactaaaagtactttggaaactaaaagtactacctaaaaggaaggtatcactatcattttgagcatttatttatgtagttttgtctcctctgcctcttgttggctataggatagaagctgtagatataattcctaaaagcgtaaacttcaaagtcaaaccatctgagcttgaatctggactcgctggcctgctggttacgtgacatgaggcatgctatttctctgtgacttggtttccttacccatatggataacaacggacctctctgagggtggctgtgaggactaaatgagtttataaatgtgaaagttgctggcaaaggataaacactaaatgtgttagcagttactatttctaccgctaataatagcatgtaaaccttgagttttccatatacactttagaaaaatcaacaaccctttcaggtaactattaaaatgtttttatttgatggtttgggtccttttcactataataatcacataaaataataaaaatttactggcctatgttccagaggggcaaataaatattaacaaatgtgtcagggctgatgttcatttacaattctttctcatatcaataatcttataatttggaagagaaccagggtagtctaaaaagtacttgaaaactgaagagcctgcattaaaggatgaattaaaaacaatcttttcaaccaagtgatattgtttaatcaactctcaacaataatttaggttcaaaagactggcaaagacagtacagaatgagtattttctgcatatatgatgccagaatcaactgacccactgccaatttcagagaagactgaagaaattaaagacatttcttttaatcaataactgaacacctattatgtgcctggtagtgggaaacacacacacacacacacacctctaattgaagctaaattcctatttactacagaacaagaattccaagggtagtatttctaaacctaagctatggctccgtagtctcattaatgtctaagcgtcctagaatataaacatcaaaaaatcctcctttgatactactaactcaattctccccaaaagtatatggttatatatccttgtggaattgattccttcctgtttatccagattcttcacctttatttgcttttatggtcttaaaagggaaatgactacttaataatccagttctacactgggtttcctactgcctccaagaaatcttcttaagacaagcgctaacttacaaaagctttaaatatctctaaagatatttaaaaattatgtctctactcctagtattttcattgcatatatatatttgagacagtctcgctctgtcacccaggctggagtgcagtggcgcgatctctgctcactgcaacctccgcctcctgggttcaagctattctcctgtctcagcctcctgattacctgggattataggcgtgagccaccacacccggctaattttttgtatttttagtagagactgagtttcactatgttggtcaggctggtctcaaactcctgacctcctgatccgcccctcggcctcccaaaatgctgatattacaggcgtttgagccaccgtgcgtggctctgccttacatttttaaagctaggatttgttcaagctgatatggtgatttgcttcacttcaaaaaatgccttattatcttgattaagagtgtttttcccattttacccattttaaggtcctgtaaggcagtcatttctataatgtacacatccactactagtagaaaacccttgctttggagtttatatttgcctccctgaaacttgatttgcccagttttgtcctcttgtgcaataaagaataaacaagtctcaagattattattttttttctttttcaagcaggcttctcagtacctctagccactcctcatgacattcaaacacctcatatggtttccattctctgagttcactctagttggttcacattcatctacatactctacatgtggcctgatatgagctacataccaagactgccaattaacaatggtctgggggaacaaatgtttatcagcaaataacagtttagccaaaataaataatttgcatgctagctttgaaatttgctgaacccttacctataaactcttaattaaattctccaacttgagtatacagacaccaagaccatctggtatcattgaaaataaagaaacatcaaagggatttggtttcttaatgaatagaatatagggagtattttaaaagcattacaatttcttcctgaagttatacctatgtagaactttctagaaagaacaagttacccattcttaaagctccaaattcaggccaggcatggtgcctcatgccgtaatctcagcaccttgggagactgaggcgggaggactgcttgaacccagaagcagacatgcctgggcgacaaagtgagaccatatcactaacaaaaaattctaaaaattagccgggtgtgggtggtgcatgcctgtagtcccaactactcaggaggctgggtggggaaaatcacttgagcccaggagatcgaggctgtagtgagccatgattgtgccactgcactcccaatacagcaagaccctgtcacaaaacaaaacaaaaaaccaaaacaaaacccaaaaccgaaacaaacaaacaaacaaaaagctccaaattcctccggttttggaggttatctaaacacatctaaaaatcattaattcaaaaatggcacaacagcttaactactatggacctgaggctttgagtcattttattttgagacggagtttcgcttttgcccagcacccattaaaatgctgacaaaagtggtcataacagagggtttgacttcaaatctgaaccataggcctgttttggcagcaaacatccttcttccaaaatagccagacttttagacttccaaaataatatagtttattctgttagcccagctgtttctctggttctaaactttttttttttttttttttttttttgaaacggagtctcactctgtcgcgcaggctggagtgcagtggtgggatctcgattcactgcaacctccgccccccgggttcaagcgattctcctgtctcagcctcccaagtagatgggattacacgcgcctgccacgtttgtatttttagtagagacggggtttcaccaccttggccaggctggtcttgaactcctgacctcaggtgatccaaaatgctgggattatgggtgtgagccactgcacctggccttaaacctgtctttctgaatgaaactactattgctcttttaaattataaaattagtgtgtgagacaaatggattaagacatatcatttttgcttacatcataaatgggtcaaattctgacaaaaacatatttattatactagacaggccaaacatttattgagcttattagtgtcatgtttacattttataaccatgtttaaaatgaaatatccataactattggttgtcattaatagtaagaaatgtttttgaatatccaatgtgaattccacaattttacaacagctcagctttttgataaatgtaactattgaggtacaaaagaagaaacaaactcaaaatttgatatacaggtcttagattttttttttttttttttctgaggcagggtcttgctctctcacccaggctggagtgcagtggtgccatcttagcccactgcaacctccacctcccaggttcaagcaattctcctgcctcagccccccaccacgtagcagggactacaggcgtgcaccaccatgcacggctaatttttgtatttttagtagagatggggtctcgccatgttgcccaggctggtcttgaactcttgaactctggtgattcgccagcctcagcctcccaaagtgctgggattacaggtgtgagccaccacggccagatttctctctttaagcaaattctgaccagtacacgtatttcagaagttatttttcttactctcctgctcagaatacttcatgacctcccttgcctcaaattgttttcactatgaaaaggtatccttggggatgacatgcggatatggtagaggaggaatccagagtaaacaagatgcatcttcctgtatcctcaatcttgaggaaaaattctaatcctaggcatttttacattacaatactatggaatagatataaagttagtggtaatttttagataaaactcaaatctaaagaaaatatttctgagccagaagcatagcactaaacctcttctctagaggaaatataatctttctagtccctggcacagtaacgaattggattgagaaataaattcactaatccaaatatgcaactagaagggtgtatatataaggctaataacaactgcttttggatgataaaaatgatttttaaataatttttttttgctcttcctgaggtttctatgtctatatagtacttttatgctacgaaaaattaaacttaacagaaaaatgcttaatttttgtatatggaagtttcattgcattatcaaatctttatcactataaaataaaccagatttgtatttctttagtttgtttactaatatagtttcaaattaaaagagatttaaatatcccttttcttacacttacctttttttgaggtctgggggggcttgaagagtggggaaatgacagtgaaatctctcaaccacgaactcaagaagtaattcttgaattccttttcaatattactttgagaacttaaagcacgctgttcctctgaagctgattttaaacttatctgattttgaaatttttcttccatgacagttaattcattatcatgtctaaagttcctcaacacagtaggattcccttttataggtttccaaaagtaaatcattatatggatgtaaggttgcttcaaataatcacttttatttttcaaggatttctctctctccttttcaaaaaacaaagtttgcccatcacagaaatcatacatgcttatttataatcaagaagattcctcccacccctataagatttatctctcacccagagtaaaccagtaaaacagtttagcatatgaattattctggtgaatctattcaactatttgataatcttttacttattcaataatgaacagctttttagctcattaaatattcacttgctattttaagtagctgcacagtatcctactgaacatgttatttcatcagccttttattattgaatgctttataaacaataccataacaaacatatggattacttctttaaaaagtgtatctgttaattgcttttacaatattggaaaactgagataattattcttttaatgtttataaatcttaaggatatattgtaactggttcatacataactatttgaagaatttaaaaagtcaactatataacttgtcagcataaaattaatatctgaaccttgggacctgatgtttaggctactgttttgaagtttcttaaatttaacttttttttcatattgctaatacatttaaaaggttaacctatatgaataaatgagaaacaatgatagaaacgttatatacctcaggtgtgcgaaagtagagaaaaaggttatgagctacaggtatcatatgttcattccattggaaggatggttaatattagactgttaaggtcaagaaacagtgcacatgagaaattctgccttactaaaaaaaatgtacaggcattagttgggggagaactggagtgatgaaatggcataaataaaggcaaagagaaagaaaaatggattaggactagttcatttgaagaaaaattaaacaacatagaaaatgttgggacaagaccacaagacatcaaagaaagaaatttaaattgtatactataggaaaaaaaaagttaggaagattaaaaaagtagtgtatactatatagaagatgaaattgttagtttaaaacagctagaggtgacccgggcacggtggctcacgcctgtaatcccagcagtttgggagccgaggtgggtggatcacgaggtcaggagtttgagatcagcctggctaacacagtgaaacaccgtctctactaaaaatacaaaaattagctgggtgtggtggcagatgcctgtaatcccagctatgcaggagactgaggcaggagaatcgcttgaacccgggaggcagaggttgcggtgagctgagatggtaccactgcactccagtttgagcaaccgagtgagactctcaaaaacaacaacaaaaacagctagaggcaaagaactagttaaaatgctgctaaatagaaataagtgaaaaacaacgaagtacttaattatagtagaaatttcaaggatgaagtaatcaaaaacactgtggttcatttgggtatatgacaaacatgagcaaattcagtgtttcttggagtcattagttttggatccacctaaattgatcacgcagaaaacactttcaaagccatcaatgcaaaatttgcaaagtcctgatcatcacacaatacctattaaccccccacttaaacactgtttgtattctaagttggtctgatggggggtctaatctcaaatcagattcataaaaatattctgtcctatctgccgacatcaaataggctaaggcacatatacctgtcaaaactatcttaaagaagtatgaaaaactgggccgggcttggtggctcacacatgtaattccagcactttgggaggccgaggtgggcgaatcacgaggtcaggagttctagagaccagcctggccaatatggcgaaaccccatctctactaaaaatacaaaaaaattagctggacatggtggtgggtgcctgcaatcccagctactcgggagggtgaagcaggagaattgcttggacccaggaggcggaggttgcagtgagccgagaatcatgccattgcactctagcacgggcaacagagcgacactcactcaaaacaaagtatgaaaaactgaatctgtagctcagatatcttgtagcttaaacagctacaagatatggcccctatcaactctctgatcctataagctactattcttcctgtttatatttgatcacagctacatgtgcctctttgctgttccatgtacacacaaaaaatgcttcagcctcagggtctttgtatttgctatttcatctgctcagaagggtcttctcccaggtacctacatggtttgctcccttattgtttctaggtctttgttcaaatgtcctctctgtagggtagttcctgaccatactatttaaaaatatctctcttctgccttacaaacacctttatcacatcattctcactttccctgctttattttctccacagaacttgtcactctctgacataccaaatatagtacctaccagcttttttgtccattcattccatcactcactcctctacccccaagattaataagcttcaagggggctgggatatatattttttattaagtgataatcttcagtacctaaacagtaaataaatgtgtacctctctatatataaatgtttcaaatctatttttaatgttgcttgttgaacattaacattttcacacttccagaaatgacattaataaaaatataaacaaattgatataaaaatctgtgtagactaagctagaatttacaaactcttaataaaaggtgtatttaagctttctcaattatgggacaacaaataatagacttcattgcttcatactaaaatggtatttttgactaatcacaaggaaacttaaactaccatatagttataattataggtattcagtccaaagaggaagaaagttttagtgttactataagaagctgtatctctgaaaatgttagctccataagtgtaagcactcccgaagattataagataataaaatatggaaacaggcaaactctggggcgatttaaagtttctaccacttcctaatgattttctttaatagaatcattcgtgctaagtggataaaagttacaaattacaaaagaaagatacagaatacatccaataacaaattaatcagactgaggaacatttagtgtaaaactggcttaaaattttttgtcagcagaatttctcaacatctaaccctatagcaaataatacaaataacaaggagattcttcaagcagttggcatttcttcaaaacacaagggtccaattataagaaaaatatcacattattcaaagtcctacagaattagaggagaatctgtactactcatatttttgcataaattccatgatttatacataaacccaaaatataaattataaacatttaatttcagtataacgtagacaaaaacagcactaacttttcatctttcaaagtaattttaacgtaaaaggtttaaacatttattttgccaatatatttttcatttcatataggcttagaaaaaaaaaagacatccgaaatacctgagatgtattttataagtaaacaaagtaagaacataaacttaaatttctggtggaggagttaggtcttcattaaaagggttcaagctattagtaataaaatggaagttataagtaatcccttgacatgtgtaaaataaatttttttagtagatgggaatgtactgatgatagtctcttatttcttctcccagatatgcaagtgatataactaaatacttactagagccaaatctatctcaaaagtttaggtcatttttttttcctttttgatagtattcaatgagaaataacactttaaataaaactttttccatgaggaaggtacagtaattatccacctgcaaaaggaaaaaaacacaatttgatttagaatgtcaacttctaaatatataaatatattaatttagagaaagaatagtttatgaaagcataatcttgctaatccaagtagggctaactgatgcatgtaacagtaatgacacttagtggcttaaaaacacctataactctatattaaccaaaaagatacataactgactgaagaaaatctttaatgttaaatacggaatttagtctacagctaggctaagttttcaaatctactatcacatattaatgtgtgatcttgagagatttgtacttgaatataagatgcaaatagaatgactgaaatacatttcttgctacttcctggatactctcctgtagtcctctgagtaagctccaaactcaatccgtaatccaagtaacagacttaagatgttcaatattggaactctttggcatcaattaaaaaagaaacctaaatgaaaaagattagtatttttttccaaacaagaaaaaatgaaaacttaatatatacccctatataactatgtgcagtttgttttgcaaaacaaaaagccaaaataagattaacactaaaaggtataaactttcattttactgctggctccttatgtgtttcaaaattataactctacaaataaaacatccagcactgttgagagtttcctaaatgttatttttcattagatatcgacaggccacctcctcttctctaagaagagactggaatgtacatactataagttttaatgcaacacttttcctatattttcttacttctcaaatatttcaattttcctttaattcattgtcaggattaaaaataagaaaagtcttcatttagctataaaagctgcaaatgatccttcatcacacttaagagcacttaaagatataaagaatcatctggtaaatgtaaaatgcaaattttttcttgtcatttagaagacagattgaatataattttctaaaacctgacttcagatacatttaggaatacaaagaaaaagaaacaaaaaacacctaactcctgggttgttctaaaaaatattagacagtattgggtaaactttgtaattcattcaataaatattctaagcatttgtgttaagtcctggaatatttttagtggaatcaaaaattatatatttggtgaagtctttcatgcaatggttgaaaggaaataaaacaagttaagagattgataaatgatttttaaaagcaccaagacagtgtttccatgcaaacgctggcatttagttctatccactatgtatggtatattgggaacaaaatattgctggataaaaaatgagaactttaatataatatttgatcttcaaattagaatttaaacaaaaaggtccttaagcttttgaatacaatttcttttttgttgttgttgagacagtctcactgtgtcgcctagtctggagtgcagtggcatgatctcggctcattacaacctctgcctccagggttaaggcgattctgctgcctcagcctcccatgtagctgggattacaggccccggccaccatgcctggctaatttttgcatttttagtggagacggggttttgccatgttcgccaagctggtctagaactcctgacctcagaggatccacccgcctcggcctcccaaagtgctgggattacaggcgtgagccaccgtgcccagcctcgaatacaatcccctttccctttccctttcccctttcctttccctttcccctcctttccaggctggagtgcagtggcgtgatctcggctcactgcaacctccacctcctagattcaagtaattctcctgactcagcctcctgagtagctgggattacaggcgcgcgccaccacgcccagctaagttttgtatttttagttgagatggggtttcaccatgttggtcaggctggtctcgaactcttgaccttgtgatccacctgcctcaggctcctaaagtgctgggataacaggtgtgagccaccacgcttggctcaaatacaatttcttaaattacatctgaagtacttcataaatttccaaaatagacaattctgattgtaaaggactaattaacaactgcttttattttgtagattttctgcatggttacaactgaaaaccctaacacactccttgtacaaaataataccagagttatgacagactatgcaaatacactcatcttctcctgaacatcatttttaagtttaatgactttaaaacactacagataaggaaaagaacgtaaatagagcatttctgttcagatttttgttgttgttgccgttaagatggagtctcgctctgttgcccagactggaattcaagtgattctcccgggttcaagtgattctcctgccccagcctcccaagtagctgggattacagacgcccgccaccacacctggctaattttttatttttagtagagacagggtttcaccacattgcccaggctggtctcgaactcctgacctcacatgatccacctgccttggcctgagattacaggcataagccaccaccgtgcccggccttttgttcagattttaattaaattaggccaggggtggtggctcatgcctataatcccagcacagtggaaggctaaggcaagactgcttgagcccaggagtttgaaaccagcctgggcagcatagtgagaccctgtctctatttttatttatttatttagttttaatttttacattttaatttatttttttgagatggagtttcactcttgttgtccaggctggattgcaatggcgcgatctgggctcattacaacctccgcctccccggttcaaacaattctcctgctttagtctcccgagtagctgggactacaggcatgtgccaccacgcccggctaattttttgtatttttagtagagatggggtttcaccatgtcggtcaggttggtctcgaactcctgacctcacgtcatccaccctcctcggcctcccaaagtgctgggattacaggcttgagccactgtgcccagctctacttttcttttctttttttttttttgttgagacagagtctccctctgtcacccaggctggagtgcagtggtgcgatctcagctcactggaagctccgcctcccaggttcatgccattctcctgcctcagcctcccgagtagctgggactacaggcgcccgccaccacgcctggctattttttttgtatttttaatagagatggggtttcaccgtgttagccaggatggtcttgatctcctgacctggtgatccgcctgcctcggcttcccaaagtgcgtgagccaccgcacctggctgtctacttttatttttaataaaaaattttaaaaatacaaaaaagtaaaaaaaaaaattaaattatgttgacattttatatcaataaaactacaatgataatttggtcttactctgagttaaatcttgaatacaaaaaagtaaacaaagtaaacaagaccttatttttgacttatcaaacaaaaatctttggctaaggatttaagaaaacattttaataaaaacatgaaaaaaatagtataccattataaagttagaagacataagactaagaccccaatctgtgatgtgtagcaaattatttgagttttgtgtttccttagctatccaatgagtgggttggtcacttgtaagggtttttctacctttaaagttatggttaagtgtgacgttttgacaaccagaattttaggtatttaattcacatattttgatggcttttccccttcagatataaagaaatattcagaaacagtactaaatattgtcttctaagctctgttcaaaatgcttaatatattttatatttatctgtaaagacatattttaaaagtaatttcaaaacaaagggaaaactagaatttgttttatcccaagtaaaaatctgaattaatgtctatgttgaatataaatgtgcattaaaataaattcctctaatgctgcataagctttttaaaaaaacttgatggcattcaatacaattattaaattgcaattacagtattttaagagatgatacatctgaaaaattagtattaattcatttttacagaatcatactaaaaataacaagattatcaataatactgaaaagactatcaataaaactgaaaacacattagtaacattaatatacattaaaacacaactgtagagtatggtcaaccttacttcagcagcacagttaatactggagataattttagaatcttaacgccaatatttacgtgctgctaaggcactgctgacattgctatcataagagctatgaataaaaagaaatatattttcttcagaagatcagatccttgtatttttgaggcagcacaatatggcctgcaccttttcaaaatccacaaaccattatgtgctgctactttactccaaggttttattttttttaaacacacattcgcgcctaaagaatataaaaaatattttctttcaggaaaaaaagaatgcatgtaaaaaaatctatgtttaaacattataacattgatgtaatatgcataattatttttaaggagattttaagtagaataataaaacatttctacatcaaaaacttaactgaagtccattctgtgcccagcacagtgctataggttaggaaacacaaagaataaaatgaggaaaagaaaagcatttatttgctatgccaacttaacagggcaatacaactaaatgcttaaacttttgaatatattcaatatatgaagttatttttccttgtataaacaaacaagtaaatttataaaatttgatctttaccttggtaaaaggagaatttacaaacattttgttccttgcagtacacctttcaaaagacatcttcatcaaataggtaagacttcacatcaagggaaaaacatgaaatgacatacaagagctcagtttcaataaacttaagctagcaaaatgcaaatatacttttaaagaaaaatactttaattctaaatgttaattttattaaatatctaattaagacattttaattccaaatatagttaagaaaaaaagctctaaacaaactaattctcccttaaataatttgttattaataatctaaatattttactttcaacattgatcttcatactagaagttctcttagagttggatatcatttgatacagtaattctaaaatatgaatccttaagtaattctaaaatatgaatccttgggatgatgagttaatttggtaccctgagatgagaaataaaacaaatcccatagctcttaatcttcctattccctgtttctggcccatttaccaggtaaggaagaaactcctagtttccactttctcagatgtagaaatgaaattccttttctctaaaagatatcagaaaattgccaccactctagtggtgccaccattcaagcctggacaatcttttttgccccatgttctcatcattaaaatgactatgctaaagttacatctattacagaatagtaaggtgatgtacacaaccaaagcactaaaatttgctcttccattctaatatctaattacttatacaaagcacagggtcacattccatatgaaatttttctgagtatttttcccattaataaaaaatatatgtagctaatctcctatctaagcaacctggatttcacatataactctgctccttattgtctcaagtttctgcacaacgttttttaaatttttattttttctttttttaagagagtagtttccgtatcttttagagaaaaagaaattcatttctacatctgagtaagtggaaactttaggagtatacttccttacctggtaaatggaccggaaataggtagggaataggaagatcaagagctacaggatttgttttacttctcatctcagggtactctgttgcccaggatggggtacagtgccatgatcgtagctcactgcagccttgacctcctgggcttaagtgatcagtccaccttagcctcccaagtagctgggactacaagtgcacacaccaccatgcacagctctttacatttttattttattgtagagacaaggtcttgctatgttgcctaggatgtcttgaactcctggcctcaagcaatcctcctgccttggcctcccaaagtcctaaaattacaggcaagagccaccatgcctgacctgcactttttttttattttttgagacggacagggtttcaccatgttagtcaggctggtcttgaactcctgacctcaggtgatccacctgccttggcctcccaaagtgctgagattacaggggtgagccactgcgcccatcctgacctgcacaatttttaacatgtaaccaagataaatccgtttgcattcacttgagaaatatataacatatatttgtatttatcaattatattaaggaattgtccttcagggtccccctcatcacatacattttccagataaaaacttaaacataatttttttcaaatataaaaggtgcctgtaaattatttaacaaatattttattgaatatctactatgtgccaggcactgtcccagttattacactagttggtagtataccagatagacagtctcttttcagaaagagtaaagtcattttaagacaacttaaagtgaaggatcttaagctgaagaatttagtgccagcaaaggatggtttgagtttcagaaagacgtttggttttaaaaatgtcaagataacaggagaagcggctttgaggcagcagatgagttcccagacaccattaagaaaatcgctggggagaaaggacaggttttttttttttttttttttgagatggagtcttgctctgtcgcccaggctggagtgcagtggtgccatctaggctcactgcaagctccgcctcctgggttcatgccattctcctgtcttagcctcccgagaagctgagactacaggcgcctgccaccacgcctggcgaattttttgtatttttagtagagacggggtttcaccatgttagccaggatggtctcaatctcctgacctcgtgatccgcctgcctcggcctcccaaagtgctgggattacaggtgtgagccaccatgcccagcccaggatgggtttttaatgctgataaatatgccctattctggaagaaaatgccacaaaggacatttattagtaaggaagaaaagcaagcaccaggatttaaggcaggaagagataggcaaactctactgttctgtgcaaatgcagtcggtttgctgcccttagccataaagctgctaatccctgagcctcaaagggaaaaaacaccagcagccagtcttttggttgtacaacaagaaggtatgaacgagaatgctttttctggattggttccatcaatgctttgttcccaaagtcaggaagtaccttgccaataagggactgccttttaaagttcttttgatattggacaatactcccggccacccagaaccacaagttcaacaccaaaagcactgaggtggtctacgtgcccccacacaatgtctttatttcatcctctgtattagggtcataaggacctttacagctcattatacattgtactctgtgggaatgactatcaacgctgtggaagagaaccctgatagaataacatgaaagtctggaagaattacaccactgattatgccactgttgttacagaaaaagctgtgaatgccatcaagtcttaaacacattcctggagaaaactgtgtccagatgatgtgtatgacttcacaggatttatgacagagacaatcgaggaaatcatgaaagagactgtggttatgacaaaaaaaggtatggttggggaaggccgaagggtttcaagatatggatctttgagaaattcaacagctaacagacaccacaccatagaaattaacagacaacttgatcgagatgatcggttctgcactagtgccagatgatgaggaagacaacatagaagcagtgccagacatatactgctggcactgacattagagagtctggcagaagggttgcaattattcaagactacttttgatttcttttatgacatggactcttctataatatgggcactgaaactaaagcaaaaggtggacagacgattgttaatatataaaaacactttttagaaaaataaaaaaagcaaaaaagtcaggcagaaattacgattatttctgtaaagttacaccaactgtgcctggcctttcctgcctcctctcccacctcctccacctcttccactccagagacagcaaaaccaaccccttttcttcctcagcctgctcaatgtgaaaacagtgaagatgaaggcctgtatgatgatccacttccatttaatcaatagtaaatatattttctttagcttactttaatatggtatatgatatgcataacatacagaatatgttattgactttatgttattggtaaggcttctggtcaacagtaggctatctgtagttgagttttagggaagccaaaagttatacatagattttcaactgcatggggattggcgcctctaatcctcacattgttcaagggtcaattgtatttttaaaattgtggttcaatatacataaaagtcaccattttaaccagtcttaagtgcatgcttctgtggtataaatatgtttgccctgttgtgcaaccctccatctccagaactttttcatcttccccaagtgatactgcttaaacactaactgtccatctcctctgcccctcagcctcaggaaatcaccattctactttctgtctctatgaatttgcctattctagttatctcatgtaagtggaatcatacagtatttgtccttttgtgtctggcttacttcacttagcataactttttcaagattcatccatgttgtagcatgcaacaaaattttcctctttacagttgaatagttttccattgtgtgtgtatacattttgtttgtccattcatgtgatgatgggcatttaggttgtttctgtctttggactattatgaataatgctgccatgaacatggtgtacaaatatctttgaaatccttctttcaattattttgggtatatgtccaagtggaattgctggatcttacagtaattctatttttcatttttttgagaaactgccatactgtgttctacagtggctacagcattttacattctcaccagcaatttacaacttctcccatcgttgccaacatgttattttctgtttttgtttttgataatagccattctaatgaaaatgaagtggtatctcattgtggttttcacttccattttcctaatgaatagtgatgttgagcatcttgtgtttgctggccaattgtatatcttctttggagaaatgtctatttaagtcctttgcccattttttgactgggttgtttactttttattgagtttatacattctggatattaatctcttattagatacatgatttgcaaatattttctctgattctgtggactgacttttcacggtaatagtgtcctttgatgcacagaagtttaatttttttttttttgagatggagtcccattctgttgcccggggtggagtgcagtggcacaatctcggctcactgcaatctccgcctcccaggttcaagcaattctcctgcctcagcctcccgagtagctgggactacaggttcccgccaccatgcccggccaatttttgtgttgtttcaccacgttggccaggctggtctcaaactcctaacttggtgattcacatgcctcggcctcccaaagtgctgggattacaggtgtgagccacggtgcctggccagaagttttaaattttgatgaagtccaattgatctacttgttttgtctgtgcttttggtgtcatatctgagaaatcactgccaaatccaatgtcttgaagcttttgccctttgttttcttctaagagttttgtattttttaactcttatgcttaggtctttgagttagaaattaatttttagttactttttgtatatggtgtatggtaaggatccaactttgttcttttctggtgtggatatccaattttcccaataccgtttgttgaagagtcctttctttactgaatgaggatctttggtacttcttggcacctttggtgaaaatcacttgaaaatatatgcaagggtttatttgtgggccctcgggtctattttcatgaatctctatgtctagctttatgctttgtaggaggttttgaaatcaggtagtgagacctccgactttctttttaaaatttgttttggttatttcatgtcctttgagattccatatgaatgtgagaataaatttttcccatttctgttaaacaaaatttaggattttgataggaattgcattcactttgtagatcattttgggtagtactgtcattttaacaatattaagtcttccaatccataaatgtgggatgcctttccatttatttattgtctttaatttctttcagcaatttttttttgtagttgctgtacataagtcttttacctccttggttacgtttatccccaaatattttattctttttgatgttttataaatggaattgttttaatttcctttttgaattgtacattgttagtgaacagacacacgattgatttttgtgtgattttgtatcatacaactttgttaaattcattagttctaaccgtttttggtggaatcttaagggttttccagatacatgattgtgtcatctgtgaagagataatttttctttactattatcttttgtaactaaaattggtttaagggctttctggcaatctcggtccattcattctctaattctcctagaaacacatcagacagctgtgtcccctctcttctttcaaacttccaacactttccctttcatttttactttcactgagaaaacagaaactatcagaaatttcctcagttcccaccaaatctaacatgtatctgtgtgcatacaactcttacttctttctagtatcaatgaaccctcactgttcataagacaaattccttctctttgatcttcacttacttacttaaggatattcctttagatattctcctgcatctttaatcttcctctctgttgcatgattcttatcagcaaaagtgctacaatttatctcagcataattttatctcttaaagactgttgctatctgtaataacactgcaattttatcactgatgttttagtaaaccaccatggaggaagactttttccttgtctattttccttttatttctaactatctgatttatatttgaaagcctgaaacatttgaactattaaaatatttattataattctccagaaaaaaatatgaaaattcttgatttaaatgtattaacaaattgaaagattcagtggaacaattccaagcacatagagaggatatatctctttcttttcttgtgttcgataataataatctcctcccagtgtggtatggtttgatttttcctttccacttatcttcgccttaggggctgccaaagtaggttttatactatgccttcaaaaagggactattttaaatttaaaatttccttgagtctataagtttagactatttctactcacatgatagggatattcagatactaatacatgccatcaatatggttttgctagtttgttgtttagacatgtccttgtatggcactatgttactttaggttttctgaacatttaattttactttcaatccagcatcaacacaatctgtaatggtaattacttcctccaaatatgccttacttctattctgcacttgaagctctaaggaactgtgtatatacagtgcctcggccacagaatgactatccttgctcaatgacagtggaataatacacagtatgtcagtattataccagacagaaaatttataaatagctattcttcaatacctttacgtaaaggcctgagttatggggtctaaaataaatgcatgacaatttcactaaacatggtaattttttttttttttttaagacagagtcttcttttgtcacctaggctggagtacagtagcgtgatctcagctcactgcaacctccttctcccaggctcaagctatccttccacctcagcctcccaagtagctgggactacaggcctgtgccaccacgcccagctaaggtttgtattttttttttttttacagacgtggtttcatcatgttggccaggttggtctcaaactcctggcctcaaatgatcctcccgccttggtgtcgcaaagtgctgggattacaggtatgagccaccatgcctggcgaaacatggtaatttttttattaccctactatgaagtcttataaagtgtccaaatatataacatttacaggaaagattaaaatgtgcttttgcttgattcttgtttctggaatataaatacttaaaaacaaaaaggctctattaactagagaagatagctttaaaattcagtgttaggaatacgcattcaataaaataataatcagatttaatccaacatgactgttttataatataaaaaacctagttgttgagtttaggcaaatataaagttttactgtttctaaactgccttgatttcttctgatgaaaaaatgactgaaagattgcttaaaaactgtgtatgaagtagatttcaatctggaaaatttattccagaaagtcagactatatatataagccccccaaatgttattttaatattagattctcttataatcatttccttatacaaaaagttaaacttcttagaaatcaaacattcatattttatttgatgactttacttcctaaatactaagtatgactaaattacaaatatatcatgttagtcaagaaatgcaatataaaaaggtttgataaatatgctatttacattttttcttacattcttcttttgctcccttttatgtcctaatcattcatacttgcccattgttattctttcttaacactcaattttcatcttgtgtcaatcatcccttgtattcagctagtcaataaaatgaattgattctttaagacctcagttcattgatttcttcgccattcttgatttcataccttaaatctggatttaagtaccttataaatccaattgcattttagctggacctcctagtccttaatcaattaataaatcttcccaaagttacatattcaagaatgtatctaggctggacgaggtagctcatgcctgtaatcccagcacttttggaggctgaggtcggaggattgcttgagcccaggaatttgagagaccagcctgggcaccatagcaacaccccatctctacaaaaaaaaattattattattattttttaacttttattttaagttcagtggtacaactgcaggtttgttatgtaggtaaacttttatcatgggagtttttttttttgtttgcttttttttttttgagacagagttgcactctgttgcccaggctggggtgctgtggctcaatctcggctctctgtgacctccacctcccaggttcaagtgattctcctgcctcagcctcccgagtagctgggattacaggccagcgccaccaagtcgggctaacttttttgtatttttagtagagatggggttttgccatgttggccaggctggtcttaaactcctgacctcaagtgatacacccacctcagcctcccaaagtgctgggactacaggcgtgagccaccatgccaggcctgtcatgggagtttgttgcacagattatttcgttacccaggtattaagcctagtacccattagttatttttcttggtcctctccatcctcccaccctctatcctccaaaaggccacagtgtgcgttgttcccctctatgtgtccatgtgctctcatcatttagccacccccacacaaaaaatttaaaaatcagctgggcatctgtaataccagctactcaggagctgaagtgggaggaatcacttgagcccaggagtttgatgcagcactgagccataatcatgccactgcactgaactccactccagcccaggtgacagagcaaaaccttgtttcaaaaaaaaaaaaaaaaaaagtaatttctagtttcctaagtagaatctctactttctgcctaagtatcaaggtctgtataattaagatctatccaatgtttcctgcttttctccaaagaaaacacttccattccagttaaatggtctcttttaagacattaacaaccactaagaacctttgaatacagaaaattattctcattattaggtactgtgttgggcagataactggttccctattccatacttatctctccattcaaaatggactagctgtgaggaaatctttactagtatagaccatgccatttcttcaatcctttatcttagtccactggaaatatcatcatgactccatcccttaaatctctgcttttacgtttgctggctgaaagaaaagccactttgcctaaccagatacagaaagagccctaatggctagatgtagagccaaagaaaagagcttctaaaaaaaaaaatacaaaaatattctgaagacagaatcattcagtccttatcctttacacaacaaccatagttccaagtctggtggtttatattctgggctgtgggcctttgatataccagaactctccattcttataatcttccaacaaaaaaaaagtagttatattgaaaggtgagacaaaataagtaaattaaatgtcttgcttaataattcaacttgaatataataaatctgagtagatgggaatctttaaatctcttaagttggttttctatgttagaatttaatatattttaagaaatatggaaaaaataaattgtatataagttaatgttttttccttgttaatgatttacagctctaattttatttccaataacattttttagacattttcttacatgtgctctattatcagttcatctgtagtttacataaagttgttattgcatttaacaaaatcatttagaaattctttttatttatttatttctgtccttacaatctgttctcattgaaattctagtcatgtctcctaaactacagaatcatcctcagtacaataaatctactggtcaatttctacattttaaacttactatcagtaaaataaacagcagaaatttatacaagcacatctagtagtgaacaggtgttcaacaaatgcctactgaatctaaatttacaggatttgaaattctaacacacttaagtgtttcagtgaactgcagctcaacatgacccgatagtattgatgaaaaaaaaagctagtgcaatcagactgcactatagaactttattcatagatgcagtgtgttttgtacctatactacattaagtatattgcaattaattctaaatacaattatttaaaaaggaatactaacaaaatgtaacagatccaaagtagggtatccagaaaatattggtctagaaattaatatggtctagaaaaaatatggtctagaaattaatgctatatggcaacagtggaaggacctcagaatgtacagcttagagaaaagacataaaaacaatttttagacagtagatctagggccagagaacaaagttataaacagatcttcaaatgatgtttcattcaacattgtttcatttttaatactgaagaggaaaaatatagagatttctgtctggggccacagtgtgtggagtttccacgttctccccatgtctgcatgggttttctcccacatcccaaagatgtgcatgttatgttagttagcacatctaaattgtctcagtatggctgagtgtcggggtaggaggacaccctgtgatagaatggcatcctatccagggttggttcccacctcgcatcctgagcttctaggataggctccagccacctgcaaccccaaagtggagtaagtgggttggaaaatgaatgaatgtaaattactgcaaaataaaaacttgtcaaatatacaatcatcatacaaatgcacaacaacaaatgatgtagtatgaaagtgctcagcaagcatgccatatttgttattgcttgtttttgaacaacatggtagtagaaggtgctccttacaatttctgctttacaaacatttattccttattttaactcaccaccactatgaccatcatcgctgactcatcaaaaattgggtaaatgatgatcttgtttctattaaactttcttaaatgtatgtttaactcacatttatttcacaatgtttaataccagaaatgtgttggatctttatttagaaggtgatgttctttgtgaccagaaataggctataggaacttaactcttgtttatatcaattagcctatggtgaaactggttttattctatgtcatttagcttaaagctgcagtttccaagaatctattcattactttaagtgaggacttactgtactaagttgaaacctgccctctgatgagaaacttattttatgttaattaacataaatgtaatttataacgtaaaggaaaacatttgtttactatgattctaattctaatattctagggtcaaaataaaattaataaagttcaatttaaaataaaattgacttagaaaaatttagtgtactttacttattttgtcttgttaaggatttggaggacagattgccagttttaagttccgactacagggcaccaaatactagaggcataaagaaacagctgaactaaggatataaaaactaaaagtaataatttaaaactgaggtgtactgaattttaattcagatattgtttccctaaacactttatttatttttttgagatggagtctcgtgctgttgcccaggctggagtgcagtggtgggatctcggctcactgcagcctccacctcccaggttcaaactattctctcacctcagcctcccaagtagctgggattacaggcacttgccaccatgactggctaatttctgtatttttagtagagacgaggtttcaccatgttggccagactggtcttgaactcctgacctgaagtgatccacccgtctcgacctcccaaagtgctgggattacaagtgtgagccaccatgcccaactgtttccctaaacatactttttgagatggagtctcgctcttagttgcctaggctggagtgcagtggcttgattttggctcactgcaacctctaccagcatacatgctattctcctgcctcagcctccccagtagctgagattacaggcacccgccaccatgcctggctaatttttctatttttagtagagactgggtttcaccatgttggccaggctggtcttgaactcctgacctcaagtaatccacctgcctcagcctcccaaagtgctgggattacaggcatgagccaccatatctggcctccccaaaaattttaaactgaggttctgaaatttgaccagtggtagagtacttgaaaggatggcattcttagtggtaatactgttaaatgtatcaaaacttcattttcattagctacaaatagttttactataagaaacagattttataagacattttaaagtaacttgtttttttctttttattttctttttgagatggagtcttgctctgtcacccaggctggagtgcaatggtgcaatctcagctcactgcaacctctgccttccaggtttaagcagttctcctgcctcagcctcctgagtagctgggattacaggtgcacgccaccatgcctggctaatttttgttatttatttatttatttatttatttatttatttatttatttatttatttttgagacagagtttcactctttcgcccaggcaggagtgcagtgacgcgatctcggttcacagcaacctctgccttctggtttcaagcaattctcctgcctcagcctcccaagcaactgggactacaggtgccggccaccatgcccggctaatttttgtatttttagtagagacaggttttcaccatgttggacaggctggtctcgaactcctgacctcatgatctgcccacctcagcctcccaaagtgctaggattacaggcgggagtcactgcacccagccaaagtaacttgttttaatggaaaaacaagcataaattaatttagtggatataacaggaaaaatgaagcttatagtctaggcaaaaaggtgtgataattgacaacatatattttaattatgcattcaatttattcctcttttacatagagattaaatttaaaaactcaagtttcagactaataggtagtagattagggcaaaagtacatagaataagtcaggggatgttacttattgcatttataacttgaaatccccatgacagcagagttgattatatctgtacatttattttctatttaaatcaggccccatgctgttaaattctaccttttgttttcctaagaaaacaaccaagtaacttcatactaagaaattccctattattcctctttgaatcatccatcttgaaggtaagaagttgttcaggttgaggaaacaagcccaacccctttttataattttggcactaaaaatcaaattttatggtgcaattttattaagagcgaaaacacagccatcgcttaagcataaaagctcatatttaactcaattattttgctaaacatatataagacaaatatggaagaatgaggacaaggaacacctggcatttttattaaatgtctaattctcaaaaatagcaattatttgaacaatgaaaaacagctgcagcatattgtgaactttctctatattcataaattatagaatacataagagcctagattttatatatttactaaattaatggcacttcatcatatcaataggtttataagacattctctttactaccaaatgctgacaatagctggtacctttatgaattttttgggttataacactctttcaccactaatccaactgccaaaagagcaatttattttttctcttttggggaattcctttctcccagaaacattcccatttttaaaactattcaagataattagaatttcctcatcagtgacacaggtatacagcaatttacacaagagtaaatttctatcacaataattaaaaataagagaaactttggctatgtctagtgcataatataattacatcattatggttttattgaaagcacaacagattttatatcatttgccatatatcaattacttactgctccactgataaaaacattgattttttttgcagtattttcagtcagtcctacgtttgtacattttataatttacaattgacaatattttctaggctgatgattacataccattgcttttattgctaacctgataatacttctaaaaacttatattgataactagtcatatgtgagaaatagtttttgttatttctttttactaggcttgctcttgatagcagccaaatttaataagtctttggaattaggaagtaatttatctctatcatttttgtttatggaactaacattgacagcactggtgaatattctgcttcatcttttctttccctatttataaagtcaatgttttaagatttttattgtagattattaaaaagagagatgtaatattcttaactgctgacaatgttttgagatttttttaagcaccaaatatatatttaaatttacataacagatgtcaacatgtatttacatttgcaggtaaacatatgtttacatttacaaacagaaatatataatttaagtgtctgtattcgaaaatgcaatgtgaaaaataaaaataattcaaaaaagaaaaagaaataaagacatataattatttctgaattttttgttaagcagcgaaagtttaagatctctaaattgaaaaataaacttgaaaaatactccatctctatatttaatttgtaaaaatgaaccccaaactgccattgtttgacaggattgtatacatgaacatcactgttctacaacttctagaacatccacattccacaaatgaacagctttaaaaaaaatcccatcttaggcagggcaaggtggctcacgcctgtaatcccagcactttgggaggctgaggcgggcagatcacctgaggtcaggagttcgagaccagcctgaccaacacagagaaaccctgtctacacaaaaacaaaaaacaaaaaacaaaattagccaggcgtggtggtgcatgcctgtaaccccagctactcaggaggctgaggcaggagaatcacttgaacttgggaggtggaggttgtggtgggccgagatcatgccattgcactctagcctgggcaacaagagcgaaactccatctcaaaaaaaaaaaaaaaagaaaatacatctatctatctagatatctaaaatcgatctatatatagatatctaaaatatatctatatatgtaaatatatattatatataaaatatatgtaaatatatattatatgtaatatatattatatataatatatgtaaatatatattatatatatgtaaatatatattatatataaaatatatattatatatatgtaaatatatattatatataacatatgtaaatatatattatatatgtaaatatatattatatataacatatgtaaatatatattatatatgtaaatatatattatatataacatatgtaaatatatattatatatatgtaaatatatattatatataaaatatatgtgtgtatatatatatatatcccatctttttttttttttttttttttttttttttttttttttttgagatggagtctcactcggtcgcccaggctggagtgcagtggtgtgatctcggttcactgcaagctctgccctccgggttcacggcattcccctgcctcagcctcctgagtagctgggactacaggcacccgccacgacgcccagctaattaaaatatatatcccatcttaaaaaataaatggcattaaacaaacattaaaaaaatgatagaaggggaacacacaatcacacacagcatcactgactattgccagtcactatgtacctattattctgggtattgtttaattggaaacatcaccattttagaatctaagattaaggggaatctacctagaacagacaacagaaagcattccaactatgaaatatgataaatggcctatgtttaaaagatgctggagagtatccaagaaagactgctagcttagaaatttataaaggagatgaaatgaagaatgtgatattatctgtgcttatgtatctgttagaattcaatgatacctatttcttgttgaaaagtggactgccctccattctgagtgtagtacgaattaaaaagacttctttttttaaagagttaagttgaagaagggctgagctggcttccaaggcactaattaaggaatccaagcctgtactatataggattctttagggatctgcagatatttccattctaattttccagagacaaaaatgtaaccgggagaaaattagaaaaagaaagtgacctgtggcatttgactactactttgcaaactggcttattattaacagttttcaacatttaattgatcccccacttaaaaattctcaccttattgagttcaatggctgatcgtctatgatcataaggccatccccaacatatacacattatttgagtcactgtgagataatgtaataaaagcatctgaagcactagtttcatttaaacagagacatgccctcaacatcaagaatagaaagtcttgcgcttgagtttttctttagagatgcagaattagctcaaggaatggatggaaatgacattttttggtaactgattttaaggtctcgaatacttttatggaaataagtatcctgcgcattttatatgcccttgatcttgtgagtttttctagaggcataatattaatttcagttaacttgttaaaattattctttcagaatttctaagtgtctcaaaagttaaatgaattggggaaaaatgtttcttattctaaaaaagaggtatgcatgtatatatataaaaggaaggaaaaaggagaaaaatcctctttttgatatttgcaggaaatatctgaggtttagcttgggaggcgatggggcaatccagggcgagaaatgatgtcttgaataattaaggtgactactcctgaccttcaactaaacagactaccttcctgtctaccctgaaggtatcactttggtgttgctatccactgattcacttctgcaaacttccctgacagaagaaaggaggacttgcagctggacactgctccctggctcttcggagcggtttctttacactatgcatggaccacagatcatctgctgccatcctactcagggagagcttgctaaagatgcatggtcctggcccccacccaaaacctctgactttgaatccatgtcagaaatcgtttaatttatgtacttacttgtttatctgttttgttcactgctatatctttggctcctagaaaagtactaggaacatggtagatactcaataaatatgtactgaataaatgaaaaaaaaaaaaaccaacaaaagaaagggaaggaaaagggattgccttcatgtttctcccacctcctcaagttgttttttttttttttttgagacggagtctcgctctgtctcccaggctggagtgcagtggcgtgatctcggctcactgcaagctccgcctcccgggttcatgccattctcctgcctcagcctcccgagtagctgggactacaggcgcccgctaccacgcccggctaatttttttattttcagtagagacgtggtttcaccgtgctagccaggatggtctcgacctcctgacctcgtgatccgcccacctcggcctcccaaagtgctgggattacaaggcgtgagccaccgcgcccggccacctcctcaagttttaacagctaaatgttaagctcttcacaaagaagtctcaagtgtaacctaatgaaattaaaaacagactttacaaaatcatttctcaagtggagagaatactctcaatttataaaaccataagaccaataaacctgaataatgagtactaaaaaagacaattacctatttgttaattcctttgaaggaaaagggctcaaaattgtgattctcagacttggagattatagggcctgggtataaaatacttccctaaataacttaccaaggcaatggcattattcttgctctaaactattaattaacatcaaatctcaacgtgtagaggggctaggagaggttagaaagttaccataataggataagcagggaaaaaaatcagaaataaaccagaacatgacaccaaacagtaatagggagactcagagttaatacttacaaggtaagaattgctgagctaagtagaggtctcttttattgtggtcttcattctatcattattaaacctaggaaaaagagggaagactttaaaaatttcagcacattatataagttagaacatttcaactgaggttgccaccgctgtattctgatccttatacagcacagaacaatcagattataaacacccagcagcatttgtatgtttcagcccagtgcagcattcttgttagtttttttgttaagacatggggtcttgctctatcacccaggctggagtgcaatggtgtgatcctaactcactgcaacctcaaactcttgagtttaagctatcctcctgcctcagcctcgcaagtagctgggattacaggcctgcatgccactacatcctgcttatcactggcttttaaaatttgctattctattacaattgccctcttgaagtttaagtcaaaaattttagtcaaagctaaaactctaacttggagcccaatgagcttctggaggacatcatatatttgcagatattttaagataaattcaagatcatattccaagactgattaatctctctcacacacataaaattgcatcatctataatccatgtattgtatattgcacaattccaagtacacaaaggaaggaatatatgacatttttaaagatatgctagtaatctgagttggttagcatgtttggcttctgtgggtcatgattctaagttgtagttgttacatcaactaatagttaagcacttactataagatacagaatagaaaggatatgacaaattcatccatgttcttaacagagcactgcaagtatacgctttattgtagactaatcttaacagaaaaagaacagcatgtttttaaaaatttcaaaatcatttgcttcaaaattcacagaaaaatcaagggaataccaaaatgaacctccatatcctatctctggactcccaatccagctgtactgaaatctaaaactatgccatacttacttccctttgttttttatgaaaattgattacacatacagatgatgtcctttgtgagctataccctgattccattccattctttccaaagatgcaagcataatcttgaatttgatatttatttcctatgtttttacactattactaccaattcaagaatttaaactttatcattgctttcaagcttttgataaatggtataatatcatacatattttatatacgttactctgtatataacctttatgcaacttatttgtttgctgaagtaggatattcacccatgatgataaacacagctctcattttagtagctttacagttcatcacatgactatgtcacaatttgccattctcttcttgcttaacatttacattgctttcatttttttcctattaaaaataaccaagacttttttctacatgtcttgagtttacctagagcatctaggaataaaattgttgggttcaagcctattgtatcttcaactttacaaagatattgctaaatgctcccacaagcagcatatgaagagttcctcattttatatttcctccaacatttggaagcatatttaagaaaaacagccactatctatatgaaaatttaaaaattcataagtgatcaattcctttggttttcatcaagtattggtttaacataggtatactaatgttccaaacaaagagaatagactgaaatttggcccaaggcacttacatgaaaacaaagctctgataacacagattttcctcatgtgactgaggaaataccaagacttaatctattttttaatcagccgaatttaagattcaagaacttaatctagaaatgataagattcctaattaaatattaagcttagatccaagatgaccaaagaggggaaaaaaagatgcaggaaaagtagatagtttgtgggtatgaacaatccctcctccaagttcattttgggcagtgcttctcacaaatgtggtgctcctaagaaaaatctcttaaagcttgtaaaaaaatgcaaattccaggtctggaaaaatgtttttattttattttttaaattctaggttattctcatacaggtggtttgcaggcaactaagcagtaagtaatgattaaaaatgaggtgctttcaatagagaggattatgtaactcatgttttagttaggggaggtaacagtaattaatatgttatctgttaaattacataaacttttttttaaaaacctctagcattagtcaacaacaacaaaaaagtaacctcaatttatggctgaatatgcttgacttcacaatgccaagaaaggttgtgggctcatttattttttcagataactagacacatactatgacaaagctttttttagtaatattaccagggaactaatattctgaatttactgtgattggcacaggaaaatattaagagtgagagtgatcaggagtgattttaatgaaggtgaccagaaagcaactatatgattaccttttaaatagaatgctattgcaaatgtcaaactttaaatgggacatttggctttatacactaaaaaaaaaaaaaaaaaaaaaaaaaaaggcattagtagtttcccaccaagaccgctacaaataaattcagaacatttatagaaatccaacattcacacttccctgtaactctaacctattgaaattagatgtaaaaggaagaaaaaaaatagaatatttaggttataaaaatcggcgcaaattcaaattataaaaataaaaacattcttctatattatttgaaattacaaagtcctgtttccaaaagatttagaataatctaagctttctagataaaaagttcagataaaagatatttcagtgagaaatggtaaatagaaaaagtaagcagtttagtagtaagaaaaaagacataagttttcatctgttgcctgcttttagttatttacaacactaagttaatatagaatgttgttttctttcttttattatagtgaaatcaacaagaattcggtcttgttagactgggcttttataaaacaaagataatgtagtccaaaagtgaaagaaacactcctgtgtggccatagccagcttttcttttctatcctcaatatattacctaacttgtgatatcagcaactaattataatttttttcagtctacctgcttaaaagtgaaaacatgaaacataccatatatacatgaaacatactatatatacctccagaagcaagacaggttttccattctaatggatggaattaactgaataaaaattaaatgaactaaagccacagagaaatagtaaaaaataatagagtctaagaactacaagcatctactgttctctttatgctgcaacctttctgctaaagaatgtattctctatactgtgtatgtggtacagtgacagttgggctcttcccacctgggtttgtaaaaacggatgggtgcaggctcctttggccaccattattgcatattgatgttattctgcacaacagctgacaagcagcatcgatctcccagcctctgctcccagctgtaaggggtaagaacaagggctgtggtgataacttgtttattcactgctgttgctgttgctgctgctgcttcttaaacagcaagctgagaaaagaatatcaaactgacacacagaggaaaaatggttcagacatcaatctacctctcaaggtctgcttatatcactatatgataaaattatttttaaaataatttttctttaaaaagtggggtggggagagaaaaaagacaaaattggtgttttgattataaagggaacctataatgtatgcaaggaaaaggaaattaatgacatatataataatcttccccttgtaagtctagatttaaccgctcaattatcaaaattctctgaagagttttaaccaatgttggggtaaattcattgagagtaacttccctacctattctcctggaaaataagaaagtgtaaaactccaatcaagaaatgacactttattttgcttacaaaatgcctctagctcccaagtgccccatatctaatcaccaccatatgtttgactttagacactattagcaaagaaataagattttagtccatactgtttttgcataaatcccattaaaaaaacttccatatgcaatttacctattttaaatgtgcaatacaaagttaaaaacttagtaagtacatagtattaattgatgagtaacagaaatagaaatattcactgttcaattacctttaaatgtaatgtgatgctatttatagacttacagctttaactgtaaatgcaactcatcttttagaaccttaagcaacttgtgattcagaaaaatataaaaagtcagaaaaatttggagatctataaactattaaaaagaaaaacccacataggctagaactggcaagtaagtttaaataataatacctaatcaagaaggctaagtttgagacattttaaaataaaagtatgaaacagtaacaatattttaaatttagatattttgtaacaaatcaaaacccaaccccaatcttctatttttatcacaattgaaaaaattttctgcttagcaactcaatgaggaacaaaaaatgttaataataataaaaataattctgaagaccagaggataacaagatactttaaatatatttgttttgtatgaaggctataaaataaaaaagactaacagcaaatcctcaagcaagatttttaaaaattcagacacttagaaacagtaatggattaataaactattaaccagtgggattaatcagtctcagcagccacatgtgaaacatgcttcacatttctcctctaagattctaaccatgaaaataggaaagtaaaactaagtcaaataatatgttaatgaagtatcaaaagtgtggtttgtggtgctgtgaatagaaatttcacttcaaaatgtatttaattttaaaccttcacattaattaaatattaccctttgaaaaatgcttatcagaaaatataattctgatacattagatctcatttgaagaaaaactgaaagaggttaaggatgttatttgctagtttaagaaaaaacacaaaatacacacatgaacaaaactgcttcaaataaatatttttaaaacttttatttaaaaagttaattgtatctattatttaacaaattctcatcaatatataaaacctctattaaaatgtcatagctgacaaactgcctaaaatgtaacatatccttataaactagcattatacatctctgacaaataataattttaagttccttcatatgtagatatgttaagttacctctattctagtttattcaaatattctttctatactaaaaaaactatttcagtaagacaggaacaatgatggtataactgtattttagggacagctaagaatttttcccaaaagtgaatgttatttaaccctgattgtgcatttagccaaaaacataaatattgaaaaaatgagatacaaatcactgaaaaaaagataaaaattaacacaataaatctcttcccccaaattccaacataattaactacacatcaaggcttaaatttagataatcaggtttgcaaatttaaaacggtcaaaatctttacaaaatgtcttacaaggggtagttaaaagagagccaatcatacacagcagttgaactctttgttaattggcctcctaaaataacccatactcctaattaggttaaagtttctcaccctgtaagaattgaccaaatacaagtaaactgttaatatttgtattgattcttttagatatgaaattatttactaagctaaattattagaagtttataacccagtataataactataggaagaacaattatatgatgctaaatatttgtgttcaaaataagttttgatatcttcaaagatcacaaatcacaaactctctaaatttggacgactctgtggatttatatcttatctaccatataaactcaaatgctgtctctcttttcctatttaactcattaaggctgttctaaagatacctgcattgaaagtgacaaactgaacctggattttttttcccagatactcaggtaactgtattttccacttttcatcttaatgttctctaacctgaaaaatagctgttaagtcagtgagggaaaaattgtatttattttcattttattcaaactaagctgctttttcataaaaatctcaaatcaaacatatgaagacattccatacctcatatttatctgaaccacattacagtatgacaccaatataaaagtatctaaacttcacccttatgttaaactctgatttctaaacatctttacattttatttaacttcaactgttaattgattcattcctggtttatctacctaatatccaatatagaaatatcaaatttcagtttttagtattttgatatgtatttcaacattcactcttaaacacacctcagaattcatctttaaaaattttacattgttggaagttaaaagcagttctatgatcgtgatgatatacttcattcttaagactaaataataattttctcatgaaaacaaacctttgacatttcctctaagtatataaatatttttaggtgaaaaaattaaaaaaaattgtattatgttagtaaaccttactttagcaaatagtttttacacaaataaacgcacacatatatgtacatataagattaatactttactatgaaagaattaaccaagtaatacttagtaatactgttcaataagttcattttcactataccagattaccattttagaaaatgaaagttgtattagttaaatactgtctgaaattttcaactaaaactataaaaatcactggaggtttagggattctacaattttatttttagagtctgcaacttttgatattaacaactgaaatattttactcagtgtatgttgagtaagatactagtaatttctgcttaagaaagtggttttttcagtttcgaccatattgccacttttggttagggcagtacttggaatactttacattttcttaaaatattctcatcaattttacctaattttgcaggctctacctactactcttccacctgtcaaacagctaagcactaaattccatttgatttaaactctccattttataagatgaaaagttcatattttactgagtacactgtaataaccttaagaaaataaaaattactataaatacatatttttggaataaattcagttggagttagaccttaggatgctgagaagaacattacctgtataaaaaaaaaatctggagttttagtaagctagacaactcagcttatggccacttcatatgatgatttctgtttatgagtaattacttattgattttagttcacgtaaaaatttcaactttaccaattgtctagtccgattatattgcaaagacataaaattatatggttttaaaatttgttagtataccttaatctcatgtcatgttccaatgcattatgtaagtattcaatcaaagaagtgaggctgttctccagaattggttctctgctacaggtcaaaacctgcaataaaaatgtcatgtattatagcatgaagacactcaacagatttccatctcctgcagttccacagttgatccctgaacacagaggtatggtcttcaaaatgaccctaatcttgccaatgttcagagaagctctaacttgaaaatgttttaaaaatagaaataacttgattagaaacacctgtgatatgctttatcatccgaagcctcttcaaacaaatcagattaatatgtttctgctttcatttctctttagggcattcatgttcaaagtagtatgggtgagtgtgtatgcgggtagctgttagaggactggtacaagaggagttcataaagaaaatatcagaaatgtagtttgtacttgtaaaactcataaaatccacacagtttaaaaagttactgaagggacagggacgaaattttactttctctccaaattatcaaatgttttaatgatgacagaatttaccattctttttttttttttttttttttgagacgaagttttgctcttgttgaccaggctggagagcaatggtgcgatataggatcactgcaacctctgccttctggattcaagggattctcctgcctcagcctcccgagtagctgggattacaggtgcctgccaccatgcctggctaagaatttaccattattttcaactttagtctactgccaagcctaagtgaaaagtatcagtatttccaaatattttaatacattacagtcctaacagaccaaaatgtggagtttttttttttttaacaagttaacatatttacaaataataaatggaccactactggaccaaatggttttttaatgtttctaagagatgtaactgaatatatgttaagtgttttttttcatttctttcacctttctgaattataatgattcagtggcaatcgactgtataaaaatattaaattaccaaaggtgtatcatgtattacatgtaaatcataatgctctgaataaattttccagttatatttaagaatagcttaggaaaatgaaagagtaaaacctaaaaaaacctttattcctctgttgccaaatatttgattgtttaatgacaaaacccacacaatcatccataactcataaacaccaatccaaataccatgacattttaaaaaattaccgtcatttatacacagtcttcctcaaaagacagacagttttctatatttgagcactctgaaaattaaggtatcttaagtttaaaaatcatagaaggaaaatagtagaaaacaaaatgtactacatgccaaatgttaagtttttaaatagtagggagatgaaaaatactaaccaataagaagcaaaagaggtctggatataaataaaataataaaccaatgtgtatgataaaaaaggcaatattaaaaaaccttcaaatagtaaaactcaaatctaaaatctattacaaaatagagcttactatttattcttagaaaccactacaagttattccagtacaaattttctttactgaaataaggcaggattaaccaaaggtatagtaaacttcttataatttgataagaaatattaataatattcaaatatatatttaatatcaatttcaatatttaaaacttgtctttctaaaaggaagatcctttaaagcatctctaatacagatcaaaaaataaaaacaaaaaaccaaccgaggcaaaaaaataaaaaacattcagttccccaccagaaagtaatatttatatgatctacgagataaataaacatataatagtaatgtgatattctaaaaatctatcctgttactcttaagacaatcatgacattaaagttctaatactgtcacttccaaaaattaaatgcttaatctcattttcaatgcttatttgaaataaagtggtattttattactgatttcctttggtgttatgagatttggggctacaaaatttcagcaagtcatagttgagctctaattatgtgccaaaattagttgcctggcatacaatgtttcaaagtttgctgaattaaaaacaaaacaaaaccaaaaacccccacgaaactatatatatgacaattttttctaagatgtgttttctagttataatcagacctaaaatctgtgtcttctaaaaaggggttaaaaagaaattaatatgtgaatttttaagcttcattagacagaagaaaaaaaacacaagagccaattttaggtaatattttaaaataagagaaatttttatagaataattttttgaaactataaatttatcatcttcttttgaagaaagctaatgtgtcatatataataattatctaatacagtctctgggaattttttttcattttgtaaaccaaatcaactgacccatatttctggctttaagtattctgtgacattccaaatagttactacctaccaataaacaaacaaacaaacaaaaatacacacaagtctccacaaaacaaaacaaacgaaaatgtactacataaagcatgatgaaaccaggaatctagactatgaaagctactttaaaatttttatccttagctgtagttcatgctaaacattaaaactcatattaatctgattagaaaaaatatgcagtgttacatacaaacacccgaggctacattttctgaatgtacaactaagacaggtcaacagtatttttttaaaaagtctgaaactgcacttttatttgaatttttaaaaatagtgtgggggcaaacaaatgaaaatcaatgctaccaggaagactgataccttaccagtcccctttcccccacaataggtaaacataactttaaaaaggggtgacctattatagcaacaccacaccccgcagttgctttcctatggtaataaatgactttgtaatacaaaataaattacaactgtcaatttctacagagaaatatggataagtgcacataaacattaaaaaatacacatatgttgtaacttatacctatatgcccacaagtctaaaaccaaaatcttcctcttatatagcatcacataaaagtgaaaatattttgaatgctgtggattttatttaggcgctagtgtattctcaaatttgaagtgatgtattttaaataaaggaatcacttcttttaaaaatggcttattaaacaaacaatcctttacccattaccccctaaacaaacaaaaaatcccataaaccaaagtgctaaaaatgtatggttatacttaaccagcctggtggaatttaaagcttgcccccaactcttcccaaaactcacgtaatttgaatgagaatacaaaactcaaaacaaaaaccatcagtaaaaagcaaaacccaggagttctggtactttaggtataattacgtttaaaatagaaatgagatctcctaaaatttcattaaatcaaattttatagagaagataattagcaccttctatgaaattttcataagatgacccaaaataaatagctttgaacaaaggtaatgaaaagggatctgttatcacaattcttgttatgagggcagtacaaaatagtatgaattataaactcagctattccacttactaatgtaaattatatttacagccctacagagatttataaaagccataagattttttatttgaatattttttaacaatgcgtatttgacttaatgcgaacatacacactataagcttcaaaatttaactactattcataaaagaatataaacgtctattaaattaaaacaattgtttctcaaagcatctacagctgtttatcagttagtttgccgctgttctttgaaaacgacacctgccttttatcaagatgcaattaaatggaatgacaagctcggtaataaatggaaatatactgaggctgtctcaggcaacatcgaacaaaaatcaactgaaaatcaaccagataaaaaacagcacacccacactgttgtatacaatatatttcttcataatgaatttatcaaaggaactaaataatagatacgcacctgtgcttacctgttgtctaaattaagaaacataaatgttttgtaaattaaagttttagttcactgcagttactgaattagcaaaatgtatattttcactagatgcgaaaagttttttaaataagatgttcaatttttatggaaaatgttaaaaagatcattcgtgaaccttaagaaaattagtttctttgcatcaaaataaaagaaacaactgtccggtaatctgcatccaacaaatatatgtagtttaaggtgaaaaattcctatcaaaggaaaaaaactaaatttttcactcagtttttaaccaataaagaacagtgacaaatatataaaagtcttgttaatttcaaccagcagaaacataattttgcgaaaacagcctcttcagttttacttttaatatacatttgagaaccacacgaaaatcctttctgagaggaaaaaaaactattaaaaaccaactttttttctaaactctcgtcctaacgtttcgtagctatttccgtggttctctggctaaaagtatattttttcgtaaagtcgagaattatagtttagcgttcaacattcaaaccccccaggcccgcttccttccagccaatcagggggtaacaagtccagagtttagggagctccgttagacacaatttgaaaaacatcacattgcactcttctattctcctccgggaaacattctaagcgagggcgggtcccccagtcttcatagaatataagaaataaatcaatcgttacatcaattccacggggaaaaactctgtaggcaggcagtcctaaagaagcgtgtcaccgcggttcccaggaagcgttattcctctttgcgaacaactgaacagaatagctgctgcagaaagcatctccggaatatttgcaacccagagccgtgcgccccacacgcaatacaccggcaaagggttaatctagtggtgcctccagcgcggaaaagaactcaagatctaatacatccttaacgcgggatttttacaaaggccatagaagtattacctaaagttaatgccgtcactggctcacatcactcaagagctgtggagtaagaattgatagaaaccaccagctaagggggaaaaaaaaaatcaccgaagggaaagacaaataacaactctcgtccctcctcctcagcgtcaagaaaaggtggggatcgcaaaattaccgttaagttgtccgggtaaagacttttgggggaggaaaacattaatagtttcacagattgcttttttccttgcgacatgtttcaaacaccggagaagaaaaaagtcttctaagaaagtgcgactcggaggaaatagccacgagaaggaaatcgttagctcgaagccccatctttcatctcacccgtgaacactcctcccctttgagaaaggacaacgctgcgagagcaaatgacaaaaatccccagaaagaagctaaagtccagcatctttcctaagagcccgctacaacctcaaaagcctgcccctgccccatcttggaagcgcgagccgcggccagtcctacctacctagagacctcaccgggacccagcgcgccgggggagggcagccagggcttgggaaactctttcctggggcacctcacgcttcagcgtcaaaagacaatatagatagatgggtgccgggcggtggcgggggggactgttgccacgacccaccggagggacccatgactccgggtcctgaattttctgtcgaccttaagtttcttgtcacgagatgacggccatcaccgggtcgagaaaacggcgagaaaaggcggcccggttcggaaatgggggaggggcgcgcgtccagtcctcctgtcaaggagcggccgcctgcagagaccccgcagtgcgccgtccccggctccggtcccgggcggggggtcttgctgacagatccgctgggcggcggctgctccgccgcagccggtccgcgtcccgctcaaactgcagctcccctccccccacagccccgtctctccgcgctcccgccacattccgcccgccgccgcccactcgcagacgcccaagttgcccctaaccctacttcctcggatttttcgcgattaagtgagagtagaccccgcgcccactccctgcacccaccactgcctgcgggtcccaccactgccacctcccgagtcccgctctgctacttcttcaggctcttaccgactgcgccagccttggcgaagctccgccgactgccctttgctccaagtaatttttggcgatttttaaagtaatttttccggcggagtcatagtggcgctatactctcggacaggttatcctgtctctcccgctagattgatgagatcaggcatcactcgaaaatggcgccgaaagcgctgaggctcctcattcaaattcgttagagccaaccccgccgccccagggaatgccgggaacgcgggctgcctccacagctgtcaataccgcctcttaaccccccttctcttgctttcccgacatttttacgcatgcgcaaactccaaccctcccccctcctcccgccaggcacatgcgcagaatcatcgtggtgcacggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccaggtaggaactattactgttctcgttttgaagaccaggaaacctaggctcagagacgttaagtaatttgcccaagacagcacaggtggcacagaagtggatgaatccacatctgtcagattcagcagccctggagttctctaccacgctgtacgattcaacctgagcccacacaggaggcgtggtctccttcttcaacggtgtgtgtgtgtgtgcgcgcgcgcctgcctagagttaatgattaagtttgctgaagcccttcttcccggtcctaagctgcctgttgcgaaggcgctttcattgaattcagtttctcttaccgtcttaacttgttcataaactttttgagataggaatgggcagtttttctgtgtcacttaggatgatttttttttttaatggcgtgataagtgaactgaatccagcaaagacgagtttctgttgtgcaacacgttggtatactgacagctaccacgtattgactgtgtactgtgtgctgggcactgtgctaaataaatgatttacgaattaatcgtgtttattgctcacaacagccttatgaagtaggtattatcttcactttacagatgaggacacctgaggttcagattaagaaatctgccccaaagtcttagaactggtaagtagaagcaccatatctaggcaaacctgtctaccttcaaaaaaaatgggcactctgataggacaattaacgataataaagttgtaatttttttttttttttgagacggagcctcgctctgtcgccaggctggagtgcagtggcgcgatctcggctcactgcagcctccgcctcccgggttcaagcaattctcctgcctcagcctcccgagtagctgggactacaggcaagtgccaccacgcccagctaatttttgtacttttaatagagacggggtttcaccatgttggccagaagggtctcgatctcttgacctcgcgatccgcccgcctcggcctcccaaagtgttgggattacaggcgtgagccaccgcgtggagccctataaagttgtaaatattttaaaaccttcattgtgaatgttaaataagagagtagatatgaaagtgcctgaagtactaataaggaagtgggagaagggtagcatggtttgcattatttaagtgtcttggaaaagaaatggattttagcaatttgagatcagcaagaagtaacgtggcagagtagtataaatacactacttaatctctggtacttttttgcactacttaagtgggtcgactctggaaccgagctgcctgggtgaatcccagctccactacttactagctgtgccttgttgggtaaattatctgttggaccttttgtaaaacaagtactattaatacctcattggactgttgtaaggatgtaaatgagctaacatattaaaggaatttcaacagtgcttggcatattagtaaatgtttgttattgtcagtcagtcattgatcttttaaactggcttctttaatggttgttcaaaaatcaaactacagttagtgcctttaggggtcagcattttttttctttttttttctgagagggagcctcactctgttgcccaggctggttggatcactgcaacctctgcctcccgggttcaagcagttctcctgcctcagcctcccatgtagctgggattacaggtgcgcgccaccacgcccggctaatttttgtatttttagtagagacggggtttcaccatgttggtcaggctggtctccaactcctgacctcgtgatctgtctgcctttgcctcccaaagtgctgggattataggcgtgagccaccgcgctgggcggggttagcattcttattcaagagctccttaaaatgataaatcaaactgacaaatgatttttcccaaatatgaataatgatccctgttaggcaaataaggatgttaatttattttaccatctcataagaataatacctggaaatggaatagatttattgctttttctgattgttaaggttaaaaaaccgaggcccatctaaaatatatataaagtaaaaatcatccaaatttctagcattcagggataaccacatattgtttgtactttaaaaatataatgtacctgtggggacaatcagctagggggggtctggataagtggtatatttgggagacatgtgtaaaattgtactagaacttacaaataggtaagtagcacaatctggtttcctcactgtagaattttttatcttagtccccttttagatataatatgtcaagagaattctaaagtgatgatgataaatgataacatttattgaagacctaatatgtgtcagacactgggctaagcatgtacatgcatttttccatcgaatcatcatgtaactcattaagtgggtgcaattatctctattttgcagagactaaagtttatgtgtaagtcacttttagaagatttaagtctaattgtgtttaaagtcttatttaagaaaaaatctttcatgaaagcttcttgatttgctaaaatgggagaaaacaaaatcaactaacatacagtagttcctatgcctgaacagagagcccgattgtaaaaaacggtcttttgaaaactaagaattttatatttgaccacaagggggtgcaaattcctgagttaaatttcaaaggaaaaacgggaaaagtgcttttactttagaccatcaaattcgtgggttaaaactagtaagaattcctgcctggaactttaataccctacaaagtaatgtactttataagaagaaagaactcaattacttaggtgctcaattagggcagaagtgtcagcttgctttcttcaatacagtcaagagttaatcatccctcccccacccctttccactcacagttagtttgtgtctctgcatacccctctttacttgtcaataagagtagaactgaagtcataatttaaaatctggggttttgctcttggaaactgaaatgcaatcaccagctaatggatgctaaatatgggtagtgtgaagaacagaggtcttgtaatttctatgctttttttccctcctgctgaagtttataatgagtaagctacaactgatgcaatgttggcttcaacatattaacttatttagataaaactgtgaaagctataggtctgttcatctttcaagaaagaatgcaggccgggcgcggtggctcacgcctgtaatcccagcactttgggaggccgaggcaggcggatcacgaggtcaggagatcgagaccatcctggctaacatggtgaaaccccgtctctactaaaaatacaaaaaaattagctgagcgtggtggcaggcgcctgtagtcccagctactcgggaggctgaggcaggagaatggcatgaacctgggaggcggagcttgcagtgagccgagatcgcgccactgcactccagcctgggccactgagcaagactctgtctcgagaaaaaaaaaagaaagaaagaatgcagacagtaccttgaaaacagtatatactactgaatgtattaaaaactttgcttagcagggttttcaacttccttttattttcgtgttggtcttgtttctctgagatgggacttaatttaaaaaatacaactttttttggaaataatttcaaatttacaaaaagttacaatattaaaaagagttcaaagaacatctatatcatttgcttgctcttgtacatgggtgagttttctttttctctctctctccatatacacagtctataaaaaacacacagaggaaaaatacaagaaaaaaactttcaacccatatcaaggttttatgattatagttaaaaatatacatatcaaaaagtcaaactaaaattttgcagtgttgacactgccaaactattcttttaaggaacattggtgttctatcagctagtccagtgatttttgtttttttaagagacagggtctctctatattgcccaggctggcttcaaactcctggactcaagtgatcgtccattcagccttacaagtagcagggactgtaggcaagtgccactgcacccagctcagtgattcttaaactttgaaaatgtgttgaaagttatagaccctttctctagaatcatgcatgtatgtgaatagtttgcatatagtttcagaggtggatgatggtccatggagttcctgaagaaaagtaaaggaaaaattattcatacatatggtaggcagaataatggcctaccaaagatgtccaaagatgtacatgtcctaatctctctgggatttgtgaatatgttatgttacacggtgagagataattcaagttgcagataaaaattagggttgctactcagatgatctgaaaatagattattctggatcacctgaggaggcctaattacatggtcctttaagtgtgtaaaggggaagcagaagaatccgtgtcaatgatgagatgtgagaaagccattgctgactctgaaggtggaaggaggccatgagccaaagaatagttcatgagctctagaagctgaaaaaggcaagaaaacagactctttaggaatgcagccatgccgacatctctattttagcccgctaagacccattttgaatttctgacctccagaactgtaagataatacatttctgttgttttaagccactaagtttatggtaatttgtttaaggtaattttaaggcattaggaaactaataaaggatgtgaacagtcattttgtatgtgtgttgatgtgtggttatggtagtaattaagtgtgtgtgtgtgtgtgtgtgtatacattttttaataccacctaggtatttttctttttttcttttttttttttttttggagttggggtctctgtctcctaggctggagttcagtggagtgatctcggctcactttaacctctgtcttctgggctcaagtgatcctcccacctcagcctcccgagtagctgggaccacaggtgcccgccaccacacccacctaattttttgtattttttggtagaggtggggtttcgtcatgttgcctgagctgttctgtaattttttgcttaacaaatccataaaaagtacttctttatcttttttaaaggtctgtgaagtgtcagacctcaagatggacaactatttaattagatatagcatcttatctactactgaaattatattcctacacaatttactgaaatttcttggtaagaatgtgatgagcttttcccaaaaatttacccatctacattccctttataaaacgcaaccttttgatttacagttatgttgacaatatctttgttctgtcaagtatcttggataatttcttctccctgtagctaattgacagattaaaaacaattagaaaattctcctcagaggttatttaaacagtatataattatatgctttacttaggtatcagcttaagagaataaactgtttagaaacagatttattttgcagttggtagattattttaatggaagatcaatacaggtacttaattatctataaatgttttgtgagcaagaaactttttgtgatttttttttttaaaggataccaatattagttacatgggggaaaatttatacacacatcaggaaatgtacttgttttaggaaatttacatggtttagagctccaatttctagaagtggttagaacagattcatatatagcattttcaactttgattctctgaatatactgagttaagattttttttcctatatgaggagttattttgcttacagtatccttgaccacaaatcatggaactaaactaaaattcatttacgactaataatggtcaacatttattgaggaagtatgaccttttttattttgttgttgagacagagtctcactctgttctccaggctggagtacagtggtgtgatctcggctcactgcaacctctgcctcccgggttcaagcagttctcctgctgcagcctcccaagtagctggtacaacacgtaccaccaggcatctaatttttgtatttttagtagagatggggttttgccatgttggccaggctggttttgaactcctggcctcaggtgatccgcctgccttggcttcccaaagtggcgtgagccactgcacctggctgggaagtatggatttttttttttcacgtaccaataatgattcctggaaagggataaacccatttgtttttgttaatcttctttctaaaattaatgttaaaatgttggccttaaatgagatattaaatatggtgttttgaaacactgcttttgaaataatatatactttgtgagagcttaataaaggaaatttagcctattcaggattggaatcatagaatcttaagagttaaaatatgtctcttcttactgccacccattgtctaagtgtcccctgaggctactgagaacaaatttattctcacctacctacagtaaccctttaaatatgatcattatttttttgaatcatgatgacagcagaattcccactcccaaacatcctttaatggcttctttaatgtgtctttaattgttttatgctcttaaacccttcaccatcttggtttccttcttctggttattcttgtttaacaaggcccctctcaaacagtgacacccagaatggtattaattacatatatatactatatatagtctgaaatataccatgggtgggtattaactttttgtcctatccattacaatttttgtattttaagaacaattttaggtcgtaacagggactcataaataatggaaatggatgtattggaaatgtatcaaaagaaagttttaaaagttttaacataaactacaggagtaaaaaacttaaaaattacaacttatgactttctcagagactttattgagttgggatgaactggaagttgtggaggatagggaaccaggaatctattacattcatgtcttatttatttttaataaactggagtaaaattgagactggtctgtaggagatatgactgcggatgtgtgatcagttgtctaagacagttgagcctcatactacatttctattcttaatatgtaaaatgtatttcttatagtacaaatcccttttggctaggaaattcttatatgtttaaaataaattaaccttttaaggcagctctgaagaagtaatttattttaaataggtgagcagtttatagctcttatgggaatactttttccttattttttcatcataggattagaccctgtgtttttaatttaagtcctttaatttttgctgttaatgtttaatttacttgatgaccccgtactgttaacttttgaccaagtgaacttgggacagtatatacaaactgtttacctaattttaaggaaactcttttaaaaataagataggtttgatgtgaaacagaacattaaattcatttcaactttccatgtagaaaaatatcatatgtatttaatcaaataacttttccccccttattggaggatgtatttttatcagcatggaggttttttgttttttaataattagatgtttatgccattggcaaaacaacccaaagctgaccatgaccaaactgcaatacttttaataaactaaaagactactaatatagtagatataaaaccctttcctgataagaaatttttatagcgtatgactgaatctaacaattctccctctacctttatttatgctcgtttactttcttttatagaaaattgaaattcctaaagtttaagtttttagatgtaaaaaatgttagtatatacagttaaattaagttcaaggtttcttttaaaccacttgatgtaatttactttgtatatagcttttatttgcctttttaaaattattattacaatttttttagacagagaattgctgtatcatgcaggctggagtgcaggggcgtgatctcaggtcactgcaacctctgcctccccggttcaagcaattctcgttcctcagcttcccaagtagctggaattataggcgcaagccaccatgcccagctaatttttttttttttttttttttgtatttttagtacagacagggtttctgcatgttggccaggctggtctcaaactcctgatctcaagtgatcctcctgcctcagcctcccaaactgctgggattataggcatgagccactgcacccagcttatttgcccttcaaactagacctgtggacttgcttttgaacattttctcccctaattatagaatacatgtgcattaaagaaaacagaaaaaaatcaggaatgattggaaggcattgcttctgaaggcctcttaacaatatacctctctcctcatctcctttcccagttgaccaaagaaggctccgtgtttgtcttttatgtatattagcatgattgaacttcatccatttagccttattgaatactgtactttgtttctcttcaggaaaattacagtttgatatcttgtgggacagaaggtttcatctttcagtcatcagagagcaaagtaggaaagacttagagaggcaaagtccctctgcacctaaggatacactatttttactctaagggggccatgagggtttatttactttcatcattttggggtgaggaatggttagaaactgagggagcataaataggttaagtattatccatgacagtagggtgggagttaatggaagctcatttatagcagttctacttcctgatttatgggtatgtgtggtgcattttaaagagattctggtgaactaacaaggtgtaataattgtattttgttatatatcatattattgactgccggactgcttaacatgcagcttaataattattatggatatctttaaatatgccacattcactttattcagaagtgaactgataagcaacaagctgccatgtgctgaacagtattaggtactgggataaacaagggttttaaatgctgagaatagtgtaagctatatatgtttctgtatagccttcatggtttgctaataaggtaatctgttgtcatttcataattgaaatactagggggaatgttgtaaaaatgctctttattattgttatttaaatggaagtattttgtgtggttttatagtcatggtgggaaatcatgagtttttggactagggtagtgatggttgggatagaagatgagggaaaaatctgtaatgcctccctggtccctggcctggttgtagagtacaatggtggtatcattaaccaggacagggacaagtggaggaggctcatggcttttgagagagagagagagagagagagagtgtgtgtgtgtgtgtgtgtgtgtgtgtgtgtgtgtgtgtgtgtatgtttatgggtgtgagatggaacgctgggacatgagagggagatgacaagtccagtgaggacattttgaatatgaaagattaagcactcatgggatacctaagtagggaagttcagtaaggagctcaatatatacgactgaggcttaggagaaaggcctgggctggaaatggatatcactaaataggtggtagttcagattatgagggaaatggatgccattgctcatagagactaaacatagaggaaatgagaaccaaaattagtaaatgggcaaagtaagaggaagcagcaaaagactgagaaggaatggctgagagaggggcaggaacaccaacagagctcagagttaaaggagccagtggtagagaggtttcaaaaggaaagaagtcaggagtgtcagaaggtaaagacaggccaagtaaactgaaaaagataaaaggatttggcagttctgtcattagtaatgtttgccagaacactttcaatgaaacaatggtggcagaattctgtttgtgttgagttgaaaagtatattaaaatagggaaaggggctgggtgcagtggctcttgcctgtaatcccagcactttgggaggcccaagcaggcagatcacctgaggtcgggagtttgaaaccagtctgaccaacatgaagaaaccctgtctctactaaaaatacaaaattagctgggcatggtgacacatgcctgtaatcccagctactcaggaggctgaggcaggagaattgcttgaacctgggaggcagaggttgtggtgagccgagattgcggcattgcactccagcctgggcaacaaaagcgaagccccgtctcaaaaaaaaaaaaaaaaaaaaaagagaatggttacaataaatgtgtattatttcaaggctcttgacattttcttaaaaacaaaagatgataattttagggaggaggttacagaatagagtaggagatctacaagagaagagaacttaacatttttataaagtatggggacagagtcatcagagaggagaaattagaaaggtatagtgagatctagtaggagataagggtgcaggtaaaggaattaacccagaaaagagaaaggataccttttcctctgagactagaagggaacaggtaagatggttttatgtataacttgtaaatctagagcaggaagttgagggaattcatagctaatagttttagtttttattttttttctgataaaggagtcataaaagaggtaagggtagagctgaagtagcaagtttgagttgaagtaagatggtacaaaatatatgctctaggtaatgggagagggaattaatgagggaggaaggttgttagcagaagagggtgatgtacctgagaacctaggctggataggaaaagacacaaagcatgtgggagattgtagtttgaagaaatgagattgtagtttgaagaaatgaggaatgggtatcaaaattaggtaagaaagcaggtatttagggagtaatggagtaaaaaaactgcaaggataagtagttgtagtcagagatcaatatattggactcttaaggctgtagaataatttcttggttatcagaagatagagggtgtagctttgggtatggattactgaatgaagtggttttatggagtcagagttcatagtttttcaatgggttttccatatggacactgaagtgggaggtgatggcagaaaatgcaggggaggcagatactgtcagcaaagggccagagtcctcaacaaaatggaatgactgggtaattaataagaatgaaagaaaggagtaaaaaattcccaagattgttcatcatgccttttttttttcctcgtaaattaagagacatgagggtaaggactatgtctgaattaatccaacaaatgcaaatatttgttgaattaataagtgaatgataaactcatgttgaataagtatttcagaaaacttgtttttttcttattataagtagtcgatattaaagaaaatacaaataagcaggatgtaggaaaaaataatcccatcagccagaaatacctacccccaacaccctttgttattaaactttttgcttaaatctgtttgttgttcatatatttttttcctagcaatattcagttgtacactttaacatctaaataagtattttcttatggaatataaggatgtactataatttaagcagttccttattttggggcatttatattgattccacccaagtttcttcaactggtaaaacgaaaaacctaatagctattttttttttttagacagtttcgttcttgtcgcccaggctggagtgcaatggcacaatcttggctcactgcaacctctgcctcccaggttcaagcaattctgctgcctcagcctcctgagtagctgggactacaggcgtatgccaccatgcccggctaatttttgtatttttagtagagacaggatttcaccatgttggacaggctggtcttgaacttctgactttgggtgatctgcccgcctcggcctcccaaagtgtggggattacaggcgtgtgccaccacgcccggataatttttgtatttttagtagagatggggtttcaccatgttggccaggctggtcttgaacttctgacctcaggtgatctgcccgcctcagcctcccaaagtgttgggattacaggtgtgtgccaccacgcccagcataatagctaaatttttgccttacttattttcttaggattcttagaagtagattttctaggaggggcttcatagagatcctatttatctttattttagggccatttctaacaggcttgtttatgtgcattccatccaggattggaatcctggacaatggacagtgttgcaggtattgactgatgcaggcatgctgacagccacaaaagtgagaactgttagtcacaggtccttcttcacaaaaagaatgatgggtatttttaaaacttggaatcaagtatagttttcatgagcacagtaagagatgattcatgagctgaatacaggatatagtagtcaattcagaaatgcatattcaaattaaataaaaaactcttacaatagtctatatttgttgataatactgaactttagtagaggtttttttccataaattttaaaactgtggcaaaatactcatgaagtttatcaacttaaccatttttaagtgtacagttcagtggtattaaatacatccattatgttgtaaccatcaccaccattcatctttgtaactagtagaggtattaatataccaatcttgaatagtcatcaaagtcactctacctcaaacttttccacaaaagtatggttagtagcagagaggagtgaacaattgccttaaaaacttggtcccaagctagaattctttttagcttcatgttttgtcttaaatttaatgtaaatgtagtgttacataccataatgttcctatatttagtaaaatacaatgattatacattttttcaaaatctctgagggaggttgatccccttaactttggcaattttgagacgaagtcttgctctgtcacccaggctggagtgcagtggcatgatctcagctcactgcaacctctgcctcccgggttcaagcgattctcatgcctcagcctcccgaatagctgggattacaggcatgtgccaccatgcctggctaatttttgtattttattagagatggggttttgccatgttggccaggctgatcttgaactcctgacctcgggtgatgcgcctgcctcggcctcccaaagtgctgggattacaggcgtgaaccaccatacccggccttcatttttcttttacggtttagccaaggctatttatagtagtgtatgtcaaggagtagactgattgatgttcaccctcttcaaatgtgagtgtcacagaaactgaaattcacagagtaaaaatttagaagtatccttttatattatatttgctctagtaatcaagcatacttcatcattattaatgctatgagacaatcttattgtacaaataaagagaatgatttcatgtgctggctagggccatagccccacctttccaaagagtatcaacttttcaactatccatgcattatgactccagagacttgtaaaccctctcaggtgtaataaattttttttttttttttgagaggagtctcgctctgttgtaaggctggagtgcagtggcgctatctcggctcactgcaacctgcgcctcctgggttcaagtgattctcctgcctcagcctcccgagtagctgggactacaggtgcgtgccaccacgcccagctaattttgtgtttttagtagagatggggtttcaccgtgttggccaggctggtctcgatctcttgacctcatgatccacctgcctcggcttcccaaaatgctgggattacaggtgtgagccactgtggcccggcccagctgtaataattttgttcttcatgcctgatcccatttcaggagattggttattacattgaaggacagtagcaaaattggaactaaagtctgagtctcttaactcctagttgagggtctttccaattacaccaaaaggaaaagagttacatataacaagagataagacttactcctacctgcccccacaaaaccactttaagccatcctaagaacggtctcttttttctccctccctctctccttcccttcacctttcctttcttcttcttcttaccttttttgggggtaactcccaaccaccccagttctcagaattaaaaggttaagaatattttagtactcttcaagatacaaagtagactattagagttttttgttgttgtttctcaagcttgggacataaagctcagagatcagaacaacagaattttagaaaggaatagataggatacatgaaaaaggctgctggaatatgaaaaaactggagtaaaaataagcaaatcaatacttctgaaatgaagccttcattggtagaaaagagtgtaggtcacaaaaatgaattagcagaagttcttgatttctaattattgaagattcctatctagtggtattctaatatgcttaccaaattatgagttgcattactttttaaaaacctaaaaccaagtcaagatttacagagtgaccccagtttattttgtttggtaagttttcagttccagttattaggcaaaacaaaaattgctaatacgtaacaatgctgaaacaggcgattggtagaataaaacaaaagggattcatacagcttttgtactgtcttcttgaaaaagtcatatttggccataaaagctaatacatgctttaggaatggaaatgatttaacctgattttttcaagtaagatttgttcaagaataatgggcttatgttgtcagttgtgggttcaagcagtaattcactttggactgcttctattcaacagtatgctgtctgtacgtaaagagttacatggaatttaattttagcattggaatctatttgagataccattatcttttatattcaaatgaaaaattatgggcctctagaattaagtgttactaacctgatatagatagaataatagctgtatcaaaaggaaaaaagcaaggataatatgtgtatagggtttgaatcatacagtctcactagagatgtgttttttaaaattgtgaatgtttgttgattcattcaaaaccgtttgaaaattgtgagggagccagaaaaggggagaatatttggatgtataatttagatgtatagtttgcttgcttatcagggaatagttaagttccttttttttctgtatattttagttggtgaaattaacagtttttgttcttttagattaccctgtaaaagaacatggcattttatagatgagataattgaggcttatacatgttgagttataatgtgtggaggagtctgatgtgcatccaagtctgtctgcccctaatgtctctgtttttaaccattatcctcagaatgaaatacattcatatagtagagaccaattcttaaacagaagtcatctttactcacaaaattaatctgtgaagtacccactgttctcagtttctctccctctcactttttctttctagtgctttgcagtttttaatgaaagtgaatatttttttcagaaattattattttcatgttttttattagaggattaaatttgttgctaagatcatttagtaagtcttttgcagtcttttaagattagacttaagtgtaaacttaaagattgccttgaagtatattatttagctatattgcattattattccttatgtaatgagctatagactgagcactccttgacaaatcacaagaataagacccaaagaatcaaactttcccaagtaacttaactgcatcccaggacaaaactcaggaacatttagaggaacagaagactatccagcagccaacagataaaattcacaatgccttgccaggcacacaaagaagccagaaaaaataatccacaatgatgaaaacaatcaatcatctgaaagtgaccttaagcagagaaagatgttagaactagtaaagacattgaacattattatagctatattctatattttcagaaagtagagacatgaaagacatttttaaaaactcaatgcagttctagggatgaaaactacaatatctgagatctactaatggtatttgtagcagattagacatggcagaagaaaaggttagtgaacttgaaggatatagcaaaagaaactactcaaaaatgaaagagaaaaaagaatgacaaaagcatcagtgagctatgggacaaacttacagaatccttatgtaaacataatcagaggcatcaaaggagaggagaggcagatacaaaagggatatttgaaaaagtaatggccagaattttcaaattggacaaaaactattaactcacagatccaagaagctcaacaagaagaaaactacaccaaggaatgtcataatcaaattattcaaagccaattataaaaaatatggaaaacagccacatgttatagagtaacaaagataaggttgacagcagatttctcattagaaacattgcaagtgaagagacagtagaacataaagtactgaaagaaaaaaatgttaacctcagcaaaatatcattcaaaaaacaaaggcaaaataaagatgttttcagacatacgaaaacaactctttaccatcaggtagactgaaggtagactgtggtagggtgaagatgtatactgccctagggcaaccagtagaataacaaaacagttatagctaataagtcaacaaaggagataagatagaatcacaaaaaaatactcaacccaaaagaaggtggaaaaaggaacaaataagtagtgaaactaatagaaaaatggcaaggcaatagactgtaatcatatcagcaatcacattaaatgcatattatctaaatatcccacttaaaaggcaaagattgtcagataaaaagcaagactgcttttggacctggatgaacaggaggcaccatcacggaagttgactcctgccacaacaatgactgaaaggttcaacaccaggaacccaagagccaggacatctactgaaggctgttggttaagctgtatatgtttctggccagaagaaactctaccttcaaccaagttgtggtgaagaggttatttatgagttgcaccaaatggccatctctgtctctttcctggatgatctggaagatgaagcttcctggccaggaaaacaaaacagctgtggttgtggggaccatgttcaggaggtgcccaaactgaaggtgtgtgcactgcacatgagcagttgggcctgcagccaaatccccaaggctggggacaagattctcacctttgaccagctgaccctggacaccctcaaaggctgtggcaccatcctgctctctgggcctcacaagggccaagaagtgtactggcatttcagcaaggccctgggaacccagcatagccacactaagccctgtgtccactccagggaccagaaattcaagcacatcagaggctgatgggccagccaaggctacaaaaactaaccctggatcctctatcttattaaaaagattttggcctgggcgcagtggctcatccctgtaatcccagcactttgggaggccaaggagggcagatcacttgagcctaggagttcaagaccagcctgggcaacaagtgaaactccatctctataaaaaattaaaaaaaaaaattagttgggtgtggtggtacatgcctgtagtcccagctacttgggaggctgaggcaagaggatcgcttgagcccaggaagtcaaggctccagtgagccatgatcgtgccactgcactccaccctgggcgacagagtgagaccctgtcttagaacaaaacaaaacgaaacaaaaaattttggatggtgggggaaaggaaaataaaaaacaagatccaactatatactctcaataaaaaaacacattttaggctgggtgtgatggctcccagcactttgggaggtcaaggcaggtagatcaccggaagtcaggagttcaagaccagcctggccaacatggcgaaatctcgtccctactaaaaatacaaaaattagccaggcatggtgatgggtgcctgtaatcccagctacttgggaggctgaggcagaagaattggacgaatgcaggaggcagaggttgcagtgagcagagatcatgccactgcactccagcctgggagacaaaacgagattccgtctcaaaaaaaaaaaaaaaaaaaagaaaaagaaacacattttacacacaaagacataataacattaagaataaaaggatgaccaggcacagtggctcatgcctgtaatcccagcactttgggaggttgaggcaagaggatcacttgagcccatgagtctgagaccagcctgggcaatatggtgagatcctgtctccacaaaaaattagccaagtgtggtggtgcacacctgtagtcccagctacttgggaggctgaggtgggaggatagcttgaacccaggaagtcaaggctatagggagtggtgatcacgccactgtactccagcctggagtgactcaaagtacagtcactttgagacagagtgagactctgtctcaaaaaaaaaaaaaaaaaaaaaaaaaggtaaaaggatggaaaaagatatatcatactgatgctggcattagtcaaaagaaaactggtgtggctatattaacatgaaataaagtagatttcagagcaaataatattaccaggaataaagaaggccattttataataataaaagggctggttaatcagaaggatacaataatcctacatggttttgtctcaaataataaaagcttcaaaatatgtaaatcaaaaactgacagaagtgcaaggaaaaacagacaaatccatagttagagatttcaatacccctctttaaatgattgctaaaacaagtagaaacttacaaggatatagtaaactcaagcaacactgtaaccaaattaacagtacaggttgagcatccctaatctgaaatacaaaatgctccaaaatccaaaattttttgagcaccaacatgacccaatacgttgggtcctattcccaggatctcttattatatatatatatataaatgttcagaaaatccaaaaaactttgaaatctgaaacacttctggtcccaagcattttggataagggatactcaacctgtaatagaatatatattctcttcaaagtatacatgaaacatttacccaaatcgatcatattctaggccagaggttatcaaactatggccctgaggccaaatgtagtctgtttttgtatagtccatgaactaaaaatggtttttacattttgaaagatttctttaagaagaaaagaaaatatgtgacaaagatcatatgtggcccacagagtttaaaatatttactgtctgaccctttagagaagtttgcctgcccctgttctaggccataaaacatgtctcagtaaattttaaaggattcagataatgcagagtatgtcttctgactacagtagaattaaaattagaaatcaataacagaaagctgtctggaaaatccccaaatgtttggaaacaaaataacatgctactaaataaccttctaataacccattgattaaaataggagtgcagtaaaattagaaggcattttgagctgaatgaaaatgaaaacaaagcatatcaaattttgtggcatgccactaaagcagtatgtaggaagacataagcaaaatgcttatattagaaaatataaaaagtctcaagttaatgagcttccaccttaagaaattagaaaagaagaacaaattaaacacaaagaaacaaaagaaataataaagatcaaagtagaaataaatgaaatggaaaacaaaataaattgagagtattaatgaaaccaaaccctggttctttgagataaataaaattgataaatcttttgccacgctgatcaggaaaaaaaaaaaaaaaagagagaagacacatattaccaatatcaggaatgagaggtgaaatatgacaaattctacagatacttaaagaatagcaagggaatattatgaaaaaccttaagcaaataaaattcaacaacttagatgaaatggtcaaattccttgaaagacataactaccaaagcttactcaaaaagaagtacagccaggtgcagtggctcacacctgtaatcccagcattttgggagtttgaggtgggcagatcacttaagtccaggagttcgagaccagcctgggcaatgtgaagaaaccccatctctactaaaaatacaaaaaaatttagctgggtgtggtggtgcatgactgtagtcccagctacttggggggctaaggcgggaggatcgcttgagcttgcgagattgagccctgattatgccactgcattccagcctgggtgaaagagtgagaccctgtctcaaaaaaaaaaaaaaaaagaaaaaaaagaaaaaaaaaagaaaaaaaagaaaaaaaaaagaaaaagaaatagataacttccaaagctatgtatctatttttaaaaaattaatagttaaaaatattctcacaaagaaacactagtggattcttccagacacttagggataacactgtgtataccaattatatacaaatcttccagaaaactgaagaggaaggaatacgtctcagtttatttttgggggccagcattaccctgatacctaaaccacacaaagccattacaagaaaagaaaactatagcccagtttccctcttgaacatggatgtaataattctcaacgaaactttaacaagtcaaatccaacaaaatataagaaagttaatattactggatgaggtttatcccaaaaatatgtcattgctttaaattaaaaaattaatcattgtaagtcactatattaagctaaaaaagaaaatctgatcatttcaatagacacccaaaaaatctgacaaaatcgtatatttgttcctgattttaaaaaaccaaaaacaaaaaaaacaaaaaaaacaaaaaaaaaaccaaacctgttagcaaactaggaatagaagggtactttctcaaccagataaaggacatctataaaaatcctacagatagccttatgcataatgatgaaaaactgcatgctttccctttccccgtaagataaagaataatacaaagatatctgctctgaccactttcattcaacatcagaggttctgtccagggcaatcaggcaagaaaaagaaataaatcgcattcaagttagaaaggaagaaatacaactgatgatagccatcattcctaagagttccccttgcctctttataatccttgcctcctcttacctctctccccaggaaaccactggcctgttttctgtcactagagaccagtttgcattttctagaactgatatatgtggaatcatgcagtatgttactcaattttttttgtcagtaattggtagcttatcttgcaatcaaagttcatatacaaccatttgatcttcattccattccctcattagtccatagaatgtcaatcaatttttctttcttttatttatttattttaacgaaacagggtcttgttgtgttgcctaggctggagtgcaggcttacttcaacctccaactcctgggctcaggtgatcctcccgcctaagcctccagagtagctgggactacaagggtgtgtcaccatgcctggctaactttttaaaattttttgtattgatggggtcttgccatgttgcccaggctggtctcgaactcctgagctcaagacctcccaaagtgctgggattacaggcatgagccactgcgcctggactcaatttctgtatgatgatgactttcatatgtacatcaacaggccagatagcttatcaagaaagcttctcctctgtcttctagtaatatcccacttagatctgacattatttttttccttcaaggtatttcttccaaatttcttggctgttgttggtgacaacacaagtttttggacctttaagtttacaatcttaggttcatttccttattttatttcttccctataggtaaatgatcactaaacttgttacttcttatagttacttctttgtaaggcactgcagatatgtttcttttcatttttaaaattgcccatttaattcaagctattaaatatcaagcttgtactatatcaagagtactatatatcaagactatagcctcttgatattttccctaccctcccatcctgccatacccatgtctccactagcctatataaaacataaaatacttttcatcaaactctctgtagagaagtgttgctgggcgaataagaaaaacctgattgactagaaagcaaatgtaaatgtaatctcctttcttttcagtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaatgaatggttatcttttctctctggcaatccaaattcaccactccttaaaaattctacataagatttgctggctgggcgcagtgactcacgcctgtaatcccagcactttgggagactgagacaggtggatcacctgaggtcaggagtttgagaccagtctcaacatagcgaaaccccatctctactaaaagtacaaaaattagccgggcgtggtggcaggcgcctgtaatcccagctacttgggagactgaggcaggagaatcacttgagcccaggggggcagaggttgcagtgagctgagatcacgccacttcactccagcctgggcaaaagagcaaaactccgtctccaaaaaaaaaaaaaaaagatttgcctattccagcagacttctacccaatatcaatctagatttaaatcacttgattttccacatccctttagcaattatgtatagtttgcacttcattaacctacccttatttatgttacttctcacatacacccatatctcttctgtattttcaatcaaaagataatgcctcaaatgttatatatattgtatgtgccactcaacagtgcctcatatgctgcaaaaaaaaaagacagtaaacaatcggggtacctttttgtcttttaagccatattttctgggtcagtgtggtctttcaagggagtttagacaggctctattttttgttacttcactcctatagtatgtgactgtaaattgttccttcagtgttcaatttaagtacaaactaaagagaaacagtttcctaaagaaaaacattttaaagttacagagacacctatgtgttcgtaacatttctccagaaatatttgaagtaacgtaaaacttctggactggtcagtttaaatattttcttggaatttctatagaaatttctgtggaatggtgttatattggaaatattaattaactataagaagactcctacttcttcacagagaacaagcagggatatcctggattttcacagtatttaggccactccttaattgtctcatgaaggaattaaggtagtggaacacattcaagaattgcttaggtgtcaaaataagacaaagtgtaacagtttttttctgtagtagatttttaaatagttaaaagactctgccctctttatctatactgtattctggcaataataaagttgggcagcctatacataaaagcaatttctaacaatgccaaattaacagcagtttcttggccctttcctttccctccatgaaagttacaatattaggttatttcacaggtttcctccatgccccccatacccaacctaaaactgtgttaggctgtcaaagaaaacaaatcaggtaagattagtgtttgcctttacgcagtcattctaagtacacataaaatcatacataatatgaaaatacagcaggaagagaaacatcaaaccatagaactgagttttagttttactgacatttatatggcatacttcctgtttttgatttcagaagtgcaaccatgcagtgcttctatgaaaaactgaatagttgagtacagtttgaggattataacaacttatccaaaggaaacaaacagacctaacttactgctgttttcatttgtggaactgctatctttgttgtaaaaagttgagtatttttcaaacatcatttaataatagggtagcccctaaaacaagtaaggagctataagtctgagttgtgaatttgactagtaatggaataagaaaaccaagccaaactccatctaaatatgtatgtaaaggtaatgcttgtaaaaatttgctttttcctcattttgagatttcagttgccagttgactattggtatgcaaaattaacaattctgcctaaaggaggtaaacgatagaggttaattcttaaataaaagtccctttgtttcactattaactttttctatttgaagcataattgtgtcagctaatttattttttggtaaccacttaggaatttgggagggaggggggcactcaagtaagcaatgacagccagctagacatcaaaatccatgttctcacttcatggccgtacagataaatttcatttcctagcctctcttgcagttagatgtgggcatatgactaagctctagctagtggaatgagaatggatgtcaactactttaagctctttaagtcaactaaagaaatcaactactttaagctcctgtccctaaaaaactcccaacagactgacccctccaaggaaaccttggaagttaggtcctaaatgcttaggtacagtaagaccttggaaactactaaagaaatagtaaagtaaacttgttttgcaagaacaactttgagccactatatattttggggatgatctattatggcaattagcctgccgtcattaatttgatctataaaacatatatgaagtgtccctgtgatacacaactccagtggtcacacactgtaatgtatgcaactgggatttttctgaagcacaactgagaggctacaggtatgcatacatatggatataggtaaatgttcctcccaggagtggtaaaatgctgtggctttgccaactaactccagcttctctcatgggttttattgtggatgattattgatttgtgtaaaggaacttcccttttgtgtctgtggtaatagataaaggtggaatggatcctccaacaagaatcttgaggggaaaatatatacttatgatcaaaataagatatctttcttgggtttgtccaatagtgatggctacatagtcttcctattaccttttatctacaggcaggcagtaggccataatagtattagaagcccctccctttctccaaaaaaaaaaaaaaaaaagtgctctgagcagtaaagatatttaatttaacatatctgcgcttcatgtttctcatctgtaaaatgagagttggattatatcacttcaaaagtttccttttttcactaaacattctcccatctatgactacaatgtccagagctaatggtagaaatatatatatatatattttttttttttgagagggagtctccctctgtagccaggctggagtgcagtggtgcaatctcagctcactgcaacctccgccttcggagctcaagcgattctactgcctctgcctccctagtagcggggactacaggcacgcaccaccatgcccagctaattttttttttgtatttttatagagatagggttttaacatgttggtcaggatggtctaaatctcttgacctcgtgatctgcccgccttggcctcccaaagtgctgggattacaggcatgagccactgcgcccggccaaaataattttttttgttttctcttttattttgagacacagtttcgctctttttgcccaggctggagtgcactggcacgatcttggctcaccacaacctctgcctcctgggttcaagtgattctcctgcctcagcctccggggtagctgggattacaggcgccgcccccgccccgccccgccgccaccacccgctaattttgttatttttagtagagacggggtttctcagtgttgatcaggctggtctcaaactcctgacctcaggtgatccgcccacctcagcctcccaaagtgctgggattacaggtatgaacctccgcgaccagcctatttgaaataattcttaacatgagcatttcttcagatttcaagttgatattacagaagcgcaagtgcttcatagaaacttgaaattattttaaaaaaatgtttaactctcaccaaggcacaagagaggttatactcttctcccaaacaagctattaaattgaaaggattttaaacttacccaaggttttttagagtagttttattattattattttatttattcgtttttttgagatgaagtcttgctttgtcaccaaggctggaatgcagaggtgtgatcggctcactgcagccccgacttactgggctcaagttatcctcctgcctcagcctcctgagtagtaaggactacatgtgtgtgccacagtgcccggctagttagagtaattttaaaacactgtgtcacttctctgatttctatactttactccatgagtggagaaataatatcaaagctaatacagaatgtgatagttattgaaataatactataaaaagtcaaaaactagacagcagattttatagtttttcagtgaatttaccagttaaaaaccttaaattttacttttcctaattgtatgtttataatgtttcaatgtaataacaattcatataatagcacattcaggatcatggcaaaatcagctaagtcatagttaacacacactccttgtctctacgtatgtggtgctaagtcatatttttggtatagctaacaaatgattttttgtctgtctgctggtggggttttaatctcctggatttcaactttggttaaagttaaaaaatacactatccagactttatacaggcatgaattggctttaattcacattcttttgctgcaggagagctgcagaaatatggacctcactcagggatgatactgttttagaaaggagaagggacaggctgtataacattgtccagagtggagttttcatgttgcgagaaagccatgtataggccggagtacatgagtaaaaggaataacaactcccccatcccctgccacaaaggaacaagacaggagagccaacaatagtattttgactattagttgacgagtatggattctaaaaatatctttacataattgcagaaattgaggaacaatctaaatgtttaaaaatgagattgataaataaattttggtatatctatatgttggaaagctatgcagatgttaaaaacaggttttcaaaactattcagtaacatgaaaaaatggtcattataaactactgagtgacaaaaataagatataaaactatatgtagtaattagcaactatatattttaaatacaggaaggaaacatgaatgttaacattggtttttctctggctggtgggattacagatgacaatacttttgtggtttccaacatttctctagttaacacattctgtttacaattttaaacattactttcaaagaaaaaatgtgatatatgtaaatatggttatataaaatctgtatacatatgtattttatttatgtatatcaaaaccagaccaaaaatactgagtttgatagttttcagattgacactgtaacagaatactttccttgaccctcattttatgttgagatctttatggcagtgaaagggctagagagaggcatgtactttcagagtttctgaaatgacatgtatagtatgaaaaagcatagaagcattcctcaattttcacatcttgaattttaatacaacctgtaattttgtacatactaaatgaatgtattagttttccaagctacagcattggtggccagttagcagttaataataatatttttcaaaggataataaatgaaaatattgttggccaggtgcggtggctcacacctgtaatctcagcactttgggaaaccaacgcaggtggatcgcttgggtccaggagttcttgaccagcctggggcacacagcgagatcccggctctacaaaaaaaaactaaaaaaattagtggggcatggtggcatgcgcctgtaatccaagctactcaggaggttgaggtgggaggatcacttgagcctgggaggcggaggttgcagtgagccgagatcctgccacttcactccagcctgggcaacagagtgagataccatctcaggaaaaaaaaaaaaaaaagttgaatatactagagatccaaactatttggaggaataattgattttctgggcaaagctaagaaatagaagttattcatactattggctacaaatttgtaaatatattggattatactccctcccaaatcataactcttaatcctgcagttttattgcatttttctgggtatttagttttgtgatgcttttctgggagactaagttaagagacccaaactcagattttaaaattagttcattttttttttgttttacatttttctaattatttctatcaatgaaactgtggcatattacaaaatttcaagataaataattttctgtcatgtttcataggtcaagtaaaaaaaaggttctgcagctaaaataaggcttaagggggaaaagtggccagcagcacattcaaagtttatgagcacagacttggggaatcggatagatgtaggttcaaattcttatactgggggtaggcaagaaagatgcataaacagtgaattttaaagtttggagggattttagagatcatttaatcaaaatccattgttttgcaaaggaaactaacaccctggaaagttaaatatctcacctaaagtttcaatcccagcattgctactcatgttatctaggtttgcttacttcccaaattcagcactctttactttctactacaatatgctacatttgaggttggaggagaccagattatagaaagtactgaaaattagaccaaagagtttgaacttactttaaatctgtctgtcttcattattattattattatttggaggagtggtactgggcacaatggaatgataatgatcagagtcataaaagatgtatagagatcctatgtttcctgaaaattctgtatcatactcagtacaactttaaacattctaggggagaacccaactcatttctttgtcttatttaaataatactgagtaatggaactgactagattacagttgataactattttattttttcacttgcttttgtcattttattccatgaattaatggtatacatgtgagattaaactgatgctgagttgggaggcaacactgtttggttctgaagagcagacttttccttaaaagttaaaatattaagaataaaatcaaaacaaaaaccttgagtctaaatttgaatatgactctcaactttaaaaggtagtccacataaatttttctccttagatttatttttgatattaaaatatatacagaattaaaagagaaatttaattttttacagcaaaatttttaccagataatgaagcttaaaaatgctgaccttttagctcatttctaggaatttattctagtttaggaaaatagatttatgcataaaaaagctcatggcaatattatttgtaagtaaagaaaataaataaccacttacaaggaacattatgcagacactgaaacttttgaggagttttcaatttatgatacatttgaggaaacatttatgatacgttgtcatataaaaaggcagtgtacacaagcaatttaaacttcatcagcttaaacaactgcctggaaatatgtcaactctcaacagttgcctctaaataaaggaactattggttattttttcctggtgtcctttaaatttttttttctttattttaacctattttcacactttcttcacttaccatgtactacttctataatcagatacgtgtttgtatcctaatgatatgttttcagtatcatcacgagtataaacatatgtgtgtatgtgtatgtgtgtgtacattgttgaccaagagaaaagttgatattacttaaatccaaataatgaaatttccaaaaaaacgcatacatatcctacaacttataaaattataatggtttaatacaatgtactaagtattctgacatagcaggctttcagtatattagttgatgatgaagataattagagaagggatacctcaattaatttaccaagttccttgagtctgtcagcaactctcccaccaagaatttaacaatataatatgacattaaaaagctggtttgtgtggtgcatttttgcaaactattattttgtatttttatttttttttttgagacggagtctcattctgtcatccagactggagtgcagtgccgcgatctcggctcactgcaacctctgactctggggttcaagggactcttctgcctcagcctttcaagtagctgggattacaggcacacgccaccaagcctggctaattttttttgtatttttagtagagatggggtttcgctatgttgcccaggctggtcttgaactcctggcctcaagtgatcctcctgccttggcctcccaaaatgctgggattacaggtgtgagccactgtacctggccttaaatgctaagttttgacacacaaaaaagaaaaatttgtccttaccttgttcattttgatcagctatgtgaggttcaggtaagattttacgatcagtaaaaaaggtttcttgtggaagtaactggaaataagatttaccttgtagggtcattataagttttggagatcatgtatgtaaagtgcctagcatagtgcctggctcacaggcactcagtaaatggtggctattataatacataatattaatatgactccttttgttatatttctatacataaggtgatctgaaaaaaatatgaagtgtagtcccccatttaaaaacatgattctagggctggatgcagtggctcatccctataatcccagtactttgagaggccgaggtgggaggatcacttaagcccaggaggtcgaggctgcaaggaagtgtgattgtgccactgcactcctgcctgggcaatagagtgagaccttgtctcataaataaatagatagttaaataaataagtaaacaacacatttctagacttctagataaaatggggagtgaaagcagaccatagaatctctctgcacatatactttacaagaagtatacaacagtatactttgtatactggaaaaacaacaataagaactcctttaaaagcattactagaatcagctagaaaaagaaaatgtccacaacctaaggcaacagaggccaaaagaatgcaattatttcaaaataaatttggaacagcaagaaatgaaataagacatagctggaaaagtcaaattctcaccaagaaggaagactggcagtcccagaacattcccctaatgaattcattcttttcttcttcaacatgattatgtcccatgtcttctctcctaaatctcccacatctctatgctcctcacttcaaatcttgtttcattgataaatagaagttgttacaagagaaacttatcttcccatatcaaatctaccaatgtgcttttatctgtactcaaatatactttcttcctgttacaaagatcaactatccttgctattatctaaggcaagcccctctactgtgtcctaggtcccatcttctcttgcatattcaaacattttgttcctgtgattatcccctccatatcctgcatcctcagtttctccctcatcaccctacagtccatatccacatctgcttacaaagggaacagaaggccctttatatcaaagttcttcaaagactctataattgcaatcttcacttccttacattatctcttgaatccattccagtttggattattgtctccacagcaccacttaaagtgctcttgttgagattaccaactaccttattgacagatcattttcctcttctcaaatgtctgcgagtcccagacatattcctcatacccaccatcaacatttccctccaaggtcatgtcttcaatctcttggtgttaaatactgtctaccatcataggactcctaacatttatattctatccctgatccctctgtggagctctggactcacatacaactgcttgtccagcaactccgctcaaatgtctaaagagaacctcaaagttagcacatttaaaataaatctcttgattttcttctcctccacattttacttctccctaagtcttccctcatgtcaatatatggcataatttctagttactatgggcaaacatgtagaaatcgtccttaattcctctttatcccagttattaagctgttatctttcagcaataaacctttccataaacactgctttgtgatgctgggactgggactctgcaaactatatttttactttgccagctgaattcctgctatgtttcatcaatatagagtagtagaggaaaactagaagtcaagaagaagggaaaataacttgccctccctcataggccttctgtacctgtcagtgttgccccagctgtgggccttcaccctgacaatggtagttagctcaaaattgcaactatgtttggctctcctagaccagtcccaacagaccctctcaggagtaccagcagcagatgggcagcacttccttgtcggaggtcagagttccagctctgccaagtccctcctcctagctcctgggttctaagaacttgaggtctttctgtgtttacccagtaccaggggcagtagctgcttccccaagttactctgttatctcagtgctctcttttcgcttttttcagtcctgcaacacccatttaaccaatctcttatactcagtgattgctcttgaaatacttaacagcagccagagtggttcttctatggcataaaccatctgcctgctcctcatcacacttagaacaaacatcaaattctttcctagggtgtacagctcctttggtgatctggcctacccatttctctagtctcatctcccacctgcttcccgttactcgtttggctccaatcactctctcttgaacacactgcttttccacctcagggcctttgtatgtgctcttctcatacctggactgcccaggtctttgcctagctcactgccttacttcactcaggcctattctcaaatgtcctcttagagatgcctgccctaactactctatctaaaatgcacaatcctctctgtacccacccccaacccgccccaattccttacctccatttctttttcttatcactacaagtttatttcttcctcttccatcctcaactgaaatgtaagcttcataaaggcagggatgtgatcatatttatcactggtgcctggcatatatagtaggtactcaaattctagttaataaatgaatttaagaaattctagaaattaataaattgtaatgaatgtagtagaaaagtagaccaaagaaattgcaaagaagataatgtggaagtaagacaaagctgacataatataagctgatccatctccctgcatatataatgcaacaaatgaatcagaaaaggcacttaaagatgtaatagaggagaatttccacaaaataaacaagtctgcagaataaaatgttcaatgtaaaatggacgtatattcaacattgaggcatatgctcataaagaatgaagaaaaaacttttcaaatctcttggcagaaaactaaatcacttacaagagggaggaaatcaagctggccttagacttcctctaagcaatattcgaagccagaaaacaaaggaaaaatgtctgcacagttttaaggcaaagccagcatgacccaaaactattatatctaaataagtaccgttcacgaattaacgaaaaaggcaaatatagcatctatgagtccatgtaggggaaaaaaaacttcttagtaaagagcagatgactaagtgatgaatcaaaattaataaggaagatatagagaagcaaggcatgttgtaagctctggatttttaagtacagatcaagatgagataactaaagaaatgaaagttacaaaacaaataaaccttaaaacttgactttgtaaaaataataacataaccaataaatatatatttttcatagcagagtctgctggcatttctgaatttgaaacatacggattaaaaagtctctaaagccttaatttttaaaatcttgggtattttaggaactaagctctcttgtgatgacgaaacattttcaaaaattcagcagttccttccatttctcttccaccaaattagaataattttaaatttaatactttccaatttaaaagtactgtgatgttctcggctgggcgcggtgggtcatgcctgtaatcccagcactttgggaggccgaggtgggcagatcacgaggtcaggagattgagaccatcctggctaacacagcgaaaccccgtctctactaaaaatacaaaaaaaaaaaaaattagctgggcttggtgacgggcgcctgtagtcccagctacttgggagactgaggcaggagaatggtgtgaacccgggaagcagggagcttgcagtgagccgagactgcgccactgcactccagcttgggcaacagagcgagactcgtctcaaaaaaaaaaaaaaaaaaagtactgtgatgttctcatcttaaataaaatgatcttatctgtataaatgcatagaaatatatcctaaactgatattcatttattttgatggtaaaatctaggatctgaggagatttaaaaactttcctgtaactttctatattgtttgaattatttataaatgagcatgtatttttataaaatcaatagccattatccataaaatagcattatacacaacaatgtgaatatacttaacactactgaactgtacccttaaaaatggtgaagatggtaaatttatatttaccatttataacttttgccacaattaaaaataataaattttaaaaatactattgtaaaatttataaaatagctaatgcacaatagctttacagatgaatttacagattctaccaacatttgcccgaacaacttttccaccaaaatgtgaaacctcagattatacccttgcataatactctatatttgcctatacattattttagtaagcagagattattcactggcagatactgttataactatgccaaatgaaaagttacttatgaaaagtaactaataagttatgttactttattaactatccttgtgctgtaaagttgtaaatatgtcatttgatttaaatattcagaagaaaatcttttagctttaatgatttttttcctgattgttaaaataatatgtgctcattttagaaaatatacaaaggtaaaaatgaccataatcacagagtacattttggtgtactttttccacccttttcctatgcattttacatatatattatatatgcatttcctatgcatttttaaataaatgagaaagttttataaactaaaaatcttagtgtatattaaacattaatatttgtgtcattaagtatttttaatagatacatattttgttagattgatacaccatggtttattaaaccactctcccactgctgaatattcagattgtttcctctgtatagatactctagtgaatatgcataaatctgtgatttcatatctgattatctccttcaaattggttcctgttagtgcaactactgtgtcaaagaattggacatttttaagaccccagaaaggtaatagataagactgaaagttttttttttcttttttttttcttttgagaccaagtgttgctctgttgcccaggctgcagtgcagtggcacgatcttggctcactgcaacctccacctcccgggttcaagtgattctcctgcctcagcctcccgagtagctgggattacaggcacaggccaccctgcccggctaatttttatattttttttagtacagatggagtttcaccatgttggccaggctggtctcaaactcctgtcctcgtgatccgcccgccacggcctctcaaagtgctgggattacaggcgtgagccacctcgcccagacaagactgaaagttttattgcactcttagtggcactggttatcagcacttattttcaatctttgtcaatctgacgggggaggggtctctttctgtaatttaattaggcaaagttgaatttttactcacatattcataggaataactttactaccttaaggacttgtaattctttgtttttttacttaagaagattgcatttagttcttaatgtatttgtagacagagcattattactatttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgcattattactattagctagcaagatcatattttctttttttaagaccctaagctatgtgatcctggtatcatattttctgtattgaatttatttctccatgtgccagtttcactacactttccaaagtgctactaaatgcttagtttataaggttttaaaaaactcactgcataattactttaaaataatttcctcaaccctgccttcattcaaaatgtctggagacagactggcccacttccaattttctttcacgttatcattactgtgaagtcattctatagataggagagcattctggcatacagaaaaacagcatctgtgaaactatatggcacagtttggttggggttgttgctccttcagaaccgcattatgtaattttagtgtttacttaagctcctttgggctgcctccgtggtagctatgagctcacagagaagtaagtacagtttagatctgatagcaaagtctatcagtttatcctgaatgctgcatcctttttttgttgttgttgttaaatcattactgtatgagaaactttaaaaacaaaggtatagtttcttcattttattttttaaaaaagctacttcaaacatcattaagtaatacaccaaaaaataaagggttcataaatatatatttgctccttatctggacgtacttatttaaaaactcatattctacagtatgaacttacagtgtgattttgactcaacataaatataaatatgcaaaattaccaaaattagagggattagcctttaggaaagtacaaattattaaaatggcctaagcactatttctatttctaagtcatagaggaagcacatttaatatttcttaaaaaaaacaaaaaacaccaaagatgtataagttaatatcagcttagggagaattttacaagatactaggttataagaaaagattatttaaccttgattattcaatgaaaagtagtattttcagttttttagagcgataactcttgagtctctctaccaaacaaataattatatatgctggtttaaaataaaaataaatcagtctgcattataaaggtgggagaagtatccatttttttattgtaataatcaagtgttacgtcgccttcataggaaacatgcatactcttataaaatacttaaaagcctcaactgttcctttagaattactgattttgatgaataaacaagccccaataaagtcaatatcgtaacatctaaaagcatattgtcccttttgggaaatgtcattttgttttaattattattataaaattacttactggaatattctccatagcattttgctttttaattttgagaaggacattatgccattgattgccagcgatcctatgaggtccaaagttgggataactcatggagggcaaagaaaaaagttttcatcaccgtggaggtacagctactgtgaatgtcctacctagtttgggagagaagggtatgtgtgcacaggaggcctgacctggagggaatggacacagggagaagaaaggtgcaggaagattatgagacagactgcctactcaagttggctcaggattagctttgctggaacatttaaatgtttgggtttttatatttcattctaatataaaaaagagggtatttattaggtttcttatgtttaaacttttctaatgtacaaatgtactgtttataaatctatttatcagaagttacatgtggtgattttaaacatgttgcaaattgacactcctaccattaaaaggtggagtctaattcccctccccagaacacatatggccttagtaatttgcttttaacaaacggaagtgatggatatgatgctgcatggcttctaagactaggttataaaaaatgatacagttttaccaggtgtgatggctcacgcctgtaatccaaacactttgggaggccgaggcgggcggatcacaaggtcaggagatcgagaccatcctggctaacacggtgaaaccccctctctattaaaaatacaaaaatcagccaggcgtggtggcacgtgcttgtagtcccagctgctcaggatgctgaggcaggagaatcacttgaacctaggaggcataggttgcagtgaactgagatcgcgccactgcactccagcctgggtgacagagtgagactctgtgatacagtttccatctggctctcagtcttaggacctgtggaactagccaccctgttgtgaggcagccagaccacatggagaggccatgtgtaggtgttctggctgatagccccagccatcagtcagtattaaccactagacaagcaagtggacaagccttcagatgatgccagctccagcctttgagctgccccagctgtcatccagtggattagaaacaagttttctctactaggcaaggtaatgttgttttaagccactaaattttggggtggtttctgtacttaagtcactgcttccaataaatccctagtcaggttaactgtaacgggttaacctgttggaaggaaggaaatggaagaggcaaaggaaaaccctttccttccacgcttccttatttccttagccagactgtgagtttagcaccttctgctactaactgttggagattaagtgtgcttttgaagtgcaaaaaacaccatcatggggactcagtctatcccaacacctttccttgagggcttagagactgagcaggggaaagacaaagtttgatttcttccatttctccttttcttcttccttaggtatctctagtttcaaaaaaagggagaagcaagatttcatcctctcctatcttcactgtccttctaaattcaaatctccagaaagacaattatggtttctttttcactgaaagagaacacagctttttcagtcatataaagggaacaaagcagcaacatgtttctattatcaaggaagcaggattttattcatcagttatatgctacggacactgctctgtctttagtcactcatcacggttcttcaaagattccttctgctccccttcttcccctgaatatgggtgttcccagggttccctcctcagaccacttcttacagggcaccctttgtggtccatctaagcccctcccactgctttagctatcacctacattttaatgactccagagagccaaactacttcaacaccccctgctcccccagtagttctctgatacttcagattctacagggacaaaacagagttccttcccctagacttgaggcctacttctccttttagtccacaccctaaaccagaaatctgggtatctcttgctcttgccctttacagccaaccagttttcccattccaccaacagaattccaccaatttaattacttccttgaattcctcttttctctatccccactatccctaggtacacagcggtggtcctaattgattgttacttaggtcacaggctgttttacattccatcttcaagtctccaggacttcaaccagtgtacacctcaatatgacatttccaaaactcctttcatggctctccctttcctatgttttagtcctgaggcagaataggaatttactcataaagcaagtaacccccctaaaattgtatgcaaaattttagtataggtatgtaagcgcatttttttttcctagagaaagagcccattgctttttattttcctcaaaaggtatgtgtttcccccaaaacttgtaggtctcaggctaaagtccaaattcttcagcatgcagggtatatacaaagccctgcccgacctggcctcttgcctccctgcagctaacctggcaattgctctctcttaacatctacctcctggatttacaaactggggtggaggtgggaaaaaagaatcaaaatcataaagtgaagccaaaactgtttgtgtagcatttatacactgttgaagaatcaaaggcctttttttcatagtgcttttcgggagggagaaattggattgtaaacatgtaatttacaatctccacattttttattctagataaatgccacacacaccttcctgttacagaatattgcatagcaactttcaacatcattcagttttttaatacctatccacatatgatgttatgtattttacaaatcctgcaactaacaacgcagttcttgatagactgcgatctactgggaggactgctcggttttcacctgaattattgctcgtggttcacacactaacacccaaaaagacactctacgggtcatgacgtgtccctaaaatcctccatctactccagaaaacgttctaactttttgagacgaactgttgtaactagtctcctggcgaggcctgctatgtcttataccacaggctctaactgccaaatctttttcagaagtctttcagttgttgcctccaaacggagctctttgcagtcctcgggcggacgaatggacggattcgagcgaagcttatttcccttctcctaacgcatctacctataaatagcgctcaccgcgctgagtcaccaaaaccccgagtttccccaaatagcgcgtaacgactgctgggatcgcgtccctcggggctctgtgacagactccaaccacacacccgctgggctggactgcgggcccacacggcccagcgggtctctcaccacccggcgccccagggacgcgggcgaggccgcggtgtccggaccgagtcgacagcgtcggacttcccgcgcgcggacggcgctctggggaaggaggagccggcgggcggctggacctggccttgactgcgcggggtccgcccccgccccctcgggagcgcagagttgcggggggccggcaccagcctccgccctgcgccgcccgctcacacaatgggacgcgtcgggagggggcggccgcggctcccattccggtcccagggcggggactccgggcggcgggagaagcagtcgggctggggccagaaggaaaacccctctctccctctgcccactcaaactgcgaaagggctccagccggcggtgccaggggctggggagcagctggggagggagcggaagtgccaccccctgcagtcaagggtggtgacgtcacccctgcagccagcctgtagcgggggtgtctgtacatcacatgacccggcccccctctccccgccgaagcccgcgcgcgcgctctctcccccagccccgactcccacctctcccccgccccctctccccaactttcgccctccccgctccggcaccgctgtcaacagcgccagctccgccccctccccgcgccctgtggaaccgccacggcggcgcggcgggcgctcgcgctcaggtccgaggctccgagaagcgagcgtgccccggttccaccctgccccccagctcagtgcttgctggctgcgtgggcaccagagccagggggcacggcggcgtgcagcgacagcgcttctctgctccatcctcccacagcagttagaggacgaagctgaggcgccgggtccgagctcggagggagcgaggcgcatgcagcggcctccgggccctgacgcgtagcctccgggggtcggcccacgggcgagagaagcagccgggagcccctcctcgaccccagcaaggcggcccgcgcctccgctctccctaccgcccgggtggcgcacgccagtcctccgtctttggctgcggcgcaggcaccggccatacgacgaggggccaggcggggaccgcctccttgagccccctcggccacccctgccgtgtggactgctggggttgcagatttgctggctgttgctgcagcgcctcgttctatttttcctctcagttcccttctaaaagtggaggctcgggggaggaaaaagaaagcccacagtgttgaaaggggcggtacggactgacctgtcaacggcggaggaggaagacccccgttcggggcgagctctcgagcccgcgcagggatcggagctctgggctcgcgcggaaaggcacggcggcagctgtgcctcagccaggtgtcccccctcggcggggcccgcgccgccgcgcccgccccctcccccggcgcagcgctccccgccccatcgccggggaccagggaaccccccggctcgattttttgtgcagtttcagcaaagctcc

SEQ ID NO: 1020 - DNA, 21461 bp, Homo sapiens
gggagagggaagggggcggagctagccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccaggtcagcagggatctgcgtgggttgggggggctggcgaaggccgtctgagctccagtccggcagcgcggcagaaaccagcggggcactgtcatgggcctggggaggagcggcctgcggagggcgccggggcagtgtgtctgtggtccagaaaacctgctccgtccggagccttcctggccccgctaccagcgtctccacatcccctagaaaagaaaagacgggtgtgggccttaggttacagcgcgccgccagcgtttggttgcatggcgccgggggagggcgccctaaccgagaagctgcttaatacaaagagctccaggctcctggcggttcaccaggtctaaacagccgggctttatttgtgggggcgattgaaaaaattgagggtcaagattggggtgctgtgcaaataaatgcgttaatactgttctttttcttctttctttgcagtagcctctagttcgttagtcaaaacgtgaaaaaaaagacctgctttgccctgggaaatagtaaccctgccaaatacatcagcttgtaggagacagaggtaaactacaataattttcctgtgttatcttttttttttaaacacccaatttcaataggccctagaaccttccaaaatggaactgtgtgtagaatacgtatgttcccatccactttcattggtggtctttgttctttgcatattttgttaaaacttagaaaaacagaattcacgtttagcaattatttatgtggtatttatcttaaatatagccaaacattcatattacaaaggaagaaaggggcttccacacttttttcctacttttttttcccttctcctatgcttagtgaattgtcaggctgctagggcttgtagaacagggcttgagttttctagagacctttatataataggcactttaaaagcagaatttcatttacataggcactccttctagtagaacttgatggagctgttaaccggctatacttccttcttgcacaatgggagcgtccctatccctccctaaaaatacgttttttttcctttctcccagctggcttactaaacctccctgggaagtcctttcctaaaaccgggctgttctgttcattctatacatttatgataggttatctggccttaattctgtcacagcttttgttcagatatgctcattttcatgacactgctttgtacctgataccttatgtaatatttgttttgccttgccttgaaatcacagttcaagtttagaaccttttcttgcttgatacactgatgctccaaaataacaccttaaatgtgtagagtttgccatatgtaattaaaccttatttatgtttgtatagtttcgtagtttatggaattctcacacatcacacaggagttgagaaattacttttaggcagctagaaagggtaaaagagttctcggtggaattttcctttaataaaaagcagctcctggccggtgactttgggaggctgaggtgggtggatcacttgaggtcaggagttcaagaccagcctgaccaatatggtgaaatcccatctttactaacaatacaaaaattagctgggcgtgggggtgcgtgcacctgtaatcccagctactcgggaggctgaggcagaagaaccacttgaaccgggacgcagaggttgcagtgagccaagatcgcgccactgcactccagactgggcaacagagcgagactctaccaaaaaaaaaaaaaaagcccccaaaccatttattttctaacagaaagcctgaaaagtcaagctgcaagcaaaaatatgcaggctagaagcttttatatgtaaatgtagcctgctgtatctggaagccaggtacattcaatatggggtttctcactcccttttccttgtcaccctatgtgggcgtctgggccgctcccttttccttgtcaccctatgtgggcgtcttggcgatcactaggtaaaaccacgggtgcaggtgtcatggcggccccaggtagaagctacatttgcataacaaaaaattagggtgggagggccagtctttagacgggctatgtaaatgattcacctggtcaaaccagtcccctgggccctatgtaaatcaccacctcctcaagcctctgtacaaaatcgattgcgtttcaccccaaacccggagaccctctcttgggtgatatttctcagcgtgaggaacctttccctattaaattttccgctcctaaacccactccttgtgtgtgtccatgtcctgaattctttcttggctcgagacaaccacgggtgtatcccccaggcaatggagccatttcattatgaggtaaatactataaaaatcatttttaaatttttttccaagagatgggattctcaactgtgttccccaggctggtcttgaactgggctcaagtgatcctcctgcttcagccttcagagtagctgggactacaagtgtgtggcaccattcccagatataaaaatcctaattttatgaaggataaaactggtgcttgaacacaggtactcaaaagcaggttctgtgctttccccttcactagagagcctgttaaacctagtttgtaaaaactgcaaaattttagaagggattttagagagcttatgattaaaccccttcattttatgaataagaatactgagttcttgagtccctttctagatattgctaaggtctaagaattagaaaactcaggctgtgatgcctagtttgctgtgtacaactgatgagtctccacttcttgagtgctgggggtgtcttagtttttttgactcctaaaattaggtgtttagatgatttctaagatgcttttaagcccagtatttctattcctaccccataacttttattaccatttattgcctatacatatatattggtaagacacagatgcagactaatgttaactgccttaaacttttatattttaaactcgggtaggtatggtaacaagtgtgtcttattgttttttactaagtcctataaaactatggttttatttaaggttaggaactgcatagagaggtggaccactctaatacatcattggttagagttcataaagtgatataaaccctttctagagagaaacctagtcatcttttcaacagccttaaaaatgtccttactgtttgacccagaagtacatttaaaggaattgtctaaggaagtaattagagctgtggagcaagacttttctctataaggtgtttacctaaatgttacaataccaaaaaaacacaacaacccacaaacaaaacaacacagcaacaagaacaaacccataaatgagcaataagaaagcatatccacaacatggactgtcatgtttttctagaacatatcatgatgggggaaaggcatgtaataaaataaggggataggatacaaaattgtattatgctaccagttctgttaaaatgtgtgcacatgcacggacacatgggattggaataaagacaccaaaataatagtagtggtgatttcttgctgatgtgattatgggtggctttttctctctattttctgaattttctataataaaaactaattttataatttaagaagacacaaaagctagttgcatggataacttcggtttcagtatggtgtcaatattttatggttttaattgtggtaagaacatttaacatgagacctatcctctacacagatttctaagtgtacagtacagtggtgttaactatagacatgagcagatctctgaaacttacttttatgtgtcttttataaactatttatcataccttctagaataacagcacctggccgggtgcagtggctcaggcctgtaatcgcagcactttgggaggctgaggtgggcggatcacctgaggtcaggagctcgagaccagcctggccaaaatggtaaaaccctgtctctactaaaaatacaaaaaattagctgggcatggtggcaagtgcctgtaataccagctacttgggaggctaaggcaggagaatcacttgaacccaggaggcggaggttccagtgagccaagatcacaccattgcactccagcctgggtgacaagagcaaaactctgtcccaaaaaaaaaaaaaaaaaaggcaggaaagagtccaggctaaactatggtatggagaagagaatgaaggaaaaggaaaaagtttttcttagtgctctgaactagcgaggtaatgagtgacctggtttatatttctgagaatttcaccttagtctgacaaccctttgtgaactttctgagtaagtgaacttaccaagctagtgaacattctgtactagctctattttgccttgtcaggatctctgctagaaatatcttggaaattttaactactgtttattctaggataatgccagaaaaggttggttacttactgtcttatatggacacataggtaacttttatattgtttgcaagagccacataacaattattttagatactatatgtaatatattaattttcatttttagaggtattgaaatctgatatttcttactttgtcctgttttgatcatatatatgccagaggtgctatgtgtaatacattaattttcatttttagagattatatctgaaatctgatctctgtatcttactttgtcctgttttgatcatataagtcaccgggacagtctctaaaagaatgaagagtaataacacattgatacagagtatttaaaataaaaactttgtaaatacttttcatataccttttaaaatagctatacaaatgaggagagaaactagtatgtataagtggtttgtcagaggttacagactgagagccagacaagtatgtcagtctcctcacaggtctggattcagagacttccagtaatacattaaaaaaaaaaatttatgaaagatgaaaccataggctgggcatgatggcttatgcttgtaatcccagcactttgggaggccaaggcaggaagatacttgtggccaggagtttgagtccagcctggccaacatggcgaaaccccgtctctattaaaaacataaaaatgagcctgacgtggtggcaggcacctgtaatctcagctacttgggaggatgaggcaggagaattgcttgaacccaggaagaggaggctgcagtgagacgagatcgcaccattgcactccagcctgggtgacagagcaagactgtctcaaaaaaacaaaaacaaaaacaaaccatactacagcagattaaacttcttatgaggcttatatttagctaatgttttcaaagttttactttctaaactcaatatggttttttaataattggctctttagtttttccacccattttattgtgaaaatgttcaaacagagaaaactcaagaagaatattaaagtattcttacatcctctacctagattttaatagttgttaattagacccttacttagtttcaagaaaacatttattaatggatctctcttttttttttttctttttgagatggagtctcactctgtcatctaggctggagtgcagtggtgcgatcttgactcactgcaacctctgccgcctgggttcaagtgattttcctgcctcagcctcccgagtagctgggattacaggtgtctgccactgctcccggctaatttttgtatttttagtagagacagggtttcaccatcttggccaggctgatcttgaactcctgacctcatgatccacctggctcagccttccaaagtgctgggattacatgcatgagccaatgcacctggcctaatggatctcatactacagtatagtaaggtgcagtggctcatgcctgtagtcccagctactctggaggctgagatgggagaatatagtacactatttgaaaataagattaactagtgtgctgagaggaaatgattttttttaatgagccattttattataggaattatttcaaagtaacatttgtggctgtctcagttcagtaaagcttagcataatttaatgtctatgaagtgagtttcaatgtttgctgtctagccacctgatagatacttaggtactgttttgaaattcttgccttcaaagatgcctcaaaacaggatggaaatttgagttaaatccttaagataaaagcgtgatatatttattggcttttctttttgttccctaatgggaaatgaaaaaaaacaaaaaacatgggtaatattttgaacaactttatattgctaacagccagtggaatttaaaaccttagtaggaaagtttcttttactaataggttttataaggagaaaatgaacttttgtttcagagtgaatgaatgagtactttctgcagtataatcattttgggttgatctcttaaaagaattctagaaggaagaagtccaatacatatatataaactctattatgacacgtttactttgtaagtattggcttttccatttttattattttagtggttgtgttatggttctcatttatagaagctgttgttgccagatactaattgaggtaggattcataaagcactttttgtaatccttcttctttgtggatagcttgacaatttgttcaaaaaaataaactcatagtggtggtatgcaactttgttaaaaataaaactgtaaatcaaaaagtgaatttcattgtatgtaaatttaaaagtatgttagaaaacatcaatatggcaggagaacaagtttgacttttttccgcaactagtgtctactaccacctttctggatactttaaaaagttgtcagcttttaaaattgttggtataaaacatttgggaagtttttaattggtatttgtgcttcaaaatttaagacttttctaagtattcagaaatattcaaaggaagagatgaattttggaaaacttgtttgcctttatgtgcttaatctgactttaagttgaaatttgaacagtgaataataattttgtttacataaagttttttgacttctatattaggaaaaaaactagcttgaggccaagtgcagtggctcttgcctgtataatcagcactttgggaggctgagtcccgactgcttgagctcaggagtttgagaccagcctgggcaacatgctgaaacatcatctatacaaaaaaagtacaaaaattaactgggaatggtagcatgtacctgtagtaccttacagctactcatgaggctgaggtgggaggatcacctgagcctggggaggtcaaagctacagtgagctgtgttagggtcactgcattccagcctgggcaacagagtgatactccctcaaaaaaaacaacaaaacagactgggcacactggctcacgcctgtaatcccagcactttaggaggctgaggcaggtgaatcatttgaggtgaggagttcaagaccagcccggccaacataatgaaaccctgtctctactaaaaacacaaaaattagccaggtggtagtggtgcatgcctgtaatccgagctacacgggaggctgacgcaagagaattgcttgagcctaggaggcagaggttgctggtggggaggttgccagtgagccaagatggcgccactgcacttcagtctgggtgacagcccgagaccctgtcttaaaaaaaaaaaaagggccaggtgcggtggctcacgcctgtaatcccaacacttagggaggccaaggagggcggattacctgaggtcaggagtttgagaccagcctgaccaacatggtgaaaccctgtctctactaaaaatacaaaaattagccgggtgtggtggcgggcacctgtaatcccagctactcaggaggctgaggcaggagaatcgcttgaacccaggaggcagaggttgcagtgagccgagatggtgccattgcactccagcctgggtaacaagagcgagactccctctcaaaagaaaaaaaaacaaccagaaaccccgaaaaagaggtggaggggatgtatccttttttgttcatgtcaaaggagtaagctgggttgattacttcagattttgtgttagccatactttaagattttgtaagttattttgctgtgaagagtaccttttatttatgatattaaaggctttaacttaaattatccttcaaaactttggaggcaacaaagatgtctaccatggtttcttggatcaggtattagtcacttgtggaagtggtcacatagttttgtcttagagaaagttttgattataaagagaaggcataggcagggcatggtggctcacaactataatcccagaactttgggaggccgaggcgggtggatcacctgaggtcaggagttcgagatcagcctggccaacatggcgaaaccctgtctctactaaaaatacaaaaattagcctggcatggttgtaggcgcgtgtaatcccagctactcggggagactaaggcaggagaatcacttgaacccaggaggcggaggttgcagtgagttgtgattacaccactgcactccagcatgggcaacagtgcaagactccatctctaaaaaaaaaagagagaaggcataaaactaaaggaagaaaggaagaagagaaaaggaaatatttagttttttttttttttttgtgatggagtttcactcttgtgcgatcatggctcacggcaacctctggcctcacgggttcaagcgattctcctgcctctgcctcctgagtagctgggattacaggcatgcgccaccacgcctggctaattttgtatttttagtagagacggggtttctccatgtgggccaggctggtctcgaactcccgacctcatctgcccacctcggcggcctcccaaagtgctgggattacaggcgtaaaccaccgcgcttggccagaaatatgtagattttaaagtgaatgaaaataagaatctttaaattatcaaccaaaatttgtaagttaagtcactaaaaatgaaattagaggatctattgtaattttgatgcaatttttttgaagatactttccaaatagtattttttcccctctggttcattttaagagctgtatgttgatcatgaccttgggatgactgtttattatttctaagttttcctgtgtgtgacattttccttttcacttttgatcacatttgtttgcctgaaaattcttcttggcccctgtcgttgtatcctcaattttcttcatagtttctctttgcctttggtgccctttttctcctcctcatcccacccaatcacttggtatattctttgttttcttcttatttaatatgcttggatagtattctctggaagtattaacattgcaaggatgagtaaattaggtttcttttattgagtgttgcccttaccactttcctgtttctattgccttctcaaaaatctggcctttgtgtagaattcttaggcaaaagatgatagtaatggaagtgaaaagtgtggagcaggactggggttggcagatcatcaaaagtttgacttcattgttctgaaagtttgtgtgtcttacagctgtgtggtaatctctttcagaagacaaactaagttgagtctttatagccattctctttccaatgcttttcagaggttatatgatttgtcatatcacaaaggatttttcagaaaaatcagctaattacacctttttttgcaatatgacactaaatttgagacagaataatctttgctttagttctccctatgttatgtattataaatacatgtatcttacaatctactataaaaccataaactggctgggcgtggtggctcacacctgtaatcccagcactctgggaggctgaggtgggcggatcacccgaggtcaggaggttgagaccagcctgggcaacatggtgaaaccctgtctccagcaaaaaatacaaaagttagctgggcatggtggtgggcgcctgtagttcccagctactcaggaggctgaggcagaggaaccgcttgaacccgggaggcagaggttgcagtgagccgagattgtgccactgcactccagcctgggtgacgaagtgagactctgtctcaaaaaaaaaaaaacccaaaaaaatagggcccagcgtggtggctcacgcctataatcccagcactttgggaggctgaggcaggtggatcatgaggtcaggagttcaagaccagcctgtccaagatggtgaaaccccgtgtctattaaaaatacaacaaaattagccgggcgtggtggccggtgcctgtaatcccagctactcgggaggctgaggcaggagaattgcttgaacctgggcagcagagattgcagtgagccgagattgcaccactgcaccccagcctgggcaacagtgagactctgtctcaaaaaaaaaaaaaaaacgccaggcacggtggctcacccctgtaatcccagcagtttgggaggcgggtggattgcctggggtcaggagtttgagaccagcttggccaacatggtgaaaccccgtttctactaaaaatacaaaaattagctgggcgtggtggcaggtgcctgtaaatcccagctactctggaggctgaggcaggagaattgcttgaacccgggaggcggaggttgcagtgagccaagatcacaccattgcactccagcctgggtgacaagagtgagacttagtctcaaaaaaaaaaaaaaaagccataaactaattaaccctgcaagctcagcttgtcctttaaatactgtttaccttctagatatagtccagtcatgtatggctgttgaaattactgttaaaaaagtattcgcttttttttttttgagacagagtattgctgtgttgcccaggctggagtgcagtggcgctgtctcggctaactgcaagctctgcctcctggggtcacaccattctcctgcctcagcctcccaagtagctggaactacaggtgcctgccaccacgcccagctaatttttttgtatttttagtagagacggggttttactgtgttagccaggatggtcttgatctcctgacctcgtgatccgcctgcctcggcctcccaaagtgctgggattacaggcatgagccacccgtgcccggccaagtattcactttttatcatagatggcctaccgattaagtcatatgttattgttgataatgtgatattgttgataatgtgatatgtgcatatatccctgagtaaactgaatgtagaaatatgtagtactctttggttttacaactatagagatgaatgtatatttaaaataaacttgtggcctgatgcagtggctcacacctgtgatctcagtgctttgcgaggctgaggcaggaggattgcttgaggccagctagtaagacctggtctctacaaaaaaaaaagtagccaggcgtggtggtgcatgcctgtagtcttagctacttaggaatctgaggcaggaggattgcttgagcccagaagtttgaggctgcagtaagctataattaggccactgtagtccagcctggacaacagagcaagaccctgtctctcaaaataagaattaaaaataataaacctgcattgagaaatggtattgcctgtattagggatctcaaatattttggtcttaggacacttttacactcttaaaaattgagaatcctggcctgtaatctcagtgttttggcagtctgaggtgggaggatcacttgagcccagcaatttgagactagcctaggcaatatggtgagacctcatctctacaaaaaaaaactacaaagaaaaaaaaaattagctgagtgtgatggtgcgtgcctgtagtcccagctacttggaggttgaggcaggaggatggcttgagtccaagaggcagaagttgcaggggactgagattgcactgctgtactccagcctgggtgaaaaagctgtctcaaaaaaaaaaaaaaaaaaaaaaagagaatcccaagaactttatgtttgtactgtcgatatttactctattagaaattaaaacaatttttaaaaaatactcacgtaaaataacaatgataaacccattacaagttaacaaataatttaggaaaataactattttccaaaacaaaattaagagaagcatggcattgcaatagaggcctgtaatgaatggctatttaatagaagacagctggagtcttttgtctgcttctgtatttaacctgttggaatatattattttggttgaaataaacgaagaaggctgggtgtggtggctcatgcctgtaattccagcactttgggaggtggaggtgggacgattgcctgagggctggatttctagacctgcctgggcaacatagtgagaccctgtctataaaaaaatccacggccaggcgcggtggctcacgcctgtaatcccagcactttgggaggctgaggcggatggatcacctgaggtcaggagttcaagaccagcctggccaacgtggtgaaaccccgtttctactaaaaatacaaaaattacctgcgtgtggtggtatgtgcctgtaggcccagctacttgggaggctgaggcaggagaatcacttgaactcgggaggtggaggttgcagtgagccaagatagcaccactgcactccagcctgggtgacagagtcagactccgtctcaaaaaaaaaaaaaaaaaaaaaacaacaacaacaaaaaacactaaaactaaaaattagcaaggcatggtggtgcacacctgcagtctgtagttacttgggaggatctcacttgagcccagtatttcaaggctgcagtgagctatgatcatgccagtgcactccagcttgggtgacagagtgagacaccccatctcttaagaaaaaaagaaaagaaaaggaaatacacaaaaatctaggcttacacagatatgtagttggtaaaggaaggaatattatttaaatagccttttcaggtaatttaatctttttttttttttttttttttttcctgaggcaaggtctctctctgttgcccaggctggagtgcagtggtgctatctcggctcactgcagcctctgcctcctgggctcaagggattctcatacctcagcctcccgagtagttgggactacaggcgcatgccaccatggctggctaatttttttggtattttttttgtagaggtggagttttgctatgttgcccgtactggtcgtgaactcctgaggtcaagcggtccactctctgcagccttccagagtgttaggattacaggcgtgagccactgctcccagcctgaatcttcttgtgatactatacaaaaactcagcaagtgctagtttctttgttggagtatggaatctgaaattgtttatgaacctgttggtctttcgtgaacttcaaatggatcttttacccatgcctgatttgtaacatgcattagtgacttgaaatagtattcactgtgttttgcagatctccaaatattgacacatttcattatacagtactcctttcccctcagaaaatcctcacattcattaatatcactgcccatctcatcataaaagtctttaattaatgggaagctgtcaggctcataaatatcaaatgttttccaaaattctaatttttacataaaacccagccttttcattagcaagagatactgtcaattgttttctttgaagtagcaagctcattttttttccccagaaaatgtcaggtagctaagtctgaatagccatagtttatcatttgttctttcagaaggtaaaaatggtgttccatgaaaaaaagcagctggtttaacttgccgctcttcacttaagtgctttttctccagacaacatctgccggtatgcagaagtgctttgtgcgtactgcctattttgtcacgcaatatattaaaaaactgtacacaggctcaagacttaataaaatgaataatttttactgctgcatcaagaacattcttaagtgaaaccggtactccaaccccaatttgggtggtgatgaagaatacaattcagcgcttcttacagctttgctcgatccctcctaaggcttcagcagtgtctacacaccattgcttttacaccattggtacaaatgttgacatggtgcaaaaagcaagtaacatcttagtgtcattacgaaaatagttttgatctcacagatgccctgaaagagggacatccaggtttctgcccaccacattgtgaaaattgatgattctagataatacaaaatggcttctgttactgttctggtggtttaaaaacaacaaaaaacctcatttagttctctacctagaagagtgaattgcaactctcatcttgtgcttttacctgtgattttaaaaattgtaatcttgcctttgaaacaaaaatatgccaattcataataaagtctacatgagagtacatgtttggatttatatttctgtgcttctttcttttatataacataccatttcatatttgtgggcccagagtaaagagctcattctgttacagacactgaatagccttgtttttgtcagtagtcagctctgttttaaaacaattgcttgggtcctgctggctcaacttgcagttgtcctagtcctgagtcttgtcttagccaaagactgttgttggaaagcccacacaaaggccttgtgtataggatgccctactattaaaggagcatgttctagtctcagtggattaaatttgctttggtgtgcattcccttaccaaatttctcactactttgtttggctggttatttcagtgaaaaatcattttaacgtgaaggcagatttcttctaattattacatagtcctagtggtgacggttattggagtaaaataattttttttttttctggtaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaaaaaaaaaaaaaatatatatatatatatacacacacacacacacatatgtacacatacatatatatacatatatatgtatatatagaacacatggcaagagcaggaaatgggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaaaaaaaaaatatatatatatatatatatatatatatatatatatatatatatatatatatatatagttttactaggttttcatggataagtttttaaatgtaagacaggaaagggatctatttgatgtctatcttcagatatattggcagttttccttaagctatttagttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtg

SEQ ID NO: 1021 - DNA, 21461 bp, Homo sapiens; identical to SEQ ID NO: 1020

SEQ ID NO: 1022 - DNA, 21461 bp, Homo sapiens; identical to SEQ ID NO: 1020

SEQ ID NO: 1023 - DNA, 21461 bp, Homo sapiens; identical to SEQ ID NO: 1020

SEQ ID NO: 1024 - DNA, 5669 bp, Homo sapiens
agttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgctttgtagtttggtaattcttagattttactattggtttctttgcttagaatgagtttctaaatgtgaactacaaaaaccactctacttcaagcatgatcattagaagaaggttagggatgtccccaagcatcattttatcccttaaaactacagatagtttaggtttctgcctgaactaatctaagttagctttttcttcacatctcataaactaatggtgggaggacacaaagagctttatgaaaacatttttgatggcagataaggacggagtcataaagctgtatccatgcagatgtgttatgctgacattattgttattattgagatggagtttcactcttgttgcccaggctggtatgcaatggcgtgatctcggctcaccacaacctccgcctctggggttcaagtgattctcctgcctcagcctcccgagtagctgggattacaggtatgcaccaccacacctagctaatttttgtatttttagtagagacggagtttcaccatgttggtcaggctggtctcaaactcccgagctcaggtgatccaccagcctcggcttcccaaaatgctgggattacaggcatgaggcactacgcccagcctatgctgacattattaaagccaacagatagctaatctgaaaagttcatgtgcatttttttctttttttcttttgtttttttttttgagacggagtctcgctctgtcacccaggctggagtgcaatggcgccatcttggctcactgcaagctccgcctcctcatgtgcatttttcttgaattggttctgtgtactgcatttgttctgtggagcacctcagtgaatagaagattttgccctttccactctccagaggcttttgaccccaagttgtgctctttgacaatggagagttattgcgtaaaaagtgacaataaaatcttgacatttcatatctgcaaaatttcacttaaaaaaaggtaaatttcataggagtaagtcgcaaaggaaaatccataatgtcagtgctaataattgataagattagatctggaggggaaattgtaagtgcacagcattcattaaaatatttgattcaatcaactaattaatagcaaattcaaaacaaaattggaaatagttatataaaaattaatacaatttgtttgatcaaatgttttctttagaaagtgatctctcaaaaattgatgagtgttggtttacttctaaatatggaattgaaatgactttcagaatcacagcaaggtctcgattttcagcacctgattactgatttggtagcctagcacggtggctcatgcatgtaatcccagcactttgggaggccgagatgggtggatcacttgaggtcaggagtttgagaccagcctggccaacatggtgaaactcaatctttactaaaaatacaaaaattagccgggcatggtggtgtgcgcctgtaatcccacctgcttaggaggctgaggcaagagaatagcctaaacctgggaggcagaggttgctgagagccaagatcacaccactacacaccagtctgggtgacagagtaagactccatctcaaaagaaaaaaaaaaaaaatcactcatttggatttgtaaagtaaatgaaatttcaaaaaaaaaatctgtcttgagaaggtatgatgcctttgaggttgtaagtcaaatttatgtgtatagttttgctagttattaaagggatgctttataattaagcttctttttgtgtgtcctaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtattttcccactta

SEQ ID NO: 1025 - DNA, 5669 bp, Homo sapiens; identical to SEQ ID NO: 1024

SEQ ID NO: 1026 - DNA, 89 bp, Homo sapiens
gtcaaccttacttcagcagcacagttaatactggagataattttagaatcttaacgccaatatttacgtgctgctaaggcactgctgac

SEQ ID NO: 1027 - DNA, 83 bp, Homo sapiens
ccttgtatttttgaggcagcacaatatggcctgcaccttttcaaaatccacaaaccattatgtgctgctactttactccaagg

SEQ ID NO: 1028 - DNA, 23020 bp, Homo sapiens
gaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccaggtaggaactattactgttctcgttttgaagaccaggaaacctaggctcagagacgttaagtaatttgcccaagacagcacaggtggcacagaagtggatgaatccacatctgtcagattcagcagccctggagttctctaccacgctgtacgattcaacctgagcccacacaggaggcgtggtctccttcttcaacggtgtgtgtgtgtgtgcgcgcgcgcctgcctagagttaatgattaagtttgctgaagcccttcttcccggtcctaagctgcctgttgcgaaggcgctttcattgaattcagtttctcttaccgtcttaacttgttcataaactttttgagataggaatgggcagtttttctgtgtcacttaggatgatttttttttttaatggcgtgataagtgaactgaatccagcaaagacgagtttctgttgtgcaacacgttggtatactgacagctaccacgtattgactgtgtactgtgtgctgggcactgtgctaaataaatgatttacgaattaatcgtgtttattgctcacaacagccttatgaagtaggtattatcttcactttacagatgaggacacctgaggttcagattaagaaatctgccccaaagtcttagaactggtaagtagaagcaccatatctaggcaaacctgtctaccttcaaaaaaaatgggcactctgataggacaattaacgataataaagttgtaatttttttttttttttgagacggagcctcgctctgtcgccaggctggagtgcagtggcgcgatctcggctcactgcagcctccgcctcccgggttcaagcaattctcctgcctcagcctcccgagtagctgggactacaggcaagtgccaccacgcccagctaatttttgtacttttaatagagacggggtttcaccatgttggccagaagggtctcgatctcttgacctcgcgatccgcccgcctcggcctcccaaagtgttgggattacaggcgtgagccaccgcgtggagccctataaagttgtaaatattttaaaaccttcattgtgaatgttaaataagagagtagatatgaaagtgcctgaagtactaataaggaagtgggagaagggtagcatggtttgcattatttaagtgtcttggaaaagaaatggattttagcaatttgagatcagcaagaagtaacgtggcagagtagtataaatacactacttaatctctggtacttttttgcactacttaagtgggtcgactctggaaccgagctgcctgggtgaatcccagctccactacttactagctgtgccttgttgggtaaattatctgttggaccttttgtaaaacaagtactattaatacctcattggactgttgtaaggatgtaaatgagctaacatattaaaggaatttcaacagtgcttggcatattagtaaatgtttgttattgtcagtcagtcattgatcttttaaactggcttctttaatggttgttcaaaaatcaaactacagttagtgcctttaggggtcagcattttttttctttttttttctgagagggagcctcactctgttgcccaggctggttggatcactgcaacctctgcctcccgggttcaagcagttctcctgcctcagcctcccatgtagctgggattacaggtgcgcgccaccacgcccggctaatttttgtatttttagtagagacggggtttcaccatgttggtcaggctggtctccaactcctgacctcgtgatctgtctgcctttgcctcccaaagtgctgggattataggcgtgagccaccgcgctgggcggggttagcattcttattcaagagctccttaaaatgataaatcaaactgacaaatgatttttcccaaatatgaataatgatccctgttaggcaaataaggatgttaatttattttaccatctcataagaataatacctggaaatggaatagatttattgctttttctgattgttaaggttaaaaaaccgaggcccatctaaaatatatataaagtaaaaatcatccaaatttctagcattcagggataaccacatattgtttgtactttaaaaatataatgtacctgtggggacaatcagctagggggggtctggataagtggtatatttgggagacatgtgtaaaattgtactagaacttacaaataggtaagtagcacaatctggtttcctcactgtagaattttttatcttagtccccttttagatataatatgtcaagagaattctaaagtgatgatgataaatgataacatttattgaagacctaatatgtgtcagacactgggctaagcatgtacatgcatttttccatcgaatcatcatgtaactcattaagtgggtgcaattatctctattttgcagagactaaagtttatgtgtaagtcacttttagaagatttaagtctaattgtgtttaaagtcttatttaagaaaaaatctttcatgaaagcttcttgatttgctaaaatgggagaaaacaaaatcaactaacatacagtagttcctatgcctgaacagagagcccgattgtaaaaaacggtcttttgaaaactaagaattttatatttgaccacaagggggtgcaaattcctgagttaaatttcaaaggaaaaacgggaaaagtgcttttactttagaccatcaaattcgtgggttaaaactagtaagaattcctgcctggaactttaataccctacaaagtaatgtactttataagaagaaagaactcaattacttaggtgctcaattagggcagaagtgtcagcttgctttcttcaatacagtcaagagttaatcatccctcccccacccctttccactcacagttagtttgtgtctctgcatacccctctttacttgtcaataagagtagaactgaagtcataatttaaaatctggggttttgctcttggaaactgaaatgcaatcaccagctaatggatgctaaatatgggtagtgtgaagaacagaggtcttgtaatttctatgctttttttccctcctgctgaagtttataatgagtaagctacaactgatgcaatgttggcttcaacatattaacttatttagataaaactgtgaaagctataggtctgttcatctttcaagaaagaatgcaggccgggcgcggtggctcacgcctgtaatcccagcactttgggaggccgaggcaggcggatcacgaggtcaggagatcgagaccatcctggctaacatggtgaaaccccgtctctactaaaaatacaaaaaaattagctgagcgtggtggcaggcgcctgtagtcccagctactcgggaggctgaggcaggagaatggcatgaacctgggaggcggagcttgcagtgagccgagatcgcgccactgcactccagcctgggccactgagcaagactctgtctcgagaaaaaaaaaagaaagaaagaatgcagacagtaccttgaaaacagtatatactactgaatgtattaaaaactttgcttagcagggttttcaacttccttttattttcgtgttggtcttgtttctctgagatgggacttaatttaaaaaatacaactttttttggaaataatttcaaatttacaaaaagttacaatattaaaaagagttcaaagaacatctatatcatttgcttgctcttgtacatgggtgagttttctttttctctctctctccatatacacagtctataaaaaacacacagaggaaaaatacaagaaaaaaactttcaacccatatcaaggttttatgattatagttaaaaatatacatatcaaaaagtcaaactaaaattttgcagtgttgacactgccaaactattcttttaaggaacattggtgttctatcagctagtccagtgatttttgtttttttaagagacagggtctctctatattgcccaggctggcttcaaactcctggactcaagtgatcgtccattcagccttacaagtagcagggactgtaggcaagtgccactgcacccagctcagtgattcttaaactttgaaaatgtgttgaaagttatagaccctttctctagaatcatgcatgtatgtgaatagtttgcatatagtttcagaggtggatgatggtccatggagttcctgaagaaaagtaaaggaaaaattattcatacatatggtaggcagaataatggcctaccaaagatgtccaaagatgtacatgtcctaatctctctgggatttgtgaatatgttatgttacacggtgagagataattcaagttgcagataaaaattagggttgctactcagatgatctgaaaatagattattctggatcacctgaggaggcctaattacatggtcctttaagtgtgtaaaggggaagcagaagaatccgtgtcaatgatgagatgtgagaaagccattgctgactctgaaggtggaaggaggccatgagccaaagaatagttcatgagctctagaagctgaaaaaggcaagaaaacagactctttaggaatgcagccatgccgacatctctattttagcccgctaagacccattttgaatttctgacctccagaactgtaagataatacatttctgttgttttaagccactaagtttatggtaatttgtttaaggtaattttaaggcattaggaaactaataaaggatgtgaacagtcattttgtatgtgtgttgatgtgtggttatggtagtaattaagtgtgtgtgtgtgtgtgtgtgtatacattttttaataccacctaggtatttttctttttttcttttttttttttttttggagttggggtctctgtctcctaggctggagttcagtggagtgatctcggctcactttaacctctgtcttctgggctcaagtgatcctcccacctcagcctcccgagtagctgggaccacaggtgcccgccaccacacccacctaattttttgtattttttggtagaggtggggtttcgtcatgttgcctgagctgttctgtaattttttgcttaacaaatccataaaaagtacttctttatcttttttaaaggtctgtgaagtgtcagacctcaagatggacaactatttaattagatatagcatcttatctactactgaaattatattcctacacaatttactgaaatttcttggtaagaatgtgatgagcttttcccaaaaatttacccatctacattccctttataaaacgcaaccttttgatttacagttatgttgacaatatctttgttctgtcaagtatcttggataatttcttctccctgtagctaattgacagattaaaaacaattagaaaattctcctcagaggttatttaaacagtatataattatatgctttacttaggtatcagcttaagagaataaactgtttagaaacagatttattttgcagttggtagattattttaatggaagatcaatacaggtacttaattatctataaatgttttgtgagcaagaaactttttgtgatttttttttttaaaggataccaatattagttacatgggggaaaatttatacacacatcaggaaatgtacttgttttaggaaatttacatggtttagagctccaatttctagaagtggttagaacagattcatatatagcattttcaactttgattctctgaatatactgagttaagattttttttcctatatgaggagttattttgcttacagtatccttgaccacaaatcatggaactaaactaaaattcatttacgactaataatggtcaacatttattgaggaagtatgaccttttttattttgttgttgagacagagtctcactctgttctccaggctggagtacagtggtgtgatctcggctcactgcaacctctgcctcccgggttcaagcagttctcctgctgcagcctcccaagtagctggtacaacacgtaccaccaggcatctaatttttgtatttttagtagagatggggttttgccatgttggccaggctggttttgaactcctggcctcaggtgatccgcctgccttggcttcccaaagtggcgtgagccactgcacctggctgggaagtatggatttttttttttcacgtaccaataatgattcctggaaagggataaacccatttgtttttgttaatcttctttctaaaattaatgttaaaatgttggccttaaatgagatattaaatatggtgttttgaaacactgcttttgaaataatatatactttgtgagagcttaataaaggaaatttagcctattcaggattggaatcatagaatcttaagagttaaaatatgtctcttcttactgccacccattgtctaagtgtcccctgaggctactgagaacaaatttattctcacctacctacagtaaccctttaaatatgatcattatttttttgaatcatgatgacagcagaattcccactcccaaacatcctttaatggcttctttaatgtgtctttaattgttttatgctcttaaacccttcaccatcttggtttccttcttctggttattcttgtttaacaaggcccctctcaaacagtgacacccagaatggtattaattacatatatatactatatatagtctgaaatataccatgggtgggtattaactttttgtcctatccattacaatttttgtattttaagaacaattttaggtcgtaacagggactcataaataatggaaatggatgtattggaaatgtatcaaaagaaagttttaaaagttttaacataaactacaggagtaaaaaacttaaaaattacaacttatgactttctcagagactttattgagttgggatgaactggaagttgtggaggatagggaaccaggaatctattacattcatgtcttatttatttttaataaactggagtaaaattgagactggtctgtaggagatatgactgcggatgtgtgatcagttgtctaagacagttgagcctcatactacatttctattcttaatatgtaaaatgtatttcttatagtacaaatcccttttggctaggaaattcttatatgtttaaaataaattaaccttttaaggcagctctgaagaagtaatttattttaaataggtgagcagtttatagctcttatgggaatactttttccttattttttcatcataggattagaccctgtgtttttaatttaagtcctttaatttttgctgttaatgtttaatttacttgatgaccccgtactgttaacttttgaccaagtgaacttgggacagtatatacaaactgtttacctaattttaaggaaactcttttaaaaataagataggtttgatgtgaaacagaacattaaattcatttcaactttccatgtagaaaaatatcatatgtatttaatcaaataacttttccccccttattggaggatgtatttttatcagcatggaggttttttgttttttaataattagatgtttatgccattggcaaaacaacccaaagctgaccatgaccaaactgcaatacttttaataaactaaaagactactaatatagtagatataaaaccctttcctgataagaaatttttatagcgtatgactgaatctaacaattctccctctacctttatttatgctcgtttactttcttttatagaaaattgaaattcctaaagtttaagtttttagatgtaaaaaatgttagtatatacagttaaattaagttcaaggtttcttttaaaccacttgatgtaatttactttgtatatagcttttatttgcctttttaaaattattattacaatttttttagacagagaattgctgtatcatgcaggctggagtgcaggggcgtgatctcaggtcactgcaacctctgcctccccggttcaagcaattctcgttcctcagcttcccaagtagctggaattataggcgcaagccaccatgcccagctaatttttttttttttttttttttgtatttttagtacagacagggtttctgcatgttggccaggctggtctcaaactcctgatctcaagtgatcctcctgcctcagcctcccaaactgctgggattataggcatgagccactgcacccagcttatttgcccttcaaactagacctgtggacttgcttttgaacattttctcccctaattatagaatacatgtgcattaaagaaaacagaaaaaaatcaggaatgattggaaggcattgcttctgaaggcctcttaacaatatacctctctcctcatctcctttcccagttgaccaaagaaggctccgtgtttgtcttttatgtatattagcatgattgaacttcatccatttagccttattgaatactgtactttgtttctcttcaggaaaattacagtttgatatcttgtgggacagaaggtttcatctttcagtcatcagagagcaaagtaggaaagacttagagaggcaaagtccctctgcacctaaggatacactatttttactctaagggggccatgagggtttatttactttcatcattttggggtgaggaatggttagaaactgagggagcataaataggttaagtattatccatgacagtagggtgggagttaatggaagctcatttatagcagttctacttcctgatttatgggtatgtgtggtgcattttaaagagattctggtgaactaacaaggtgtaataattgtattttgttatatatcatattattgactgccggactgcttaacatgcagcttaataattattatggatatctttaaatatgccacattcactttattcagaagtgaactgataagcaacaagctgccatgtgctgaacagtattaggtactgggataaacaagggttttaaatgctgagaatagtgtaagctatatatgtttctgtatagccttcatggtttgctaataaggtaatctgttgtcatttcataattgaaatactagggggaatgttgtaaaaatgctctttattattgttatttaaatggaagtattttgtgtggttttatagtcatggtgggaaatcatgagtttttggactagggtagtgatggttgggatagaagatgagggaaaaatctgtaatgcctccctggtccctggcctggttgtagagtacaatggtggtatcattaaccaggacagggacaagtggaggaggctcatggcttttgagagagagagagagagagagagagtgtgtgtgtgtgtgtgtgtgtgtgtgtgtgtgtgtgtgtgtgtatgtttatgggtgtgagatggaacgctgggacatgagagggagatgacaagtccagtgaggacattttgaatatgaaagattaagcactcatgggatacctaagtagggaagttcagtaaggagctcaatatatacgactgaggcttaggagaaaggcctgggctggaaatggatatcactaaataggtggtagttcagattatgagggaaatggatgccattgctcatagagactaaacatagaggaaatgagaaccaaaattagtaaatgggcaaagtaagaggaagcagcaaaagactgagaaggaatggctgagagaggggcaggaacaccaacagagctcagagttaaaggagccagtggtagagaggtttcaaaaggaaagaagtcaggagtgtcagaaggtaaagacaggccaagtaaactgaaaaagataaaaggatttggcagttctgtcattagtaatgtttgccagaacactttcaatgaaacaatggtggcagaattctgtttgtgttgagttgaaaagtatattaaaatagggaaaggggctgggtgcagtggctcttgcctgtaatcccagcactttgggaggcccaagcaggcagatcacctgaggtcgggagtttgaaaccagtctgaccaacatgaagaaaccctgtctctactaaaaatacaaaattagctgggcatggtgacacatgcctgtaatcccagctactcaggaggctgaggcaggagaattgcttgaacctgggaggcagaggttgtggtgagccgagattgcggcattgcactccagcctgggcaacaaaagcgaagccccgtctcaaaaaaaaaaaaaaaaaaaaaagagaatggttacaataaatgtgtattatttcaaggctcttgacattttcttaaaaacaaaagatgataattttagggaggaggttacagaatagagtaggagatctacaagagaagagaacttaacatttttataaagtatggggacagagtcatcagagaggagaaattagaaaggtatagtgagatctagtaggagataagggtgcaggtaaaggaattaacccagaaaagagaaaggataccttttcctctgagactagaagggaacaggtaagatggttttatgtataacttgtaaatctagagcaggaagttgagggaattcatagctaatagttttagtttttattttttttctgataaaggagtcataaaagaggtaagggtagagctgaagtagcaagtttgagttgaagtaagatggtacaaaatatatgctctaggtaatgggagagggaattaatgagggaggaaggttgttagcagaagagggtgatgtacctgagaacctaggctggataggaaaagacacaaagcatgtgggagattgtagtttgaagaaatgagattgtagtttgaagaaatgaggaatgggtatcaaaattaggtaagaaagcaggtatttagggagtaatggagtaaaaaaactgcaaggataagtagttgtagtcagagatcaatatattggactcttaaggctgtagaataatttcttggttatcagaagatagagggtgtagctttgggtatggattactgaatgaagtggttttatggagtcagagttcatagtttttcaatgggttttccatatggacactgaagtgggaggtgatggcagaaaatgcaggggaggcagatactgtcagcaaagggccagagtcctcaacaaaatggaatgactgggtaattaataagaatgaaagaaaggagtaaaaaattcccaagattgttcatcatgccttttttttttcctcgtaaattaagagacatgagggtaaggactatgtctgaattaatccaacaaatgcaaatatttgttgaattaataagtgaatgataaactcatgttgaataagtatttcagaaaacttgtttttttcttattataagtagtcgatattaaagaaaatacaaataagcaggatgtaggaaaaaataatcccatcagccagaaatacctacccccaacaccctttgttattaaactttttgcttaaatctgtttgttgttcatatatttttttcctagcaatattcagttgtacactttaacatctaaataagtattttcttatggaatataaggatgtactataatttaagcagttccttattttggggcatttatattgattccacccaagtttcttcaactggtaaaacgaaaaacctaatagctattttttttttttagacagtttcgttcttgtcgcccaggctggagtgcaatggcacaatcttggctcactgcaacctctgcctcccaggttcaagcaattctgctgcctcagcctcctgagtagctgggactacaggcgtatgccaccatgcccggctaatttttgtatttttagtagagacaggatttcaccatgttggacaggctggtcttgaacttctgactttgggtgatctgcccgcctcggcctcccaaagtgtggggattacaggcgtgtgccaccacgcccggataatttttgtatttttagtagagatggggtttcaccatgttggccaggctggtcttgaacttctgacctcaggtgatctgcccgcctcagcctcccaaagtgttgggattacaggtgtgtgccaccacgcccagcataatagctaaatttttgccttacttattttcttaggattcttagaagtagattttctaggaggggcttcatagagatcctatttatctttattttagggccatttctaacaggcttgtttatgtgcattccatccaggattggaatcctggacaatggacagtgttgcaggtattgactgatgcaggcatgctgacagccacaaaagtgagaactgttagtcacaggtccttcttcacaaaaagaatgatgggtatttttaaaacttggaatcaagtatagttttcatgagcacagtaagagatgattcatgagctgaatacaggatatagtagtcaattcagaaatgcatattcaaattaaataaaaaactcttacaatagtctatatttgttgataatactgaactttagtagaggtttttttccataaattttaaaactgtggcaaaatactcatgaagtttatcaacttaaccatttttaagtgtacagttcagtggtattaaatacatccattatgttgtaaccatcaccaccattcatctttgtaactagtagaggtattaatataccaatcttgaatagtcatcaaagtcactctacctcaaacttttccacaaaagtatggttagtagcagagaggagtgaacaattgccttaaaaacttggtcccaagctagaattctttttagcttcatgttttgtcttaaatttaatgtaaatgtagtgttacataccataatgttcctatatttagtaaaatacaatgattatacattttttcaaaatctctgagggaggttgatccccttaactttggcaattttgagacgaagtcttgctctgtcacccaggctggagtgcagtggcatgatctcagctcactgcaacctctgcctcccgggttcaagcgattctcatgcctcagcctcccgaatagctgggattacaggcatgtgccaccatgcctggctaatttttgtattttattagagatggggttttgccatgttggccaggctgatcttgaactcctgacctcgggtgatgcgcctgcctcggcctcccaaagtgctgggattacaggcgtgaaccaccatacccggccttcatttttcttttacggtttagccaaggctatttatagtagtgtatgtcaaggagtagactgattgatgttcaccctcttcaaatgtgagtgtcacagaaactgaaattcacagagtaaaaatttagaagtatccttttatattatatttgctctagtaatcaagcatacttcatcattattaatgctatgagacaatcttattgtacaaataaagagaatgatttcatgtgctggctagggccatagccccacctttccaaagagtatcaacttttcaactatccatgcattatgactccagagacttgtaaaccctctcaggtgtaataaattttttttttttttttgagaggagtctcgctctgttgtaaggctggagtgcagtggcgctatctcggctcactgcaacctgcgcctcctgggttcaagtgattctcctgcctcagcctcccgagtagctgggactacaggtgcgtgccaccacgcccagctaattttgtgtttttagtagagatggggtttcaccgtgttggccaggctggtctcgatctcttgacctcatgatccacctgcctcggcttcccaaaatgctgggattacaggtgtgagccactgtggcccggcccagctgtaataattttgttcttcatgcctgatcccatttcaggagattggttattacattgaaggacagtagcaaaattggaactaaagtctgagtctcttaactcctagttgagggtctttccaattacaccaaaaggaaaagagttacatataacaagagataagacttactcctacctgcccccacaaaaccactttaagccatcctaagaacggtctcttttttctccctccctctctccttcccttcacctttcctttcttcttcttcttaccttttttgggggtaactcccaaccaccccagttctcagaattaaaaggttaagaatattttagtactcttcaagatacaaagtagactattagagttttttgttgttgtttctcaagcttgggacataaagctcagagatcagaacaacagaattttagaaaggaatagataggatacatgaaaaaggctgctggaatatgaaaaaactggagtaaaaataagcaaatcaatacttctgaaatgaagccttcattggtagaaaagagtgtaggtcacaaaaatgaattagcagaagttcttgatttctaattattgaagattcctatctagtggtattctaatatgcttaccaaattatgagttgcattactttttaaaaacctaaaaccaagtcaagatttacagagtgaccccagtttattttgtttggtaagttttcagttccagttattaggcaaaacaaaaattgctaatacgtaacaatgctgaaacaggcgattggtagaataaaacaaaagggattcatacagcttttgtactgtcttcttgaaaaagtcatatttggccataaaagctaatacatgctttaggaatggaaatgatttaacctgattttttcaagtaagatttgttcaagaataatgggcttatgttgtcagttgtgggttcaagcagtaattcactttggactgcttctattcaacagtatgctgtctgtacgtaaagagttacatggaatttaattttagcattggaatctatttgagataccattatcttttatattcaaatgaaaaattatgggcctctagaattaagtgttactaacctgatatagatagaataatagctgtatcaaaaggaaaaaagcaaggataatatgtgtatagggtttgaatcatacagtctcactagagatgtgttttttaaaattgtgaatgtttgttgattcattcaaaaccgtttgaaaattgtgagggagccagaaaaggggagaatatttggatgtataatttagatgtatagtttgcttgcttatcagggaatagttaagttccttttttttctgtatattttagttggtgaaattaacagtttttgttcttttagattaccctgtaaaagaacatggcattttatagatgagataattgaggcttatacatgttgagttataatgtgtggaggagtctgatgtgcatccaagtctgtctgcccctaatgtctctgtttttaaccattatcctcagaatgaaatacattcatatagtagagaccaattcttaaacagaagtcatctttactcacaaaattaatctgtgaagtacccactgttctcagtttctctccctctcactttttctttctagtgctttgcagtttttaatgaaagtgaatatttttttcagaaattattattttcatgttttttattagaggattaaatttgttgctaagatcatttagtaagtcttttgcagtcttttaagattagacttaagtgtaaacttaaagattgccttgaagtatattatttagctatattgcattattattccttatgtaatgagctatagactgagcactccttgacaaatcacaagaataagacccaaagaatcaaactttcccaagtaacttaactgcatcccaggacaaaactcaggaacatttagaggaacagaagactatccagcagccaacagataaaattcacaatgccttgccaggcacacaaagaagccagaaaaaataatccacaatgatgaaaacaatcaatcatctgaaagtgaccttaagcagagaaagatgttagaactagtaaagacattgaacattattatagctatattctatattttcagaaagtagagacatgaaagacatttttaaaaactcaatgcagttctagggatgaaaactacaatatctgagatctactaatggtatttgtagcagattagacatggcagaagaaaaggttagtgaacttgaaggatatagcaaaagaaactactcaaaaatgaaagagaaaaaagaatgacaaaagcatcagtgagctatgggacaaacttacagaatccttatgtaaacataatcagaggcatcaaaggagaggagaggcagatacaaaagggatatttgaaaaagtaatggccagaattttcaaattggacaaaaactattaactcacagatccaagaagctcaacaagaagaaaactacaccaaggaatgtcataatcaaattattcaaagccaattataaaaaatatggaaaacagccacatgttatagagtaacaaagataaggttgacagcagatttctcattagaaacattgcaagtgaagagacagtagaacataaagtactgaaagaaaaaaatgttaacctcagcaaaatatcattcaaaaaacaaaggcaaaataaagatgttttcagacatacgaaaacaactctttaccatcaggtagactgaaggtagactgtggtagggtgaagatgtatactgccctagggcaaccagtagaataacaaaacagttatagctaataagtcaacaaaggagataagatagaatcacaaaaaaatactcaacccaaaagaaggtggaaaaaggaacaaataagtagtgaaactaatagaaaaatggcaaggcaatagactgtaatcatatcagcaatcacattaaatgcatattatctaaatatcccacttaaaaggcaaagattgtcagataaaaagcaagactgcttttggacctggatgaacaggaggcaccatcacggaagttgactcctgccacaacaatgactgaaaggttcaacaccaggaacccaagagccaggacatctactgaaggctgttggttaagctgtatatgtttctggccagaagaaactctaccttcaaccaagttgtggtgaagaggttatttatgagttgcaccaaatggccatctctgtctctttcctggatgatctggaagatgaagcttcctggccaggaaaacaaaacagctgtggttgtggggaccatgttcaggaggtgcccaaactgaaggtgtgtgcactgcacatgagcagttgggcctgcagccaaatccccaaggctggggacaagattctcacctttgaccagctgaccctggacaccctcaaaggctgtggcaccatcctgctctctgggcctcacaagggccaagaagtgtactggcatttcagcaaggccctgggaacccagcatagccacactaagccctgtgtccactccagggaccagaaattcaagcacatcagaggctgatgggccagccaaggctacaaaaactaaccctggatcctctatcttattaaaaagattttggcctgggcgcagtggctcatccctgtaatcccagcactttgggaggccaaggagggcagatcacttgagcctaggagttcaagaccagcctgggcaacaagtgaaactccatctctataaaaaattaaaaaaaaaaattagttgggtgtggtggtacatgcctgtagtcccagctacttgggaggctgaggcaagaggatcgcttgagcccaggaagtcaaggctccagtgagccatgatcgtgccactgcactccaccctgggcgacagagtgagaccctgtcttagaacaaaacaaaacgaaacaaaaaattttggatggtgggggaaaggaaaataaaaaacaagatccaactatatactctcaataaaaaaacacattttaggctgggtgtgatggctcccagcactttgggaggtcaaggcaggtagatcaccggaagtcaggagttcaagaccagcctggccaacatggcgaaatctcgtccctactaaaaatacaaaaattagccaggcatggtgatgggtgcctgtaatcccagctacttgggaggctgaggcagaagaattggacgaatgcaggaggcagaggttgcagtgagcagagatcatgccactgcactccagcctgggagacaaaacgagattccgtctcaaaaaaaaaaaaaaaaaaaagaaaaagaaacacattttacacacaaagacataataacattaagaataaaaggatgaccaggcacagtggctcatgcctgtaatcccagcactttgggaggttgaggcaagaggatcacttgagcccatgagtctgagaccagcctgggcaatatggtgagatcctgtctccacaaaaaattagccaagtgtggtggtgcacacctgtagtcccagctacttgggaggctgaggtgggaggatagcttgaacccaggaagtcaaggctatagggagtggtgatcacgccactgtactccagcctggagtgactcaaagtacagtcactttgagacagagtgagactctgtctcaaaaaaaaaaaaaaaaaaaaaaaaaggtaaaaggatggaaaaagatatatcatactgatgctggcattagtcaaaagaaaactggtgtggctatattaacatgaaataaagtagatttcagagcaaataatattaccaggaataaagaaggccattttataataataaaagggctggttaatcagaaggatacaataatcctacatggttttgtctcaaataataaaagcttcaaaatatgtaaatcaaaaactgacagaagtgcaaggaaaaacagacaaatccatagttagagatttcaatacccctctttaaatgattgctaaaacaagtagaaacttacaaggatatagtaaactcaagcaacactgtaaccaaattaacagtacaggttgagcatccctaatctgaaatacaaaatgctccaaaatccaaaattttttgagcaccaacatgacccaatacgttgggtcctattcccaggatctcttattatatatatatatataaatgttcagaaaatccaaaaaactttgaaatctgaaacacttctggtcccaagcattttggataagggatactcaacctgtaatagaatatatattctcttcaaagtatacatgaaacatttacccaaatcgatcatattctaggccagaggttatcaaactatggccctgaggccaaatgtagtctgtttttgtatagtccatgaactaaaaatggtttttacattttgaaagatttctttaagaagaaaagaaaatatgtgacaaagatcatatgtggcccacagagtttaaaatatttactgtctgaccctttagagaagtttgcctgcccctgttctaggccataaaacatgtctcagtaaattttaaaggattcagataatgcagagtatgtcttctgactacagtagaattaaaattagaaatcaataacagaaagctgtctggaaaatccccaaatgtttggaaacaaaataacatgctactaaataaccttctaataacccattgattaaaataggagtgcagtaaaattagaaggcattttgagctgaatgaaaatgaaaacaaagcatatcaaattttgtggcatgccactaaagcagtatgtaggaagacataagcaaaatgcttatattagaaaatataaaaagtctcaagttaatgagcttccaccttaagaaattagaaaagaagaacaaattaaacacaaagaaacaaaagaaataataaagatcaaagtagaaataaatgaaatggaaaacaaaataaattgagagtattaatgaaaccaaaccctggttctttgagataaataaaattgataaatcttttgccacgctgatcaggaaaaaaaaaaaaaaaagagagaagacacatattaccaatatcaggaatgagaggtgaaatatgacaaattctacagatacttaaagaatagcaagggaatattatgaaaaaccttaagcaaataaaattcaacaacttagatgaaatggtcaaattccttgaaagacataactaccaaagcttactcaaaaagaagtacagccaggtgcagtggctcacacctgtaatcccagcattttgggagtttgaggtgggcagatcacttaagtccaggagttcgagaccagcctgggcaatgtgaagaaaccccatctctactaaaaatacaaaaaaatttagctgggtgtggtggtgcatgactgtagtcccagctacttggggggctaaggcgggaggatcgcttgagcttgcgagattgagccctgattatgccactgcattccagcctgggtgaaagagtgagaccctgtctcaaaaaaaaaaaaaaaaagaaaaaaaagaaaaaaaaaagaaaaaaaagaaaaaaaaaagaaaaagaaatagataacttccaaagctatgtatctatttttaaaaaattaatagttaaaaatattctcacaaagaaacactagtggattcttccagacacttagggataacactgtgtataccaattatatacaaatcttccagaaaactgaagaggaaggaatacgtctcagtttatttttgggggccagcattaccctgatacctaaaccacacaaagccattacaagaaaagaaaactatagcccagtttccctcttgaacatggatgtaataattctcaacgaaactttaacaagtcaaatccaacaaaatataagaaagttaatattactggatgaggtttatcccaaaaatatgtcattgctttaaattaaaaaattaatcattgtaagtcactatattaagctaaaaaagaaaatctgatcatttcaatagacacccaaaaaatctgacaaaatcgtatatttgttcctgattttaaaaaaccaaaaacaaaaaaaacaaaaaaaacaaaaaaaaaaccaaacctgttagcaaactaggaatagaagggtactttctcaaccagataaaggacatctataaaaatcctacagatagccttatgcataatgatgaaaaactgcatgctttccctttccccgtaagataaagaataatacaaagatatctgctctgaccactttcattcaacatcagaggttctgtccagggcaatcaggcaagaaaaagaaataaatcgcattcaagttagaaaggaagaaatacaactgatgatagccatcattcctaagagttccccttgcctctttataatccttgcctcctcttacctctctccccaggaaaccactggcctgttttctgtcactagagaccagtttgcattttctagaactgatatatgtggaatcatgcagtatgttactcaattttttttgtcagtaattggtagcttatcttgcaatcaaagttcatatacaaccatttgatcttcattccattccctcattagtccatagaatgtcaatcaatttttctttcttttatttatttattttaacgaaacagggtcttgttgtgttgcctaggctggagtgcaggcttacttcaacctccaactcctgggctcaggtgatcctcccgcctaagcctccagagtagctgggactacaagggtgtgtcaccatgcctggctaactttttaaaattttttgtattgatggggtcttgccatgttgcccaggctggtctcgaactcctgagctcaagacctcccaaagtgctgggattacaggcatgagccactgcgcctggactcaatttctgtatgatgatgactttcatatgtacatcaacaggccagatagcttatcaagaaagcttctcctctgtcttctagtaatatcccacttagatctgacattatttttttccttcaaggtatttcttccaaatttcttggctgttgttggtgacaacacaagtttttggacctttaagtttacaatcttaggttcatttccttattttatttcttccctataggtaaatgatcactaaacttgttacttcttatagttacttctttgtaaggcactgcagatatgtttcttttcatttttaaaattgcccatttaattcaagctattaaatatcaagcttgtactatatcaagagtactatatatcaagactatagcctcttgatattttccctaccctcccatcctgccatacccatgtctccactagcctatataaaacataaaatacttttcatcaaactctctgtagagaagtgttgctgggcgaataagaaaaacctgattgactagaaagcaaatgtaaatgtaatctcctttcttttcagtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaa

SEQ ID NO: 1029 - DNA, 1598 bp, Homo sapiens
gtcacgccgagccagcgcctgggcctggaaccgggccgcagccccccggcttcgcccaccatctccctaccatggacccccgcaaagtgaacgagcttcgggcctttgtgaaaatgtgtaagaaggatccaagcattctgcacacccaggaaatgcgcttcctgagggagtgggtggagagcatgggaggtactgctactcagaaagctaaatcagaagaaaataccaaggaagaaaaacctgatagtaaggtggaggaagacttaaaggcagacgaaccatcaagtgaggaaagtgatctagaaattgataaagaaggtgtgattgaaccagacactgatgctcctcaagaaatgggagatgaaaatgcggagataacagaggaggtgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgcagccatccgagactgtgacagagccattgaaataaatcctgattcagctcagccttacaagaggcgggggaaagcacacagacttctaggccactgggaagaagcagcccatgatcttgcccttgcctgtaaattcgattatgatgaagatgctagtgcaatgctgaaagaagttcaacctagggcacagaaaattgcagaacatcagagaaagtatgagcgaaaacgtgaagagtgagagatcaaagaaagaatagaacgagttaagaaggctcgaaaagagcatgagagagcccagagggaggaagaagccagatgacagtcaggagctcagtatggctcttttccaggtggctttcctgggggaatgcctggtaattttcctggaggaatggctggaatgggagggggcatacctggaatggccggaatgcctggactcaatgaaattcttagtgatccagaggttcttgcagccatgcaggatccagaagttatggtggccttccaggatgtggctcagaacccagcaaatatgtcaaagtaccagagcaacccaaaggttatgaatctcatcagtaaattgtcagccaaatttggaggtcaagcataacgcccttctgataaataaagcccttgctgaaggaaaagcaacctagatcacattatggatgtcgcaataatacaaaccaatgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggtctgttaattcttatatttttctttactaatcattttggatttttttctttgaattattgggcagggaagatacttatgtgtggaagattattgctctaatttgagtgaaataaaagttattagtgcgaggcaaacataactcatttgaggataa

SEQ ID NO: 1030 - DNA, 245922 bp, Homo sapiens
tcaagataaatatattttaatacaatatttataaaaattaaattactgcaaaaactccacaacatcaacattttacataaagatggtatctgagaaggtcaagatgaaggtgaaaagagtaaaggagttgtactaggacaggcctcccattagacacatgctgtcttccaggggtcccaaattggatgggtgtttccagtggcatgctcttacagacagacctgttaatttccagtttaccttctcctacctgccatctgtaggctccttcttgagcaaactacagtgcgaggtgatctggggactattgtacatgaagccatgcagctttgtctgaaagatacctactcaagtaagttttaattttgcaactcttttggttaagctaattttttaaaattacaaaaaacactaagtattatgcaaatgtttacaaagcaatgactttcttaggaaattaaacacaacttttggcactttacatataagacaacattttgtggagaataaaggagtctataacaccgcttttatataactgagcaatcaaaatgtatgaatataaaatttaaaaaattgaatgagtccactctgtgaaaataaggctttaaaatcagttggaattaatgtaacctgaactttcattttaaatacatggcataaaatttaattttaaaatactcaattattataatgtgccctctaaggatggaagagaaatagtatcttttctaaagtgttcattataataattatgaaaggattttaaaaatacagaacactggaaaaaatgtatgagaaaagaaataaaagtcaccaaatgctatcatctaaagatagaatattaatatttaacaaactgtattctaccatttttctaataccatcatgttcaaagcagccttaatttagtttctaaaatagtaacagaatgtttgatacctggggctactttttaactgtgtgtttctaacattatacatttttccttatatttgaagtgtttaatagtgctcacattgctttctagcacctctggatgagccctgtgagaaagctctccaacacaggggagggaatgaggctctgacaagcacagcaagcacacacggcctggacacgctgccgaggagcctctgcttttaaccctccaggctttccaggtactttttcctgcaatatacaatggagccaatgtgaaactcaacagcaagtcaaagaatcaaggcttgcaaatgaaaatatgatattcctttgggggatatgccatatatatatatatatacacacatatatatgtgtatatatatgtgtgtatatatatacacacatatatatgtatgtatacacacacacacacacacacaaatacattcataaatatcaccaagatgattaccaaaaaagaaacacaagacaaaatttttaaataaattttttattacaatgacaggaagactccggatacaaacacatttgctaatataatcactccactggttacctaggcctagacgtacaaaaggacacccatatctcatcaggagaaagacaattttgagtttctgggtgtagtaccaagtggttatgatcaccacgtacgtggtctatccagttaactgtgtggcaatttgctatttcaagtcctctcataacagaaattactgaaatatgtggaacaccagtcaatataaagaattcatttttaaacagactagtgaatttgtgtcataaacacacttgcgtatggatattaggagagcattgcttgaatatctctaaaactatttttaggaattaaaagctttcatagttaatggtatgatattggccttcagaattcatattgataaaagcaaaccttagtcatttaacaggaatgtttaaattttagagattctaacatgcgatgccgaaaaatcctaacatttccacttagtaatgtcagggttgtgccagttctaatttcccatagctagtaacatcagaaaatatttatcagagattcaatattggtttcattagaactgataaatgctaagtatggcaactattaaaacctattgttattcttgtttctaaaagggaataataggatgtagctataaaaataatgaagcttatttttcataaacatatcataacctgagcgtccaaatagattttaacaattaaaaatgcctcatttgagaggacatacacttatttgatattgccatccttcaaaatgcttttgggagtccttataatgtccttgacaactggtatacaacaagcaagaaaatataatccatcgcctaacttgctaccttcctttattttgaaacttgtttgaagtggcttttgactgtttctaaaggagggggaatatatttatcaatcagttttcaaaggataataattttccatgattattcatattaatgctatgttagtttctaaacttcaactcaaatgtaatttcaagcagtaaaatcatattttaggaaacaaagaatgcacactttaatctactttaagggagtcacactcatttgacatctttatcctggtatgtttattcagatcatcattaattataagttccttaagggtgcagcccacgtcatttcaattacacagttctcttttctaatttccccatctcctgtctactgcatcccagcataagacctgaggctggtcccatgctcaaaaatgtttctttaattgaagtgacttgaacttctctgttagatacatacatagatatagctatatatcatatatttaatgctttatatccctttttcaattatatagttctcttttctaatttccccctctcctgtccactgcatcccaccataggacctgaggctgctcctatgctcagagatatgtttcttcaattgaagtgacttggacttccctattagatacatagatagatagatatagctatatatcacatatttaatactttatatccttttttctatggattaggcaatatttatatacataagatatgtagattaataattttgatgattttctgtaaatcgaggaactgtacaatataaatcatagtaaatagatcaccaaaggctttaatagaagagcactttatgtctattcctatttatgctgtttgatatatttcagttttagaattcctgctagtcaagcttctttctgggaaaagacctacaagagtttatacttaataaggatcaattgtgatatgctgtaagttgattccccttccctagttcacatctatatggccaacaagatcaaccttgagctaaagacattagcctcaatgtcattagaagttcaaattaactcaacagtacaaggttggtcactgttatactttgtatctcttatttgggctaattgataactaaatggaactgggtatttgttgacaacatttcatgcttagggatgagatttactgcagtaattgatccgaattaaagcatatccactaaaacaaaatatcctaaccagacaaatcaaagttggtaaaattttagattaaataccttgaagcagtattaaatttgtaagtaagtattgtgtactacattggttttaacattgtttattatataattcagggactaaaaggataggagaaaatttaaagcagtattaaatttgtgtctgtggactggcattccctgttggaaatattaacagaaaaagtaagaaacaggaatagagaatgatctaggcaatatttttctaaaattagatgaatatgaatattttcaatcagtatgtattgcattgtaatcagcatgtattaaaatcactttaatacatgttggctaaagtattagcaaatccactacagcctaataacttgaccaataacaacaatgcttttatacagtaataaacaaatggcatcttttggatttcttaatttgtccaaattcagctcctactgatgagattccatttaagacaccttgcaggggcagacctttgctatccatgaatgatgccttggctcacctaggaaaaaagcagatatcttgggttatatggtgaaatctaaaaagagaaaaaagagaaagaccaagaggaggggagggagagaggaaatgaagaatagatacagaaaggaagaagggagagaatgaggaaaaaaagaaagaaaggaagaaaggtattgcttataatttctacatgtcttttccatcctaaaataagacaagttaatataataaaaatatacttgtcttataaagtaggtaaatacactttaattgcacacattattaatagcttggggatttttttttaactgccaaggaagatggaagttttctataagaaaaatttagtttgaaattagtaaatttccataaatttcaaacagcttaattgttcttagaaaaatccacaactgcagttttagggtcaaaatttattagttgaaatactgtttgagttagagaatcaaacaagtatttatttctcagattacttggatgattgcctttgtaggctaaaaaaagccactcatttaaaatcaaattgactaccaaactaattggaacattgttccttaataactattttaaaacacatttatattaatgacatgtctatgaatagtaactttcactcctactggcaaaaactatggtttagttaaaccagtactgtatactaactgtgtgtgtgtgtgtattaatgtataattttgcattctttaaaaaatatgttgatgcttgaattttgcttttgggtaaattttaagaatgtcatattgttaaaaacaactcgaagaaagtgcttatatcttcctactggaattgctcttaattcttctagattttttttagcgctaaccataagaagtgtgttctcaatggccatgattgatcggctgctcacacattccacattttttctgcttcatgcatcatcatcagccatctccaacactccagtcctgaatctgtcctactttctgttacctgatttttgctggtgattcatgagccagaatagaaaaagaaaaaaaaaaaactccaccttggcttttcacagtatagtatcccctggaaactctgtgagaaatctagttttggtcatcagactcatgcaaatgtaatattgattgacaatgatgtatatagatctacatagataacctgccttataaaaaccacaaaaatgttctattaatggcagaatgcatactgattataaactacttcagaatgatgtggaaacacttacgtaaatgcattttgttggacttctaattctctcttgtcactattattttcagctgaagctactttggagtgcactgtttctagtgcactaaaaagaaaaattattaattttccaagccaatatggtgacaaaggcttaaggtttctcattaacactgtcataaaaattgtgaatgtcacactaaattttctatcatcgaatgagtttaaagatgaggagctagaaatccttaaaaaattattctgaagaatgaaaaacaagctttaatcactgtaaaagaaacagtaagaagttaaccagcaaaaggctccactgaactatttttgtgataacatctttcagattcagaagcaaccaggccttaaagagccaaagaaagaaagcctaatggccctaaaatctcaaaagagggagctgaaagttcatgatactgtctcagtgcttctattactagacatcaaagttattcccacaggtttcaggaaggtataaatgccagtgaaggagcaagtagacttcacagagtctaagccggaaacttcaatctgggattcacctgtgagtgaaaactctttgctaatgaattattccgaagacaagacactactcagagacacttttccctatcagacaagacctccaggttcactagcagggtcaaagtaataggaatgctctggtctaaaggtgctttgcctaccttaatggactccaggcactcacctgggtatacagcttgaacccataaagagatcacaatggcatgatgaataaggtagagtgctctagagaccaggtgaacaatcactccacaagccatctaaattgtgacctatatgcagactgcagcccatttacaaatgggtcatcctagtcaattcagtgctggagaaggagtgatgccaatataaaaataaacaatctacatactgagttcaagcccattgtattcagaggtaatacacgaagtggttatttctattttatataaattcaagcaacttggctttgttaatgacattttaaaactctatcaacatctaaatatcaacttcactttttccaaaaactttttctgtgcttcaatgtcccttttgctttctgcctatgaaaatacgttcgtattcacaatataaaaccagaagagtttaaagtaaaatgatgtttacaaggtttgcaaagaagagaatttatgtggaatgaacaatatacaaagcaatatacttgaactgtgtttgcatggaaaatactttttttcattttctatatgctgttcaaacaactgagctattcattaaaatgatgtaataattatattagtcatttagcattgcatagataaaaccatgtaagttcaatatccattaaagttagaagattgaccacattcagctttgtaactgggggattttgcaggtacataaaaatgttaaaaggaattttaaatgaatgaaaacattccagttgaaaatggtaagaatgtgcattcagaattaaatgcactcttttccatacagtgactaaggaatacactaatgcaattgtaagtttagctactgaagcacctcttctggttcgaggacattttcccaaatctcaccacctaaaaaccccaaatttgtttcttcttctgactgaggtagttaatattttccagagaaacaccactcacatgtggtaaatagaggtaactaaaccactagagtaatgcttatggttttggaacccctacattttgaaagacttgatattttgaagttaacgtttgggctttgaaaagtgaaaagtcatatttttatagttcaagaacatccctctctgccaccaaattcacacgagaaacataaaacttattttcctccatgttcaattttaagaattttgcccatcgaatactcatgcttcaaggaaacacactctctcatcaaaatctttcttactaaacaagcacctctgtcagaagtgtcttaatttcttatcacagaattttatccacacaaggagcaataaataattcatgtcactgcctctttgttgtgtgtccctgaactgcacagagctggaaggctgacagctgtgtcaggacaagcaccaaagatctgacatgacaagtgactaacaagtttctttcagttcacagtgaaagaagacaatggcccaaagtgcagaaagaaatcctaaaacaaaataaaactgcttctttctttttagctaagtgtttgctatgagcttatttccaacccacaagccctggtcattttataggactgcccagccccctttattcctcacactggcttggccatttactcctggccacggatcaatatgagcaattcttggagaaatacgatgtctccatgacaaccaagccacaaattctcagtggaaggcagtgagaccagtagtgaactctccagaggtttctaggcctataaggcaagatgtcttaaaatgcaggaagggacagaggaaaaagccagagtaattcattctttattaccagcataatgatgtccgatgtatagaacggtactcactttttgagttaagattctttatcagcacctatattttctaattaatctttctttcttgataaacacgtttgtgtgtatcaatcagatagagaatgttatatttgaatctcgctcccattccattcatattaagggatgatggaaatttattctacttttgaaatgatataaagctgatctattcttatcaaaaacaatggacatttaggtaaaaacctgattcacagatttacctgtctgacaaaatgagtaatagaaaactgtattaagacacttttaaaacctaataaaaatttggcaacattagtcaaaactaaaagtaatggataaataatttttattatagaaatttaacactaccatttatttaccctctcccttttagagtgagactcatctacatttttcttttggctattatggcaaggggtggggttaatttgctcattaaacatttctgtcactgctaaagatgccatttctcagttccatgggatctgaaagcagaagtgtggttgagaacaggcacagggcagcagtccatcttcagaggaatcttggtggagtgaagaggactgatatacaatgccatcgccactgcgcctattggggttccgagatgacttaggggacctgacatagattgcaggctgcacctttcactgaaaattaaatctcagtaactctccttggggaaggatcaggggactgtttgtttgcagctgccccctgtcaacaaaggctacaagatttggaaatctcttaactaagctgacaggccacagagaggatgaatcaaaaatatgatacatggatcagcacacaaagatgtgagagggtagagggtacacaggagccagataaaacaggaatcacaaatattaagtggaggagatatttaactctttcattcatgataataaggtaccttctagcaccttataactttgtatttatccaggaatgttcattcgacttttacaagattttttgattctaattaattagttaaggctaggcgtgtttcaaaatgaaacaaaaatagaaacagaaatccttgtataagtgtttctagctgtatccttctagtacatttctcttttatttctataaaggatatatacaaatatgtaactttgacaaagaaaagcttttattgcatgagagaagggttactattttctagactttattttccctaaacatttgacagtattcattaccatcatgctaaaatcctgtcatcccagttacagtcctgtttgtttctagaaaggtaaatagaattgtaatgatgacagtttctcttttcacccccgtctgtccacttccgctcccctcttgttagtttccattatttgaaatatttaaaatgttgccatttctctatagtttccaatctctggctctattaaccatttagcctaaaattgatgataatgaactaatagtgtcagcttcccttctcagtcataaagcctttgtacttcctccaactgaattcttgatgaaagaggaaaagataacagctccacactgtgacccctggaggtgaccattaatttgacagtgcagctgctaagagaaaacagcattacaatgtcctctcccctcacccccttccaaggaccccaaagctgtgtcaaatttatcattttatacttgactatttttaaatggctttcacctggactctcagactcttccaaggcacatctgtcaggcatgtcctccacgtcttggaagtttgccgagtttgagttgctgtcatgcttgaccgggctgactggagctattaaaagagagagagagagagagagagacagaagagagaggatgaaaaagtagtagcaaacaccattaaaacatttcctttcagttccacagatatttccagggacacactatgtaaacacaaataataaattgaaataaaatgtatcctctaagtatttattggcagacatgtaattagttgaaaaatctatagatgtgactttatcttagaagaaaaataagttcacggcatcagcttaaaagctacaaagtaacaaagtgatctcttcgaagtagaaatcgtatttttaatgcataaatctaaaacaatatagtcaattaacagcaatagaacacagagagaagaacatcaggctagtcaattagaaagaccagctctgtactggtggcaatgtttcctctcactgcactaatcacagctaatgaacattttgtgtgcattttggctctctttcattaaattaaaaactatggtaccaaacaccaaaaaaactagtactataaaaagtaaattttaaaatgtagcatgaatatacactgaaagttataataagaagggctattgtttcaaatggtaggtctccagacaacctatcatgagatattgtagaattatgaccagaaatggaaactagtacagaagtccaaaattttctataaacccatggtaccgactaattctgtttgagaaacagactgaagtttccactttttccacaagttgtaatacttgctctatgttgtctccaggaagtaacatatttccatattacatttgttctagaaaatatttgtcagaaaaagtgggccttgtcttcatgaagaagctcagtgaaaaagcaaaacaagcctgcaatagcataaattaggtcacaattaagccaaatgttctaaatatatggatactgttgagtacaatggaattttatttattacaagttgctgcaataaacacgactactgatttgataacacatgcaatgtatttataaaccataaatgcaataaacaaaatatatatttacaaatcacacataagatatgtttgttggcacaggggagtgggcctagacactgtttctaaacctctgttaccagacaagaaagcaatgcagaggctgagactgtgctacttcacacatttggtacgtgacacaacggtgtcccacccaaggtccagtcagcattagtagtgttcagacctggcacactcctccacttattttaatgaagtgtgcatagcactgatgtttgtaacctgaagaccacacggacaaactttagagaagactagtaacatgattctggtttaaatattccttctagattgtttcaccaactctctcaggacacagatatgacttctctgttctatcaaagtgccagcatagttagaatttactacgtttctaaaaccttttttgggaacaaaatataagaaaagcatgaaattgctattttcaataataaatctgatcttttcattttcatccatatgtttctgtggacttcacatgcaacagtgtctaggccatagaaggtattcttgaaggatctgtgaaatgaatgaatgaacacatgaatgatgcagaggtaccatgctaaatgtccttctgatccaagaggatatgtgctttcaattatcttttcaatggatctgttcaatttccttgttaggccaacttgagaccaaggatgcatgtttgcaaaatggtgatgtgggttagtttgtgacatggaaggagaggatgtgtggcctaagtagttattgatgcagctgagtttaattttcttaattttcttcagtttaggtcatacttacagattatttttgaatccatagattttttgtgaaatgtttaagtggtatagttaaatgtatcagtttcattcagaatactattatgttggtcaagatttcctggcctactttaatgatttttatctctatatatctttcttgataattttctgaaatatttatgttggtatttataaaaggaaataaatcatatagctaaatctattactaaaagccaatgaggtggcacctctattgatttgggcaaatgcattgcacttgccatccaacacactattctttcataatttaaaaaattcctccattcattcatttattcattccttcaaaaaatatttatcaagcaccaaataaatattcagaagatactgttctaaatcagggacctcacagaggaagaggacatggtattagacaaagtacatgtctgcaaccattctttgtggcaataaagtggtcccagaatgaactgacatcccaaacccttcaaaaaggccagaaagttagctgtagttttagctgcatgatcttcattaaactcacactagtaggtaccatgctacaactttgcttccacctctgattttggagggtgtgacttgtgtgggggaggggaaataaagatggttattcttcagatattgaacttggttacagattagtttccaaatttaaaatgatacaagatttgtcatttttactggatagttcctagggcatccaattaaatttactgtagaagaaatagctacattctgccagttgggaatagaaggcactggagaggttaattactgccattctactttttccttgtttgtttgataggctaatccttgcaattgttcttttgggtgtttcctgtgatgtttcatcactgaactctgacatgatgtgtgaccaaggcttctctaatgaatcacttcaataatgatgaatcaacaaatattgctctagtgtttattatgggtagagctctgtgctggactgtgaggggtaaagacatgaaggcacttttaatgtgccctcatacaacttgtgctctaattgaagtgtgatgaaaagtaactagtaggaacaccggagaagacattctaagagggacatggtttttagtagtgcagaggagaattcctctacaatagagtagtctgaaggtaaaatttgaattagacatccttgagtaggaatgtggaaaacccaaagggagctcattcaaggaaaaagaaaagggtgtgaacctaggcatgaccaaagatacacattagcctagtgccacagatatagttgttaaagctgctgcctactttggtatgtatttttaatgaattctctttacatgtctctttgagctttttctaaattgctgctgttagctaattcttctcacctgtgaaagttagctatagacaggtttttccttgctttagatagtcaataatttgatctttactcatggtgggcccatttatcacagtaagttgtccttttactatacatattgacttttatttatcaataccaaagtccatttgtagctcatcactaaagttcttggatattttcagtagtttttgaaggtgcatttcagagcttggcagagagatacttttgacatcaatataatgcaaatggttgctagacttatctttagcttaaaatcaactgtttatttcctctgtaatggattctgaaatagtccacatttgaaggtaaggggcaaaaaaggcaaactcttcttgacagttctgccactgaaagatgtaaggctattccatttactcatcacatgcctcaaaatattgacgactgaagggccagtgttctaaatatctttgcaatatctttggtagctagagaagagaggaatctatgaacttcgtatggatgtgtttcactatggtgcatttaactattagtgtaattcttctagatcctaaagaaatgaattgtttggccaaagagaagatgaaaccaatagtttttaaatcacattcaagaacactgtaagaggaaattcaggagatagtatgaggaagactctatagcaggatttgttgttaaaattagaaaagtggtagcagggccatcggtgataatactcctccacctgctctgttctctattttggtttcagtcattctctaaaaattccgttcttccttttctcctcacttgcagaaagatggtattagctgttaaagggggctaggcctaggcagcgaacaactccccccagaaacatttccacatccccagcaagagagtggccactggaaaaaagtctccatccacgtccacaaacagtggctggatcttccaagctaggcaactgctgttggacagatggagcccattgaaaaaaccctataatttacagtgtgaataaaatctgcagtcctaaataacattttcaatacaataacttatgaatgatttaaaaatagatctcattcgtcatctgtataggctttttggaagtaatgaggatatttataggaaaatcattaattaaaagatagagcagtttgaaatattgggcaactgaatagaataaaccactgcagtaccagaccaaagccaaacaaaaatcttaattacacattaatcaggggcacaaaaataatgtacaggatgcagaggtcaggaaagactaaaagatagctcaggcctgtgaaataagcagtgaaaaagaactcaaagatttgaattcaaagttactagctcaatatggtagccaagagttgaatgccatcctgctttataattcagatctctctccaattttaaagagtcactataaaataaactaaaagatagcattctagaagtatggaagtgagaaaagctacataaaattcaggtagaagaaaatattaatgcaatactggcagatctcaaaagactgcaagatattttaaatcagagggaggcataatctatgaaaagatgttaagtggtaacactaaatttgtaaacaaagatgatgtcatttgaacagactccaaattcagtttacaagtggcatctctctggacagatgtcttatcaggaaaacttatctggctaaagagctgtgtacacatcacccttactttaagagtatctattcagataatcaagtgctaggacttcctgattatatttgaatagcaatagttacatattgcattagactttaggcttactttgtcttcagtgtgaactggaaattggggaagaatcatgtagaaatgcccccaattaaattaggtatctaacgcttctttataactaataactattttacagacaagtttagcaagatgagttaaggttagacttatgtgttttgccatcttcctgcagttgtaatctaatatggaatattattttgtgggtagcattttctagaatgaatcgctttaaagaggatctatttttcaactaataaaaaatgaattttctgaaatgttgtgaagagtaactattatttttgtattattacctagatgtagagaatttaagttattatttcatttaaatacacacagagaggattaaattattgactatttaggcttaggggaaaaatctgtctatagcaaacttccacaggtgagaagtatggctagacccccagccaagtttggggaagataaatgagaaagaggtatcaattgcttacggaatctgtttaaacattgctgtattcctctcaaattgttctgttattcaggactttgagcaatgggctgcctcagtaaggctgataagcaagcagatactgcacttccagcctaatgcaaggcacaataaaaactttttaaaaatcaatgattaatttcacttgcagttttaagggaaaatctcaaggtctagttagggtttacagctcaagcttaatcaaaaatgtccaaaaacttcttattaatgccaaaaggaagtctgcataaagaaggaaaccctgtctgacttatttttggatggaaaataatattccacactgtttagcccatatatatatatatatatatttttttttttttttttaaaagaatataaaaaatttcattaaagaggtgaacttatgagttcccagagagggaatgtgttgtattgttaaaaacaaaaaacaaaacaaaacaaatccttaaacaggtttcaatcttacctctgctcctaatagtgtaaccttgggcatgccgtttcacttccctaaactcaggttctttcctttataaaatgagggagttgaagtacacagcctctttgataccttccagctttgagactcaaatattctgccagctaagaatccaagaccaaccaactactgagtatacaattgaacaggatactaagagggtaaatggccactacactagtgttggaactaatgaggacttctgaggccctttctgaattaaggaagattggcattttcctaaaagagaaagtgttccttcttggtttcagtttctcagcgataaggaggttctcaatgattgctgaacgaatagacaaggttatggagcagtatgtgttcctgtggactcatactctcctcaatccaaagggagaatcagtatactcccaactctttctattccttttatatgtaaggatggggtccatgaagtcattttgtcttactcaaaccaggcatgaaagccaactcaaatcaaattatctaaactctcagaatctgaaacagattataaggatataggatggaaggagtattacaaagagaaaacgtgtaggttgggaagtagaaaaggagagtaacagggaatggtacaactgcattccttcctcctgctacatttcctcgctcccaaccaggtaattctaagagttcccactgggaggtttgcctagatttctttatgttctcctttggaaaaccattttttgtggcaagcagtgttccaaggagacagctggtgagtagatgagcagacacttaaaggaaatttcaataatttccatgactttggtctctgaatattactgagtaaatctcttctttaccaaattgtagataaatatacaaaataagaaacattacttcttattttgtatatttatctacaatttggtaaagaagagaatttctatatacaagaagttaattggtcatatcagtaagctgaattccagtttttataccatacagataatgaagaaaaagagattcagaaacatctgaaaggatctgttcatcactaaaagaagtatggtggtgaatgatttctaagaatgtatagaaactaattcgcactctttatgcaatttagtttctgcaaagtcgtttgttttctttttaaggaccaaatcctatggtaaatacagaaatgtattaattttacttactgttcacaagttcaagaaaatactaagttgaaagcaggaatacattccaaagaagaaaataaatagatacccacatattgataaattgaagaacagtcagtaaagggaaaattctaggaagaatttatagtaaacttcccagcttgtatttaaaaatttagaaggaggccaggaaaacaagagacccttcaatcaaaagagcatcatgctagcatttgagactagagataaacatgatttatatatgaacttaagataaggattcacatcacagggcaatttaaaccaaggaaaagcaccaaaaaacattcccctcttgaatcagtaggagaaaaaactgttaaatggcactagcactggaatttgtaagagcagcaacctttccacagactgaagctaagacaacaccatcagtgtggggagaatagttggcaggcagtctcaaattcccagctgacagccatctctatctcaagggaaagcgtttgtctcagatggttagtcaagtgtcagagctctttcatctcccagataggaaatggaaaataagaaaatcacattatctagactacgtctccattttctagttctttgtcaacattaagaaggatgcaaggaagaacatgtctgagttaccatatttcgtatcattaggctgagttactctgaatgtgacttatttttatttgaatgacatcaaagtggtatgttagctacttaaaaacatattgagattgaacgaaagacatgcttggatgctaacaagtattttacaactatatgataacgcaatcagtagtgagtatcactttctcacacccccacaccctccatatgcatttacacaagacatagaaagcataggtggtctgttggcatcagctggttcttactgtcacacatctcaatgtaggcactcatttaaaagtattagttttattgagagataaataacagaaagatgccttctcaaatcctcaagctgtctcactgcataacactgagtatttggactaatatctccaagagatggttgctgaaaatatggaagtgaccttgataagtagtagagtttcatttgatattacataagctactgacatctataaataaaggataggagaaacacacctaaagaaagccaagttttaaagagcaaacatgcacgtggataaagggaaactagtaaatataatctaatgatacttccagaaagctaggttccatacaaaagagatgttatcatattggagagctaagaaataggaaacaaaaggttaagagatgaatagatatttctagataagacagtttcctagattagtgtaaaaatctctctctcaatatagttttacacattgtttggaaaaatgcatggtaaatctctaagacactaagggttcttgagttgtgaaatgttagaccaattagattagttatagaaaacaatcgtaaggcagaatgaatgagaataaatgttgcatacacatttgagtaaagtttgggaaacatttagaggaaacacaacccaaagtatatgtaatacactaatcgttagagaaatgcaaattaaactacaatgagacatcatctcactctagtcaaaatggcttttagacaaaagacaggcaataacgaatgctgtcaaggatgtggagaaaggagaaccctcatacaccgctggtgggaatgtaaattagtacagctaccatggagaacagtatggaggtttctcaaaaactaaaaatagaactaccatataatccagcagttccactgtggggtacatgtccaaaacaaaggaaatcagtatgtcaaagggatatctgtattcccatgtttattgtagcactattcatgaaagtcaagatgtggaatcaacccaactgttcatcagtggatgaatagataaagaaaatctggtactatacaaaatggaatattattcagtcataaaaagaatgaacttctgtcatttgcaaccatatgaatggaactggagggacattatgttaagtgaaataagtcaggtacagaaaaacaaatatcacatgttctcactaatatatgacagctaagaaaatattgaactcttagagatagagagtagaatgatggtaactaaaagaaggttagtgggaagcgggggataagaagggatggttaatgagtacaaaaatacagtaagatagaaggaataagatctagtgtttggtagactatagttaacaataacttattgtacatttcaaaataacaaaaagagtggaattggaatgttcctaacacaaagaaataataagtgggtgaagtgatggaaacccagttaccctgatttcatcattatacatgtatacgtacgtcaaaatatcacatgtaacccaaaaatatgtataagtagtatgtattcataataattacaaataaaaaatttaaaataaccctaagtatacgtaataagaacatggcactgagctatcatttgttatgactcaaggacattgtgtcaatgtaaaaatgtaggcaaatggctaacagaaggctggtgctttcggaaggagacgagcaacacaatcaaccaaccacaaggaaaccaagtaagcccatgaggactccacacttggaacactgtgtgtgtctccagttactgttgcccatgcagaagacaatggaattgaagaggccatccaaaggtctgggaggaagtaatggggaggacagtttatttatataagagtatctcaagaagagattaagaagacaaagacgctagtctgaaagtaaatctgaagaagagtatatttgtaaaattgctaaaaagttatatatacctatgactgtcattttctcatttcccattccttcaacccattaagatataccctccttctgtttgacattaccagaatcactcctctattttaattatccaataataggtatctttccctccagccattctttaaattaagacaagtcatacccctaaaaccaaggtctgatcatgtatttcctaagtagaaaacccacaaggacctttgttcactcagcaatgaaagattctggagccatggatttcacagccttttgcaatataatctcaactcgcatttagcgatttctcactagatgctacccctctctttatccttccaatctcagcctctgatatcatcactatagttagaggagactgctcactgtcccctggatatgccatttatttactgcatttgtgcctccgcacagatgcccagtttgagatatcccctctaacatcaatcttcaaatctctgctatctcaaatactttttattgaagacttagctgaaatttcacctttctgtgaaatcttcatcaatctgtcagttaacattattttttctcctctttcctgtattccttagcactttatttggcctgtgttatacttataatcccattctttgggtctcatttctgactaccccactggggtagggaagcaagacattttagacacattttgagactttgaggctgatgttatgaggataactttgcctctctacaatggaacctctggtgctgaaatcagaagactgagctagaaaaatcagaggcctgacccagtgtgtcagtttctgtcatctttagcttatctcagacaccaggaaatttatagattatatgtttgctccactaacatgatgagtctaatgctcatgggacagctaacttccaggtagtgatgactgaagaagtctactttatttgcactgaatgtttatgtagcattgggtggatcatattatgcaatatctctaggccaaagcatcattttcccaacactcactttcctaacctttagataactttataaaataatatgagtcatgcgttgcaaaagattacaccttctccctacaacagaaggggaaattcactgatttccactcccttttccttattctcataaatcataaacttaaatttaccctagggattttatttctttgaactcaatgtacaagcataaaacaaattttgttctcacaggacatcccatttttgtttcattagttcaaggaaagggtcactcaatttttaaagcatttggtttgatctttgctatgattcatgctacctaacatccacagacacactctatatactgaaatgtatcttatatataaaatgtgtctccatggaccctataatggtggtactctcacgtaaagtactcaaaagctgtattatggatacatgagtctaggcagggtaaccagaagtagaaaataaattaattttgttgaatatttaaataattgttgttttgcccaagttcctattacacgacagatttctgtttcttcttatgaaaggtaaaatacttccctggggctacgggaggaaatgcttgaaaaaatttcaccaaatataaggcctagattatactagttctattttatacatttttattctatgttcagccatctcactgatatttcattccacagagagggaggtgataaaatatttttttaaggtaataaaggaaaaaggaaataaagaggatttgtcataatttaactagataaaaataattcttgtgatcttaatgtaagaatagactatgatctctaaaagaatactgaattatggaaacatgatttttacataatagaaccatttacacatagaatttaatcctactaaacaataattcttaaggctctattggcttatatacatttttgtctctaaatcctttccagggcaccgttaagttattttaaaatatttcctcattgtattgccatggaagagattctcccttacctcttctcatgaccaaaattctatttcccatgctgggtatcgacagggaaccatgatcatcaacctttgcagagaacttctcttcatgagtttaagatcacagagatttatttgcaaaaacaaatagggagagagattcggcttaaaattttttgccagattatggccattatttagtcttaaaaccctaaaggtcttagataggagggtcaaacctagtacagcactgttggagcctgcaaatggcagctgaacctgggaggaaccagttatttccagggcatttctctcctatttcccacagtaaaaaagttgtccaatttagaggcatttggtatagctagagtaaggaggtaaacaaacatgctttagaattccatttcattgacaaatctgaaacacagatcaaattggccttattccaagactaaacagccccccaaatcatctcattttgtacagcagaatctcagagcttccaacccacctatggcacaagatcctggcctccagtcagccagctagttatccatggaagtggctcaaggctgacactcagattgactggttcacactaatttacttcacacagattccatttatctcctagaagatcccctggcagcagcttataatggcatatcctaggatgcctgcctgcatgcgtgtttaaagcaacagcgcttgatgaatctgagtccagaaaacagttcacagattgaggagtaggtgcaatcagaaaacatcaagaggcacagctgggacttggtggcttgcttgactggtcagagcagctgagcattaagcgtgtctgcttttctgctggctgctcaccatcaccaggacaaatcagagagccaccccctttttcctttaccagtcaccctccaaaggaaaagagaaaagaaagtatgtcaccatcccagtagcgtgtgcagctgtagagaaagctaatttgatcatttacctttacttcttaaatacttcgatattattctcagtagaactacagctggtagttctaaggttaagttgttgaatggttggattggcaagatgtagttagaaaaagtggaagagaacttcaacttattttttttactttcaacaatgagtcccaaagagctgtctgaaacgctatgatcatggggctcatcggtcgacctccaaagaaaggaagggtgcctttctggttactctcctacatctataagagagcttggggaaatatacaaaaaagctggatatttatctaatgagtaaatgggtggatgaatgtatgaacaaacaagtcactgttctccagctgacgttttagaagtgtggtgaaccattgcacagtaacatggtcagcctccaaaggtggagagaattgagatcttttaacggcattgaagctaaaagttttaaacaatgacaattcactgagaaatgtaccaaagcagtgacatagcacatttagtacttataaggttaaacactgggctgcagtagctgcttgaccgtaaaaagtaggattaaggcttttgcatgagccttgacatgatcctgttgtctgtctgctgccttaagctttgaaaaacagctgggatcatcttcttataagctccagctcaaagatgtttaagcagtccccaatccaattaaacagaggtaaatagaaggaagaattgtactgagcaccatcatcaccttttttcttaatgaaaaacagtgtaattgcgggttacacagctccttaatctcacattaaatctaatagattgctgacttatactgagcatgacagtcccagctttctatattggtgtgcttaattttaggtcattatcctttattatgtgacttgtaatccttaaagcccatgattgtgtctggatatttggcaaggattgtatttggtaatacaaggattctgcttctaagagtgatggtttaattgaatgacattgtataattattagatgttcagagaattacatatatttctttccttttttaattggctggtttcttataagtgtttccttcaacaaacattgttcaagattattattgagttttaggggctcttctgaaaaggacagctttcacaaatgaaagacaagtagtttattgatatggaaatgtatctaaatgctattaaaatgcccagttcaaatacaatcctggctcatctacaaactgggaaaccttggtcatgttactttacctttctgtctctgtttcttcatttataaaatagcaatagtgatggtgcctaccaggggcaagaaactgttgttacaattatatgagttaaaacatgtaaagtgctcagcctaatggctcaaatgtagacagtctaagtaaattcagtattattattatttgtatatctgtctttgtctagaaatatgcataaatgtaaataagatgtccagccttaaggtcaagacattttattttattttactagcaatgtagtaatatctaaaatttctctaacctagtaatagaagaaatattttaaatagctatattatcttgatcttcattgaagactgtagaaatctacaagttattgttagtggcccccttttattttaccagtttaaagaggcatgtccatttgtatctattaactaaataaaaacctgtccaaagtcatctgtaattcttttttcttatcaagagtgctgaatatggaaggaagtaaaagtgacttctgacaatgctgaccagataacatagaacctcattggaaagttattctaaatagcttttttaattttttgctgataaattaaataaaaattaaatggaatggaaatgatgatatggtgatatactttacatatatattagccttttagagaactgatttgggtttggaaatttaaattattgtatgtgcacaatcaaatttcagcttatggatatgattagatcataacattttaaatgagcaactataatcttttatatttcaaagtaagaacaggtcttgcaccatcacttgtgcatggttcttgattgctgcttttttcctggtttccattcacacattaagatttaagaaatgctagtattgaaactgaaagtctaatgaagctcagctccgtcaatggcaaacacattagtggaggaggtcatttgacggtgtatacatctaacacacagaaatagtggtttacttgttattaacattcttctttttcatttctagggtagaaagcaccataaaacctcatataaaataacatcaaaaaattctctttttcttgaacaccaggttaacattgggtgatgcggaatgcattattatatccattttagttaattttaaaggtgaaaaaatagacttattttggtttattataaaaagttttttgctgtgtttttatcttgtttgacccaatatttatactgctacccgccctggctcacccacccctagacacacagcagatcacagaatgaatcagatcactgcatggttctgatccttctataaaagcagctgaaataactggatcagagatttcatgactggtctcagtaagtacatttagatataagtagtgccttgcttttggtctttacaacacatactccatgaaactcattaatttgaacttatagataatagcaatattctatatttgagcaaatttcaaaatagtgatagaaaaataagtgggtcaagttactcataagggaaaaaaataaaattgtcaaaagattctgatgacaacactttaccccagaaaataaagtaacatacttaaaaatttaagagaaagaaaaaattgaactaagattttctatccagcaaaattgacttttaactagaaaggctgcaagttaatataagcatgcaataacttaagaaatattgtttaaatatgcctttcctgggtgacctactaaaaatgagctttagataactagaataattgaaaagccatcagcatcagaataagaggtaagcactaaatatacatttacctgtagaactaaaatcaaatgatggttatagaaatatggctgtattctctgacaattcatagaacaactatgaaaaatgcaggtgatcagagggatatggagagtgcataaaaagcaggataagctgagtaattacatagtaatacatatacttagtagtatatgtattacctgagagtaaaagagtatcatttcaaattagatgctggaagagagaaagtaaaaatgttagtagcaaattatttcattattgctaatagttgagggctaactggcaatgagaagaaaggtaatacgtaaaggttttagcataaaggtaaacattaggaaaaaaaaaaactaccaaatactccctcaatacctacatacagaaagtgagagagaaagagagattttgaggaaaataaaatgaaatagatgacatagtaaaagaacatatatagtttcatatatttgtgtctatgtacaaacttaccatctttatcaataaatgttaatggacttaattcacctattagaataaaagagattaagattgactaacaaagtaaaatctaacactatgttgtttttaaaaagatacatcaaaaacaaagagttaagcaagattaaagataaaaggatagacaggatataaataaatttttaaaaagcagtggtcacaatattattgagcatggtggaatgcaaaccaaagagcaataaataaagacacagagaagagtatttcgtaatactaaagactgcaattcacaatggaggtatttcaatgactaatatatgtgtaagtaataacacagctactttaataaagcagaggctaaagagaatggaaactaacgatagataatgttagcacatatctctgaatataagacacataatggggacgaaatattgacaagaatatagaaaacctacagaactaagtcaataaagtagatgtaataatcaaactctaatgccaatagtagacagtacaccttgtacttaagtgcacatgaaacatttaccaaaactggccacatcttattttccggagtgacccctccaacattccaggaatggaactagcacagaaaacttctctgatcacaacgcaataaggctagaaattagatcgttccacctggaaatttcaaaacacattactaaataattcagctcaaaagggaaattcaatacaaaactgtagaacttaaaaaaattgtaataatgaagacataacaatacagcaaaccaaaggaagaaagaaaaaaaaaaaaaacaagaggaaagaaagacaatgaattagaaagcagtaaaaagaagaacaggaggagccaagatggctgaatacgaacagctccggtctacagctcccagcgtgagcgacgcagaagacgggtgatttctgcacttccatctgaggtaccgggttcatctcactagggagtgccagacagtgggcgcaggtcagtgggtgcgcgcaccgtgcgcgagcctaagcagggcgaggcattgcctcacttgggaagcccaacggtcagggagttccctttcctagtcaaagaaaggggtgacggacgcacctggaaaatcgggtcactcccacccgaatattgagcttttcggaccggcttaaaaaacggcgcaccacgagattgtatcccgcacctggctcggagggtcctacgcccacggagtctcgctgattgctagcacagcagtctgagatcaaactgcaaggcggcagccaggctgggggagggacgcccgccattgcccaggcttgattaggtaaacaaagcagccgggaagctagaactgggtggagcccaccacagctcaaggtggcctgcctgcctctgtaggctccacctctgggggcagggcacagacaaacaaaaagacagcagtaacctctgcagacttaaatgtccctatctaacagctttgaagagagcagtggttctcccagtacgcagctggagatctgagaacgggcagactgcctcctcaagtgggtccctgacccctgacccccgagcagcctaactgggaggcaccccccagcaggggcacactgatacctcacaaggcaaggtattccaacagacctgcagctgagggtcctgtctgttagaaggaaaactaacaaacagaaaggacatccacagcaaaaactcatctgtacctcaccatcatcaaagagcaaaagtagataaaaccacaaagatggggaaaaaacagaacagaaaaactggatactctaaaacgcagagcgcctctcctcctccaaaggaacgcagttcctcaccagcaacggaacaaagctggatggagaatgactttgacgagctgagagaagaaggcttcagatgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagaatcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagtcgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcactcaacacaggagcacccagattcgtaaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatgaaactagaactcaggattaagaatctcactcaaaaccgctcaactacatggaaactgaacaacctgctcctgaatgacttctgggtacataagaaaatgaaggtagaaaggaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaccgttcaaaaaattaatgaatccaggagctgttttctgaaaagatcaacaaaattgatagaccgctagcaagactaataaagaaaaaaagagagaagaatctaatagacgcaataaaaaatgataaaggggatgtcaccaccgatcccacagaaatacaaactaccatcagagtactacaaacacctctacaaactacaaacacctctacgcaaataaactagaaaatctagaagaaatggataaattccttgacacatacactctcccaagactgaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccggacagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatttcaaaataataagagctatctatgacaaacccacagccgatatcatactgaatgggcaaaaactggaagcattccctttgaaaagtggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgactgtatatctagaaaaccccattgcctcagcccaaaatctccttaagctgataagcaacttcagcaaagtctcaggatacaaaatcaacatacaaaaatcacaaacattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccataaagctaccaacgactttcttcacagaattggaaaaaactactttaaagttcatgtggaaccaaaaaagagcccgcatcgccacgggaatcctaagccaaaagaacaaagctggaggcatcacactacctgacttcaaactatactacaaggctacagtaaccaaaacagcatggtactggtaccgaaacagagatatagatcaatggaacagaacagagccctcagaaataacgccgcatatctgcaactatctgatctttgacaaacctgagaaaaacaagcaatggggaaaggattccctatttaataaacggtgctgggaaaactggctagccatatgtagaaagctgaaactggatcccttccttacaccttatacaaaaatcaattcaagatggattaaagacttaaacgttagacctaaaaccataaaaaccctagaagcaaacctaggcattaccattcaggacataggcatggggaaggatttcatgtccaaaacaccaaaagcaatggcaacaaaagacaaaattgacaaatgggatctaattaaactaaagagcttctgcaccgcaaaagaaactaccatcagagtgagcaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactacttcaaccattgtgaaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccagatgtccaacagtgatagactggattaagaaaatgtggcacatatacaccatggaatactatgcagccataaataatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagaggggagggatagcattgggagatatacctaatgctagatgacgagttagtgggtgcagcgcaccagcatggcacatgtatacatatgtaactaacctgcacaatgtgcacacataccctaaaacataaagtataataataataaaaaaaagaacaaagaaagaaatgcaaaagatacttttaacaaaataatcaataaaacaaacaaaccactaacaaatctaatcaagaagcaaagggaaaattcacaaatacacaaaatcaaaaatgaaaggggaaggaaaatgactatcagtagagaggaaatttaagaagtcttaagcgattataatgctcagtctatacaaattagtttgaaaatctagattaaacaagtaattctctggaaaacttggtagtgatagaaagagtaagtagacaattatagtagaaatagggaaagaaaagccattagacaaaattaaatgtccatttatgtaaaaatacttaataaaataggattgctggatatttctttgatatgacaaaatacataagccttggctccaaagccaacaacctacttaattcagaaacatcagtgatttcccatcaaaataaggaaaacaacaaggatgcccactgttaccaacaactatttaacattgagttgaacatatttaccaatgcaattaagccaaatggaaacaccaagtcctgggtttaagcgattctcctgcctcagcctcccgagttgccgggattacaggcatgtgccaccacgcctggctaattttgtatttttggtagagacggggcttctccatgttggtcaggctggtctcgaactcccaacctcaggtgatccacccgcctcggcctcccaaagtgctagaattagaagcgtgagccaccgtgcctggcctgttactattataatatcattcattctataaacaatgagtgctactgggtgacagagcatgtgggaggtgctgggtatatagcagtgatcaataatctttgtattcatcaggtctcagtggttgtaagagctaaatatttacacaaaggatgctcaccacagggtaacaggaacagggaacttctgaaatttatttgtaggaagaactacaccagccttttttggttgccacatctggaacaaaaggatttcatccacttgttctgcctttgcttcattcagctttaagttcaggacctcagaagagattaattggttgagctaaagaaacctgcccatcctgtggccatactgtggtaatgatagaggaattgatctggtggtaggcgcttcaagcatgcttagggcatctgaaggaagaggacaaattaattcattgtttctgcaggaatgcacaaaagaaaactagggtgctctcatggtagcagtaaatgctggacagcaaaaaaagaaaagaaaagaaaaaaaagaaatgttgctgatctccaaaggttgatgacgtctttgtaattgaccacttgaatgacttctttgtacttgaccacttggatttgtctgccatataagtctatgctgaatgtgaggccaccttatctggtgaaaaataaccagtataaaatctatcataaagtggtcaccaactctgcttactccctatagtaatttagagctatgctctgatcatcttctacctaaatcatcttttctttcaataaagtagtgtgtggtagcactgaaccatatacctgttttccttctaaatgcacccgtggtaaggtatcttttataggtaagacttcttaggtagaagagaaatagccagtgccaccatgctcctacagaataaacagggcaggcctgatgggagggctcgggctctcagatgcagcagggttagtttctgccatgcactgggattggaattcctgttgtgcatccggatcatgtacagaatttcggctgacttcaaagagagtgattttgagaagagagagttagttgccaaaaggagaaagcaaggcattaatctttgataagctccatttactaatttataaaggcaatgggaattggggtgaggttaaaaagtaaaagctgagggaactatctgtagtgaatgctaatgattttctgaccatgtcatgaactgtgcttttttttttttttggtgggggttgaggtggggaactatagcatgattataaaacgttacatactatttagtagtttataagtgtttgtaagatttttttaaaaactagttctgaccccttaaaatggaagagctatttgctagaaggggcttgtaaatcacagcagttacaggagacatgtttagaattcagagtcaacagagagagattagcatagacagcaatgcaaacagtgtttccatttttttgttcatcttctttatatcaacacagagaagactgggaatgaaaggcaagaagctccagaaagaatctggagaaatttacagaagaaagagaaccaataaccatgccccaggtataaagaacacaaacatctaggtaggaactatttcaaacagttaagtatggatgacgtttatttattcttaaggatttttatttcttttagcatgttattctttcagtcataggcatatttgggggacccagtacgtcacgtactgtccaaggtgctggggagaggaaacaacaataaaagataggcatggtttgtgccctaacagatcttatggtctgacaggcaagagacattgaacaagtaattacagtcgcatgtgatgaatgtcaagctgggctgatacacagttcttttggaacaagcagctaggggacactggaccattttgtttcttgagagaactagagtgtagctgatagactctgctcaaaaattgtctattcaattttcaggtttggatgttgacatatatatactttacacatcttgcatcttttaatcctcaaaacgaccctgccgaatagatgcgtgttttcccatttatcgaccagaaaatttaaactcaaggtagctaaattaacatgcccttttcacacacataataaaagctaaggctgtaaaaatggacctgcttcaaaaacaagctgattttaggatttttttttaaaagatgagtaacagactgacaaagggagatcactaaaggaacatttcaatggttaattacaccaatataaaggtgaagggttatacctaaggtcacgtaggctttggttttggttttatagttaaattaacataaaaatgaagtcttactcttaggctaacttaggctttggttttacaatagatcaaaggtgatctgttgcccagactttggccttatttttgtgcccaactctataatacatatccaaattcaggtgcctaaaccgaaggccccagatctaggtcccagggtttcccagagttattttgcccatctgtgcttatttgctttctctttcattcatgcagatactttcctgagtgaacttttggtgtcccctttcataatataagctccagaaagcggaagttcaattaaaccagaaaaacctgtttaattgaagccaaccattgtttattgaacactgattggtggaaagcactgtggtaagtgttgaggaaacaagcttggtaagacacagtctgtgccttatgtttgcttcccactctcatcagtcttgaccagggattggcaaatgttttcttaaaggttcagatagtaaatattttagacttgtgggccatatagtctctatcaaaactattcaactctgcagctgaagcatgaaagtaaccaaaaacaatacatgaatggatgggtgtggttgtgttccaataaaactttttttaccaaaaacagatagcaggctgaattcagcttatggtttgcagacctctcgtcttgaccatttctggttagtgcatcaagccaccagctgagcttcagtttttatataacagtgatagtcatgatatgaattgggagcttatcagaatctctgagcataagattataacataaacatctctccatccttttatttattatgcattaaacaaaaaactttctctgcctacccctttaaagactcattcaaccaccactctgctccagcagagaaaaagatgtgtgttttggtttcctccacaaggaatgattagggaaatggttagagacttgctgtataacattagagacttgctcagataaataggccttcactttaactgtggtataaatgaagcagccgagagaatgacagcatcattaattcaaggaatatttattgagcacctactatgtgaaaggtcctggaatacaggtattagagaagtggtaaacaaaagacacaggctctccatctcttataaagcttagaatctgactaggagacacacaatctgtacataaacacaaaagatataaatgattattaattaaaaaagaaaatgagtaatatgaaagaaattcacagtttgtcatgagaataaatatggagtgaacctaatgaagcttggaggtcaaggaggatctgtttaaggaaatgacctttaaactaagacctgaaaaatgggcagaaattaggtgaagagtaggcaatgggaaagattacaggttaaatgggtgtcacttgaaaagatttgtgaaggttctgaggcaagaaggagcttggcctggtctggggaatggaggatggccagtgagactggaggtcagaatacggggaggtgactggcaaaaatgaagctggagaggagagaggtcaaaccacaagcctaagagcacttgttaagcattttgtattgtatcctaaatgcaatgagaagatgttgaaataattcacgcagaattggcatgtttagatttacatatgtaaagatcgtactgactgctgtaagaaatatgtcttggaaaggaaatttgatcaaacccactctcagcctttctctttccagcaccttctctgggcaaaacacccttggcaactgcacccagaatcaggagatgcgtaaaggaagaaagtcatatctcccttccgtagatttattacctgtccataaataacctggagacatttatcaccatgaatttggttacttatgcaaacatacaattcttatgctatgtaaaaattaaacacaaaagtcagtcctatgtataaatcacagaatcactataaaaaacaattaccttaagagtcagacataagatggtctagataaagaaagcagggagccagaggtggaaaactcccttgaagaagattctgctaaacccaataaaaggtatcaatgaaagaggtggtaaaattagatgtaggataccaattcagatatggaagacgacttagaatacacagacacacacacacacacacacaaacacacgcacatgtacatgcaatatgctaggcaggaaacttctgatcctgtctggcagttggtctctatttagtataatagtcttttgagatcagagtgggaaagggaggaattgaagtgaccattcagccatctgctgctgagcatattcagggaaaagacagaaaattcgttgtttggaatgccttgcaagtgtcacctgacactgacatttttagactatcctcaactgaattattctatacctatcatgtgtgtgtgtgtgtgtgtgtgtgtttatgtatgtactagtatgtataaatactcaaagacacagagtcaatatcagttaatttcatagtggtgacaaagctatatatccaagttcagagttgtaactttaactgtttagtgtattaatgcctcactgggctcatggatgctacatattctccactacttgtttactagcttgtcaaaattattcaatatatgcagtgtcacaaagcacatggtcacatctcatatgtctgcttcaagggcaggaccaacgtgacctttactttttcttttacacgggataaaatcattctttaggaacaatgtctatttgcacagctacccaatctgctattgaagcagtctcaatcttcttcaatattgcttgttaaatgtttatagttaattttatagtaaagggctagatgtctgaatattttcaaatgcattctctattggagtgggttttaactgttcttctttcactatgttttataagatcgaaaacagacacatagaaaataatgaagtggcttaaaaaattctttcttggataatgaaaaacctgtatcatatagaagaatagaagactgcttccaaacatcctctgacttggaagacagttacacatttgtctgttacgtatttctcatccagaagcaaatattaaccagtcaacatcgaatgccatttgatttcatcccctttggcttggaaaacctatgactacccacactcaggggccatcggcatggaaagtattagttcctgtgcagcccaggagctctataggaagcggtggaatcccaaaggtgggttgaaaggttcaaatcatagccaagaaaaataacttcagtcactgtcaacggtcaatatcatttaaatctctagaaatcttatgaaaaaaagataaaaattaaaaataatggctttctttagggtccttcccacagcaatgattcagaatactacatttttagacaggggaggagaaaatcataatgcccggtagaggggagatgtaattttattatctggcaagatagcggcttcatcattaaaaaattcaaccaactagaatacagcgtcctttgacctagcagataaaaggtcagacagcaattttgaataataaatgagacctgttgacctgatgacccaaatctggcagggtgagtgtttcctctttcacagatgcagacacacacaccaagacagctcagctaatgagctgcctcaacccaggttgtgggtgctgcagtgttttcgtgttatgtagcacggggagaacaaatttctgaagctgttgtgtcatgtaaagtgatatttatagaaatatttctattgtggcttttaaggagactctttcctgagttcccaatgtttctatttagttgttgaattgagtagaaacctaaacattggtcaaggtatttcttccacctctgatttcctttattattttagcactggcaaagaagaaaggaaatgctatatgcatttcacttatattaacagcaaggtgattttatgagaattttctaaaaatgggaatgaacctaaatgtgactctttcacttcattttggtgcaaatagtccttgtatttagataacggatgtagaagtacaaggtattaagctatatggatatttgtgacatagtaattagtttaaatgtttaactttatttgagtaacacagtgatgtaatttgaaaccttaaaaatttccaactaaaatgaaaacagaaatatggctttaaactaaactatccatccctacaattttaatccttaaaattttcattattgcttttggaaaataacagctgttacaaagtaaacttggtaaatgtttacattctttttgataaatatcctataatatgtctaattttgacacttttgcttaataacatgtatagtgcctttgtgtttacttggtattcttttcaataaaagatttcaggagcctggccaaattccagtttagctaattatatttctcttgctaggtccccttttagctttcaactgactatgatagtcttcttcactcttcatgttaaactcttgccaatttttgaattgcagaagagccatttggtaaaataacattgtctctacttgtagtaatatcacacagatgagtaaaaattgttttgaaccaattttttgttatttaccataaattggaaaaaaaaaacttaacaatgaaggatttagagaaaccctcaccatatatttatcacaatttcccattatcttcccaaaatagaaagacaaaatggcagccaaagctggttcagttggtttcaagcctgttcaatttgctgtaactgaataaatgcatatagaagacttttggtgtgcagagccctagtaagcatcattgtgttgtgttgcaaaaattttgctttgtgcatattgaacttttccagaaagtcacaacttttccaaagtaaaggcacttgacctagatttatgggtgaggtcccattctaattagtaacatggaatactactgctacatagatatacatcagctgaactgtgatacaggagaagaaaggaagtgagtttacagggagtgaggaaaaatgacaccttatgtatgtgttttgtggagcacttctttgtcccgtctacacacttcacatttatttttacataacctcactacaaactcacgtagaatatatgtagttttgtgttggtaaatgtttaataaaagcaaacaaacaaaaaccccgatttgtactatttgtcaatttttatggtacaaatactcccaccataactaatttcaagctaccaaaatgatgtcactatgtacaaagctgaggagagatgcatacaattggctgtcaggagctggtgttagctggctccatcacaccactgagtatagaggggctattggtatcttcattttggagtcaaggaaactgatacggagagatttaatgattcatctgagatggagaagcaaagaatagcagggctggtacttagacatcttttattaccaggttctgagtttttctccactttctacaatgtgaagccatttaagataaaaaaaaaaggcaggaagtgtaagtgcgggaagggtaaggaaactgtgcaccaactcaggaagtgcacgtgcacttcacggaggacagaggcagggcggacccacgaaagacttcagagcagaggcagacacaaaggaaagaaacactgggagacaaagatgcagacaaagaagaaagaaatagatctgggggaaaccgggaaatgtagggggagagagataaagagagagagaacatgtgcaagtaagcattttggataaagaatactcaacttttatatcagttttctccttctggctcatttgcctctttcccacttttatctctcgtccttcatgttgtaataaatatatttttttgtttgtggtattctttgtagttttgttaatatagcaaaccagctaatgttttatatttcactcgactctcctactatttcaccctatcacccataattcaattaaattaaaatgaactttgatttatttgttttacattcagaccacttatttgattattttgctgggtcaatggtttgccatttaaaaaaatatatatttctcagccctttactgtagtattaccttgcaaagacaaagggtttcacatccattacctaaaaagtcttatagcactccttcagaagaaagggctattaattttattttacaaaataaagaaagacaaaaggaatgaactaattgtttaacaaatagcaaaatgaactgaggcttgaatctgtgtttctacattattattctctaatatgtagctatattacactgtttcaaaaccaaaatatacagtaaaatctttaaacacattttctttgaaaataaatgtttggatgacaatgtattccatcatttatctatggagaaaacaaataataatgctctattttaattgccagtgtaaaagtttaaggcataataaagaggtaaatatataaatgaggcaatacaatgtccatccttggagaaaatattttaccaacagttaaataatgagattgagtaactgagtatcaggatataaattataatgatgaaaaccatttaaacttatcagcataagaacaaattgttaagttagagtattgttagaactaaaggtttgtgttcctttcttcattttagttttcattctgttgcaaataagtcactttttccctaatctattacttcaaagaattcacataagtgtttctagcagactgcctatagtagggtctggaaatcagcagggtgacattcagcagtgttcctgtacatggatggatggaactgacttatcaactgtcacccatatcacccaaatcatccatgtgaagaaggctgacttggcattgagctggcaattatctggtgaacccagcctagtaaactgcccaaactgataaaagttcaaagaataaatataattgcattgggaaatcatagagaatcctttttgatgattcaaaatgcaatatcttgaatgggttcaatccactatagcatgctcatcaagtcatctaagaaaaaaaatacagactgctattataggctttctacaacatggttcaaaaccttgcataaacctggtctttacagaaatgtaaattatgagtatagcgcatgctgagtacatgtggaaaggttacacactcactaatgttatataatccatgttacatgtataatacatatgtatacatatagtacacatacacatacaataacttgaataattaactcaggttattagagcaatgatagaaaggagtttcactctgaacagataaaaaaggaaagatgaatacaataatttactgaaagaaatttgacttcaacaattaaacaatagtactgccaaggttgacttggccagagtaagaaacttcactttaaaggtaatttgctttattagttctcagtatatcaggctgtccaaaaagcttggaggccaaccagcagtgccatagcagtcagagcaaaatgaacaattacagtgtcattatacttagctttctaaggttaggaagttcttgcctgttttctaagtgaagggagctgtgttgtgttcagcatttattaaatttccctgaactttcagattatcttggagaaaaaaactgactgctgcctttagtatgataatatgaaaatccaaagtgaggagcaccaaatgttgacttattttgtgtgagcttaagggtctctcagacattacaatggctaagaatttcatctcaaacaccacattcaaaaagattatagagtgattgcttggaaggcgatgttcagaagatttctaatgttgtatctggatgtcgcaagaaacaatgccttgatctacgagcaatgtatgccagaaggtaggaatggagaagcaacagcttacatggcaccttttgagttcttgtgtaatgaaatctggctgaggtcaagagagatcagcccgtgagcctggaaaagtgaccaccgaccatcctgaggctcagttaaatgaaggaggtgttcctagataatctccaaggctctcattagccttagaatgatttaatagcatctaaggtttctataataatattacagttcaaaaaatgttttacatatattaatttctcatattattattactaggttttagaaaaaaactaaagctcaaagtggctagccaggatgacacagattgaggaggtgagattcaaatgttagtttccacccaatgtatttggcatgtccgtagaagtgtacattggtatggttattgtagtgaataatgggtagaggtgacctcttccctcgttgatgctgaaacaggggcactggtggaatctggagcagtgggttccctgagtagaggactcagaacaaaggcccaggtcactatctttccacagacattgactgacacagctccacttctactataaatgtgtcctagaatctattgctcattctatagtaggaattcatagactccaatattaattttaacattttatccagttttaatggcaattatccttaataattatccttagttgtcaacattaaaaacattatccatgacatctttaattccggtttgcctcgtcctatcacctggcagatttttggccttgatccagaagactccaaccattcaagccaaacatatttacaactgtggtataagaaagtagccctgatgtttacaaacaaaaacgaattctgaaaaatgtgctctaaagttaatactatgtatcacattagacaattgaaacttcattaaatattactccatagatactatcccccatctttcatctttatggaaatggcttaggggtggagtgaaggagaagcaaagattatttgattatgtcacaaaatgatgatttagcaattcaacatcccattaaagtatgtttaatgggatgctgaattgatttcttaatttataaattcaaaaagttaaagtccactcactaggttgctgtgtaagaaagaaccctgtaatgtattccaaaaccttatgtagatgatttcttgattttatttataacttttttcttccaatggagccaatgactgaggctggcctattctgatgcatagcagtaaatggcacctgccttttgatttcatttgtttgacgggatttttagtgaggcaagaaatgacttcagaataaaagtctcttaatgaaacttaactttttagcctttaaaaatgggacattctatttcttagcttattccaggtgcatacttaaaatgtgcatgatttttattaaaatccacattcttggagagttagaatctcaggcataccttgaagcatctcttcagtttatcaatgtatgattcaaactcaagcttttagttcacagaaatatagcccaaaagcaacgccaacgttaaatggttatttacttataacttgctaatgtacttttctccctgagtattggcatttcttttttttttcattttaggattgggaaacatggattttgctactgccatagtagccttggtttcttttagccatggactagaaagaagaaagagtcctcattcgcaattcacacaaactgtaatgatgatacacatgtggattttttttaaagtacaatgaaagtttaagaaaaaacatgcaggttttctaaaaatgttttgtaaagattaggtgaagatcagtctccccaacagactcttatttttccttacaatatctgtaggaaaaagctcatttgcagacagctgcaatatgagcttcctttccttgccctgtcattgacctccaacctgatctgaaagaaccaccttctttcaaagtgagaagttattcatttaccataatagctctattcggggcctccttaacagaaactagcaattgtgcccaaacaagaaggttttgtgatcctgactaccgttcttacacaggaggacaaaaccaataggaaatttccgttccgacagccacagtaggcggccataaagttggtgtttaaaactatggcttatgtgtggtgatcacaaaaagagaaagaaaaatcattaggagtttgcacttgctctggttatgtactggggtttgccaattatgttctcttaactcgacagcttattcattgagcaagagctgctatattagaggttagctgacagtctgcagtgtgcaacttaaaataaaaccactttatgaagaggagtgagaaatataaatgataagcctattggataatcattagaaataaataaaaagcctttgatacatgcagttagtcacaagcattacaagttgaaatgcagtccagtgttaaagagacagtttagaagcacatggcacatttatcacaactccacagacaagttattgagctgtctgtgaaaaaacagagccaaacaggaaagctttcagcagtcagcagcagttgaggtccttgattgatatagctagatgatgaaaagctgtccgatggctttctgcaaaataaagtgaaggaactcaaggtctttcatggtgctctctgaccagagatgaacagctactttattatggcccagattgaggttgtgccttacttcatattctgctactttctgatgcacacggtaggggtttgacatcttcacattaaaaaacaacaacaaaacaaaacaagttcactataaaggacagaataccgcactggttagaagctcagattctttacttgtccttacgagcaactcttttaactgtagagatgtaaaggatgagaataagtattatcctagagatcccatggcgacccaccccttccttcctgtgcagtttcactccaaagcatcacaaaccaggatattcactgccatgaccccgatacaccaggttattttttttccaagaattaagatgcagtacttatttttattttgtgctctaaaatagagaatggcctttagataagacataaataactttggaagtctagtttaagttttttagttgctttgagcagtttcaatgactggaatttattttgctaaggagtttaacagcaaataatacaatggtatgacccttgtctttagcttgattcttgtcaactaaaattattaaccttaaaataaccacactgcattcttctcattatattcatttgtgtcctcccagccccggccccccaaaaaaaacacagggagagaatgaatgaggagaaaaaagaaagagacttgctctagaatcattttaaaaacattatattcttccacactctctcttcttatctaattcccagacttcactctccctaaagatattattaccacagtcctttgtttgagattagaacttcataaatcttcagttctactcttttattggcattttagagttgtattatttgattttgagtatcataaactgcattgttcagaacacctggaatttttaccttcaataaatgagacaactggtgtagcacattcaaccaaaaggacttcatttgaaattaattctggtaaggatatagctatttctaaaacttaaatgcactactaagacctagtattagttctcctctctctccaaaaatattagaaattttactctatttttaaacttcctgaggaaaaaagcaaacatattgaaagcttttattctgtccagaacccaaattcatatcccaaatataaatatataaatcaaagtaattaaaaaaatcaaaatttaacatagttttactttgcttaaagccgtcagcaaagagggtattcctctacataaaataagtgcatactttgctgcattctggttctatttcctcatacaaataaaggaggaaaatgattaatttctccctagaaactcatatatttccaaaacctcaatttcttgttatccaaagtgcctgttacctggggaattcttagagaatctcaggcctcaccccaaaagagtaagaactagcattttaacaagttccctgggtgattcatatgcctactcaagtttcaaaagccctgctttaatgcagtacttctaaactctgtctgcattttaggttcacctgaggacctcttagaaaatacagatgccagcaccctactatagaccaattaaatcaaaatttttgacagtagggctcaaccactgatattttttaaaagctccccaggtaattcaagtgtgcatccagagatgggaccaccactgtaatcaaagctatgtaacctgttttgtttatctttttatggtagccactagaaagctcaagtagttaacatgaatctttttaggtaatttattgttaattgagttatattaagaacaagaaacaagataacattaatacatttttatctcatgctagtcattgcactaagctctttttaagtaaattttctcatttaatgctcaaagcaatgtcagtcttcctattttacatacaagcaaactgagaccaggaggggttgaaaaaattaaggtgagatagtccttaattagtagtagaacatccagaacttaaaaccagttatttttgactacagagtttacattcttaaatccttgttactactttgcatattcaattcttgcagcttttttccaacctgtggcctagttttctcttaattgccccccaccccaattatttcttaattcctggctttggtttgtactctagaatgaaaagtggacctcaaagtttagtgtaaattagaagcaactgagagtttgttaaaacacaagttgctgattcagtaggtcttggatacaacccctaaatttgtaattccaaagaattcccaggtgatgctgatgctgctggtccagggacaaaaccaagttttaagaatcagtgggctagattagttgtgatggctcttatgatgttacctgccttcattacaaatttcctcaaatcatttatgtaaattgaaaagttatgaataagtaaaaacaggaaagaagagagggatgatgatatataaatgatgttaataagaatggataaaaataaaacttcaagtaagaagtgatttcctatcccctactgcaaacccttcccaagagataaatggacttcagcattcttttctccacaaagttataattagacttggtatatgatggcaggcaatgcaggtattctaaaagtcaaataaacttatattatgacattgtttagaaaataaatgagcaatgatgaacaattttaaggtcttctatgccttgtgttctctaagttacttaaatcataccaagatacatttaattattcgatgaaatgttttgcttgaggttataaactgcagtgtctgaaacaataaaagcgagggaatttttaaaaatttatctcagtgatttatgctcttagtgcaaagctgacaatttaaaatatacacttggtttttcttcatcactttcggaaagaaattttccacgtaacaaaatagtagctagaaaaatggtcctaattatttgtgttggatattggtaagatgtgattgagagaatagtgtttacatgaatcagtttcagcaaagacacatccttagaactttatgatttaaagttaacaagcagactaatttattaaattggaaattaggtatataatataaaattattttaagtctctctacctggactgagtaaaatttaaaagaaactaatttcatctttcacttacgacttcagtgacatgtacttcatttgagctgttaaaataaaggaaagcaagatctgcctgttataaaatagatatttttatttatttattttttaacttttaatttaggattgggggtacatgtgaaggtttggtacataggtaaacacatgtcatgggggtttgttgtacatattatttcatcacccaggtattaagcccatttaaaaatgtttattaatacccccaaactaggtttgaggtgaagctgtttgctaaatgattaatctagtaataggaatgtcagatggaacacaatttttaagatttttttttaatctgaaatactgttcttgcagaatgttggttggatgacataaagagcacaggcttgcctatcacactgattacttgatgtaatagtaagcaagcttaagtgaactgtgtgtcttcaatctttccaatcacttagggatgggcatcggagctcgtcatccatcatccctggtctgaaacatacagtgcatcagcaatcttgggctgacctaaatgatagtaaaagccgctatgctgttcacaataagaaattgttgtccgctgaattacaggtttgtgattagattgctaacatggccaacttgatgtataagtgaagtgtccagggaagatattctttaggatcttctgaagattaatttatacccttgaaatgcagaccaatcacagagtcaaaaaatatgtcaaggtgtttttcttgtaaccaagaaagcccagctgttttaacagtcattaattcatttctggcacctttatctgcaaaagaatttaataaacaaggggtctaatggctatcatcttggcatggctagaattgctcaatctgataattgatttttttggaggcaaatttatatgaggaatagttatatactgttaagaatataaacctgaaatgtcaactgtttctcataatttaaatttttacatttaaacaattttaaatttgctaaaatgcctatctaaaattcctagctgtgtgttatgttctcatatcctaggacagcatctaaagatagaagacaaattacctggtaaacatgccatgtattattattatttttatttcctttcctaagattacaataacttgaatttaaaattaaactttaaagaaactatctccaggtcaactgcatagccctaagagaatattagcacaggaactaggaggcccaccttggacttcaggttctgtgtctaaattttctgtatggccttcgataaaccatttggctgctctaaccattagcatccacatttggtcttataggaatggtattttctgacctatcaaaggtcttattcagtaggatgacatttattgcttccatgcctactgaaaatccttcctttccagtcacgtgggtaagcataaaatgatgaaggtgctagtcctgctgacagcaggcaagaaaataggcaagtacgataataagcttagtgtgcagaaaaaccacccaaaaatgaaaatgctggggccaaaagcccagaatctgagttgacagattcagtgctgagctctgatatatacctttctaatatgtcctccagataattctaatgcagatagtccatgagctacaagaaaatttcctaagtgaaaggaattagagctgggtgctttgaggtatacaggaaaaaaacacttgattcaatcctaaaagcctgggaaaggttttggggaaaggtgctggagaaataaaaatttcatgagcatattctgggtacaataagtgtaagattggggaaagtgttcccagcaagggaacctcatgagaaagggagcccttggggactcgaggcaggtgagtttagaaagtttaagaggcaaaaacaagagatgcagtttaagaagttgaaaggaaactatcacgtaggactttttttcttttcaataaattactttttgaacacatgtgcacagaaaaaaagtgtgtaaaaagaataaacaatgaaaagttttccttctgtcctctccccagccacccatttcttttttggaaggcaaacaccattaacagcttcttgcgtgtctttccagagatgttaaatgcatatgcaacaatgtgccaagacctattctccacactcctgttccagtaaattaaacagtaaggtatactatgcacagttcagcatcttgcttttttgacctaatgtattttggatattgagcacatctcctacttctttgtaaacactgcatggtactctactatgcacacactatgatttattttaccagttacatgctgatggacaattaagttattttcaatctcttgctcttacaagcaaaaatataaagaattagctagtacctaagtcatttcaaacatgtgcacatacgttgaattaaaaaaaaaacagaatttttgagtcaaagggtatgagcatttaatatgttggtagattctgaaaaaatgttctccacagaggctgtaataatttgcaatgtcatttgcaaagcataagcatgactgtttccttcctctcaaaaaagcagttagactttatctttggaacactagagcataaatcaagggttttaagagaaggaacgctctgattagggttacattttagaaagctatattctacagcagtgtggaaaatggatggattagagataacccggtgttgattatgtgggagagcaaggatttttactgagcacgtattacatgtcagattttctgctaagcacttacactgcattatcacatttattacctataaccacactaactgttattactggtttcagacaaagacaaaatgaaacagaggctcatagttaattacttgtccaagtacatgctggtagtagcacatggcaaaaccgggattcaaatccaagcaagtattactattagctcagagcaagtggttttagccactacaataccatttgggatgcagagaagttgatacatttgagatttgtcagaggtagaactgacagaatttggtaactgaatgcatgcagagcataaagaaaaggaacagatcagcattatccgtcgagactgggaatctaagatttacagctggaaagcaaggagtcggggggtgacttttgagtttgaggtgacagtgggagatatctactgcctgggaggtaggagaacagtctagtctggggaatatatgggacttcaccagtgtacagacactacgcttgggaagtcaccagcatggataggctcatctacggagcaacatttaaggaacaggtcaaggatgaggagaacatgaaagaggtgaggaacaaactaagagataagaagacaggaaggaaaacccaaagaaaatgttatctccaaaccatatttttaaaaaatcactttgaactactttacaaataaattattaatacccacttttttatttataaggactctcatatactgtaaaagtaatattcatgaaatagtccccaaacacaggaaagaataggttactggaacatacccaccaacactgtcttgcacaggtgatagtcctggggcaaatagctttctctagcctggctgagagtcttgatacatttctttaaactctaataaccatgcagaaaagtgtcaaattgaggatttaaaggcaaccgttgcagtcccaggagagtgtctgggagtgattcctgtgtacctgacataactcagaagcaggagagctgcactcaatggcagggagaattctcccacaccacctcgtataaatctacagagggctacgcaaaggtttatgtgagctgtgtgtccaacatgtgttgggaaatcagtcttgttatattttccctgtaaatccttccaggagtcctctaggtttaaggaggaccttcacatttggaatcgagaaatgagtatagattttctaaaactgcctagactgtgtaatatgtagttcatacaatagatttgaggggaagaatatgtaggcactgtcagtcaattgatgggttcagactcaagaagctccaacaggcccaccactctccccaactccctcataaggaaacaaaaagcccaaaaaacaaacaaacaaaaaaccctgtttttcaaagggactaagttctttaaatgtggctgaccaatctctgttgcatatccatgcaggatacctgcatatccgagagagatgagactgatcttattttgtttatataaccagttttataaataaaagacaatatcttttatgttagcataccaaattccacttctgaatacaccaaaactaaaaactaagactggaccaaactacagaatctaaacaccttttttatgtgtttaaactgatctttataggaacaaaagccttgaaaattatatacataaaatggtaacgttactaaaatcttctgaaaacaatgaaaaatctagtgtgtaccagatttttaagtcaaattaataactaatttaaaaacagttttaattattaaaccaaattttttattttatcaacagataaaaaacaaataatcatttctaagctttattagaaatgtcttaaattcaatattcctccatttcatcaagttttatctcaaacattaattgcatatcatcctgatcataacaaacagttgccttgaataaagactattgattatctaggatgctccaaatcaagatttgattctaggcattttttgtcttgtttttttttttttatttttttaagtaaattctactaatttctaagtattagtcaatgaatatctgatttttaaaaataggtaaatttaaaaaaattacatcaaatacaaaataattttttaccatttaatatggggatcgtatgtggggatcacatacaagtgcatgcatgatccacagtacaactttactgagcagcttttcaaagtacataagcttttgttttttacagacccttaagaagttcagaatagtgaaatcggtttttatgaagtagaaaatagggattttctaaccaatctaatactcaaaacagtaactctaactttgtgacagacgctatttgaacaacagtgacagggagctcaccacttaatgaggcagcctgttcattcaacaggcttaagggtgtaaacattttccttaactattatacaaaaatctgcttccctgtacatctagcaatgttgttcactctggcttctgtaacgatcccaacttgctccccattgtcactaaggtggtcactattgatgtcttccatgctaagaatttattttttttgaagtaaaacaattccatttcctccagtcactcttccacatcatggtttgaaaagttcctcatcaattcctgctccaaaaggaccactgatcatctctagcaggcctatagaccatttcattcaactataaccatagctctatgtgtagggttatcatttctcatgagttaaaaactcagctgctatcaatgtaaacatacattataagtatatataccttgaacacatcattgatacatacaaatttgtttccttttgaagtttaccacaaagaatggtacgatatatactatatatatgacataaattttaattatgatatatttagcttgtaaaataatgtttaatttaccagtttttcttagagtaattgggagaaatggaagaatgcaaagtatttaggtgtggtagggagtttactgaaaacataatactaatctaaagttttctttcctttcacaggacttatggtctgtttctttctgcacatgagatcattctctttctctgaagaccagtcttctgtgatttgaaatacaggtagccagcctatccctgcctttatgtggtcattcttgtctacatcaagtactatgttgagcctctacactcccagcttccaagacctgggacacactatttcattttatcctaggtctccacccatcacaggtaatattagagatgacaaggattgcataactagcagctcatgtgtatgcactgtaggtacaagttctccaaaatggtgtggacaagactgtgggagaaaaatgcatcagccacacaggcaacctgagaggtgtcatatttttgaagcacgtgtctatcagctaaaatacagtattgaatacagagataagattgaaaccatcatagaatggctacactctgaaccacccattgaagtcaggagaattcaacatataagaagtccttctaatatctatacatcagcttatgaggcatttatttgcattcacaagaccaaatgttgaatgtggtaccagaagatatgaagcacctggatgtctttaaagaggtatagttgctgtacttctaattaagtcttctcagagtactgaggtttgctgtcatgagagtaatgattttctttatcatgcccccctagaatgtcagtatgggagggagaaagtataatttgcattatttcatatgtcattacttttattttgcttatttatctttacataaacaatgaatcataaaaacaatgaactatgaaaacaatgaacatttgacataggtggcctttgtggtcttcagtgaaatgtatgtaacggtgattcacacttaacaactcagtaggagtgaggtcatagtccattaaatgcattcccttttgtccacatccttaccaacacttgttatccttcatctttttataatagccattctaataggtgagaatgtatctcatgcttttgcaggaatacactccccccttttttccagtatatacttttttaaaagctaaattttttattttaagtgacaaataaaaattctatatatttattgggcacaacatgatgtttcgaaatatgtatgcattgtggaatggctagattgagctaaataacatatgtattacctcatataccatttttttttttttgtggtgagaacacttagaatctaacctcttcacaattttcaagaatacaatacattgttcttagctatagtcaccatgctgtacaataggtacctggagaactaaacagatcaaggaaaaaaatgaaaaacgccattcaaaagtgggcaaaggacatgaacagacacttctcaaaagaagacatacaggtggccaataaacatgaaaaaatgctcaacattactaaccatcagagatgcaaatcaaagccacagtgagatactgtctcataccagtcagaatgggtattattaaaatgtcaaaaaataacagatgttgccaggttgtggagaaaaaggaatgcttatacactgttggtgggaatgcaaattagttcactcctgtggaaagcagtttggaggtctctcaaagaactaaaaatagaattatcattcgatccatcaaaccattactggatatttacccaaaggaaaataaactgttgtaccaaaaagacacctgcactcatgtttatcacagcactattcacaatggcaaagacatgggatgatcccaggtgcccatcaatggtgaattggataaagaaaatgtggtacatacatactagggaatactatgcaaccataaaaaagaatgaaatcttgtcctttgcagcgacatggatgcagctggaggctattatccaaagcaattaacacaaacagaaaaccaaataccgaatattctcacttataaatggagccaaatactacaaattaactcaaacagaaagccaaatactgcatgttctcacttgtaagtggaagctagacagtaagtacacagggacacaaaaatggaaacaatagacactggggattccaaaatgggtggtgggggaaagaggggagaaagtgttgaactattgggtactatgtttattacttgtgtgataggatcatgagaagccaaacttagtatcaagcactataaccatgtaaaaaatatgcatatttatctgcagaatttaaaaacaaaaaaacaaacaaaacatactttgaatttatttctcttattgaattgaaattttgtatcctttgaccaatgtctcttcaatgcccaacccctgcctccagctcctgaaactactaccctattctctgcttctgtgagttcaactttttaaaatttcacataaaagtgagatcatgtggtatttgtctttctgtacctgtcctatttcactcaacataatgtcttccaggttcattgatgttgttgcaaatactaggatttccttctttttaaaggccgaacagtatttgattatatatgtcacattttccttatttattcatccattgatggacacttaggttgatcccatatcttggcaattgtgaacaatgctgcaacaaacaggggagtgcagagatctctttgacatgttgatttcatttccttggtactaatcccagcagtgtgattgctgaatcaacagcagttctatttttcatttttttttttttttaagaatcttcatactgctttccataatggttgtactaatatagattctcaccaacagtgtgcaagtgttcccttttgtccacatccttaccaacacttatctttcatctttttataatagccattctaataggtgagaatgatatctcattgtagttttgacttgcaattccctgatgatcagtgatgttgaacattttttcatatacctgttggccatttctgtcttctttagagaaatctgtattcgggtcctgtgtccatttttaaattggattatttgttctcttgttattgagttgtttgaattccttatatattttgaatattaactccttaccacatgtataatttgcaaatattttctaccattctgtaggttgtcttcactctgttgattgttttcttttctgtgaagaagcttttcagtttgatgtaatcccacttgtttatttttgctttttttgactgtgcttttggggttgtattaacaaacaaacaaaacactgtccagaccagtaacatgcagctttccccctgttttcttctagcagttttagagtttcaggtcttgtgtttaagtctttaatccaatttgagttgattttttgtatacggtgtgagatatatatttttttgccctacctatgatattttcccctcacattgaaagcttatgttttcgaagagctcattaaaataagaaaataaaggaaaatatttgggatctagggctaggcaaaagtttgttagaactgactcgaaaagcacaatccatgaaagaaaaaaattgataaattggacttcattcaaatgaaaaaaaatttctttgtgggagataatgggatccttgatgcaagaaattcttaacctttctctgaagaatttcctaaacagacaggagccaacttgactatagatgcctgggaaatggcgagaattgcagcctatggctgactgatacttggatttaaaaagccctgtctttgttgcaatacatgttgtgctccagttactgccctctgggaatgctcccgaaccttacagaaagtcagcattcagtagcaattagagttctcctttctagagaaccacatttttctatcctttcatcacaaatataagttttccatagggattgggttttacattaattggataacaaaatcaagggaagcagtagaatgttgctttattgaataccagcgtccttatagttgggttgggaggaggtagaggtatcagtatttcagtcacaagacttcatttcatggtcatggattccaaacagtgccattcaactctgatagcaaatattgtgttaaaaacaactgtttatttgatttttgtcacattcaaacttctagtgatttaactttgttcctctaagctaagtatctcattttgtccaaatgacctccctaaatgtgcatgtggctgtgtgtctatttccttcattccatgatattatgaataactctaaggtgtgttaacagtcatcatacagaaggaaattccacattaattgttcatatgttgcatcaattcacaatggcatatgcttactcatattatacatgtgcctttcttttccaatatcttaataatcttggagtctaattctgtatgtattcaaaggctaaaatttttctgattcattttggtcattgctattccataaatgtcatttgatgatgtgttttttatgattcttgcttgtaattttaactcctttatccattttaacaccaactgcttcttttctttttttttttttcggagacggagtctcgctctgtcacccaggctggagtgcagtggcacgatctcagcttactgcaacctccacctcccgtgttcaagcgatgctcctgcctcagcctcctgagtagttgggactataggcgtgcaccaccacacctagctaatttttgtatttttagcagagatgggatttcgccatgttggccaggctggtcttgaacttctgacctcaggtgatccactggccttggcctcccaaagtgctgggattacaggcgtgagccacggcgcccagccaacatcaactgtttcatttgcattttttaatttgttaatttcctagttttgcatttgtttttatttctttaattgattcacatatctcaggatattaaacatatcctctggaaagtcagctggaaacttcttagtactttctaacgtttgagtatgttatagaaatacacccagattgaaaatgtgacgatctcttataaaagatttgtccatttctgctgtctttaactgtatctcttgatgtatgacagggaatcttctatttttaaggtggtatttgtttcaattctgtattacaatataatccttccaaagacattttaagtgacaattaaaaatccaaacgtaatttaaaatttagcagtaggcattgctgttaacgctaataatttcagccgaagtgaaaactgattgaagagatgccttctatacatgcctaagttcccacacatagacaatgacagccactgtttgggtgctcaaaactatcttttaacttagattcatgcatttattcaacaaatattatttacagcctaataatgacaggcattgacctaggtattgagaaaattgggtgaatataatagataaaatattcaccatcattgaacttatgttcttcaattataagaggcactcagatttcggaaatgataaaatgtggagaaatatgtaaaatatgtatctcagaacaaagaaagatatgatgtagctttagggttctttcatactttttaaattcagctatttctaatgcaattaattttattcaaacttgtcctaaagagactattttagtatttgcttatgtttcttgaaataatttttttcattatattatttctaatgcaaaggaaatacttcagttttatgtaacaaatgacatcagactttcttttcttcctccattttttccttctataaaataaattaacagaggcttttcataggatagtctatttattttctctgtgctcatgtatgaagaaatatatatgggtggggtgagataggaggagtgtacacaggtatttataatgatggacctggaaagggttaaaacaactcccgtaccaagccctcacttccaagtgaggaaatcctccaacaagcattgccctagaatacatttaaagaggctaatgaaaatcaaacacaacacacacacacacacacacacacacacacacacatttaaaatgtatgtatacacatacatgtatacataatttatatgcatatattatgtgttttgatacatatatatttcaaaaagcaatgtagtaaattagtagcttatttttcatatgagtactaccatatcgtatgttccgaactcaacataagggtcactactgatggcatttgaaaactgtcaagtcagaaaactctcaggtgtaaatgtagacttaatctctgatgttcatgggaagtgattcatggctagtttttacattacaccaaggagatgctttataactggatgctgacactttatatattaggctataatcaatattatttgctacatgctctgtcactgaaataaaaccatgattgttctgcaaataaagttttaattaataacacaaacatccctgtttcaaaatgtggtaaccctgtatatcccataacacaactttactaccaggtataaagatgaactgaaggtttaaaagtctaaaacattgatatctcaatggtataacctgagtctgtgtattgtttttttaggcatacaggtcatatattgtagaagggaaactgaactcagttttctaatctgtaaaatggaaataacagtacctagcctgcatagttattagaaagattagatcatgtgtgtaaagcacacagaatttttgggctcctcctagatttggagaatggtaatctgaggttgagtattgatgtccataattgaattagtgttaacctgtgcattttaacagctgctgtcaatgcccataacacagagacatttaattgctaatccaagtctatgcaatcacttagctcatcactatctaccagggtagaactggcagtcaacaacttctgcaggattgaaaagaagacatcactggagcccactgagaccactggtctccctgcttataggccctttgatctttgattcatctaccaaactgagaaacacccaaattataaatctgaaaactttctagtacctacaatatggcatacaaaaccattcacaaactggccccaccccaactttaagcctgctccatcacctcacttacacgattgtattctaattacacccctaaaatagctcttatgacattgcgttatagttaatcaggtgtctaatccccatctagccctttttagggctgtacctcaaagtatgtgtttgcctaggggcagtttaaccagtgtatgcctcttcatatcttccaagataatcacacttgaaaggagtttcagctgttagcatctttcacagacccctcagactgtcagcagtaagatgaacattctgaaattaagttttaaggatgttcagaaaagagaagtaaggtatagagcctccagttcctccaaaactctccataagcaggtgtgtccaggacagccactcccattgcactaaagcaaatgacacatcttattgtactccttgtgtcttattcctttttgtatgcatggtaacttgtatagtgccctttacttattaggtgaaatttagattaaataattcctttccttctctcttcttcccccacccctaaaaatacacacatacagaatttttcaacttaaagctacctctctgtgacagtaaccaagtgaaaaactcagattcctatgggaacctagggaaaattgaacaagacaggcttggtggatactgagatgacttggagaacacacacttctgcaaaaaaggttattatctcactagctgctatcagctccagcctactgttgttgcatgaaaatggcaatttagtgtggtttctcttcctatctgccatgagaagtcagatatccagaatatttttgggaaatctggtttttatatgttggaaatttggtggttgtttgtttggtttgttctctgtaaagcattgtctaagtcaaacagaatgtacttgtaagggatcagtttgaacctttgctttagagctccaagactgggcagtctctagaaatcactactgtgcattttagcttgaaaagatccattgttcttccaaaagactaggatgctgttaggacacagccaggctgttcatgggtgtgctacctgttcgtatgaaagaaacttggtcagtacctgcctcacaaaattatgactttcattttatcagcaaggaagaacttctgcactgtaaaagcttattaagggaatttgattgcaaattgaatgtggtccagcacctctccaaagctcatttaagatatttgatattttagagaaaaagcctaaatgggcatgttaactatccatttacctgcactattctaggttctatcattgaagtctcagaccatcagaaaataatgtcttggaccccattatctcagtcaatcaaagacaagacttctgagagatgactcaataccatgtcatttgatcttacagaaggctaatataaaaaaaactgtcatgtttaagagcatagtttgaaccttttagaaaactggctggagacacattctaccttgtgtcttagcactgctttataatggatatataaagcagtgtaataaattccaggaaaatagttccaggaaagaatgtttatcctcacggatgcatctatatatgatgccttaatgggaaacagtttcttttccttagttgccaggacaaacttaaaaagctacattaagtgagaataagaatccgaggtttgtttcagagtgtttgaagtccttactaatccttcccctttatttgtttattaaagttaacattggctttaggttttagataactaggaataacccaattataatagtttgtttttattctagtgatatgattctgggtaatcacaatttttaaaatgtatttgctccattttctataatattggtttgctttgttacaaatacaatttttaaaaatgaagagaattctatccatatcatagatttcagtgggtatctgctttcaaaatatcttcaccatcatataccaggactttaaattttaattttagaagtatgttatttgtattttaaatgcatattgcaattcaagaattccctgccatctatttgtttatcatatgtttatcaagtatgtactgggtacccagcactgacctaggcactggagatataatagtgagcaagttagacatatccccctcccttcaggagctcacagtctcattgcagcagaaaagaaaccaggtgatgaaaacacagggtggtcagtggtgtgacagaagtacaggttaggtcacttaacatatactgggcaacagagaggcctttccagaggttgcccatgacatgaagatctcaggcaatagtgggaaaggggaaaaacctttaggcaggaggctgcagactctccacggctgcccttctcattgtatccctggggccttgctcagtgcttggctcatggaaggtactgaaaacatttaaaataaataaataaatgaatgatgggacagcatatgcagaggttgagagccatgggcagtaatcggtcctttggaggaactgaaaagggtatggtttggctgagttgtagagtttgaggtaggtagaaagaggcaaaataagactagagagacatccaaagctcagttgtaaatgagccttatgaatcatctaaataatctgcactttatcctaagagaaaagagaagccatatgtgcttaaataaataaaacttaaaacaaacaaacaaacaaacaaacaaaatccaagtccccttttctctttcagcaacttgacctttggttaactacctggattcccttggtaatttgataaagacagaatgtcaactaagtctcaaggtgacattgctgatagcaaaaatgacccctcattggtaaaatgcatctggactaggagagtctataaatgaaccataaaaacccgatttcatagctttgggcttccctgtgagcagggaagaaatcgttgcaagagatataaggctgttagcaagatgacttccatagatgaactgctggactgttgcatggactcctgatgaggaaggcctgctgctgtggtgagctatggttgctgatctctgccctttagagtagacaagtgccaggtgtggtgtatggtcaccttgtgaaactgcatgtttaggtgagcctaacaagaacccctgacaggcactgcatcattgaagggttttaagtagagagttaacacaaacagacttttatgggatttctttagctattgaaggcaattgccccaggacaggttactgaaataatacattaaccagaattattaatagagttgctggaataaaacggaaacctacaaagaagggaggaaaaagcattctccttttaagttttacctaaacctaaatgttctaagcccatcaagtgggacttacaggaatgcaaactgctttccctatcttttggtgtgtggttcatctgccacttaatggagaaaacattaatctggactggcaaataagaaccaccagagggaatgggcgaaatactaaataaagaccaccaagccattttcagaaagcagcaactattgaaaagagtcaggtgtgaaatactatctcaccccttaactagctgtgtgactttaaacaagtcattaggcttctctgagcctcagttttcttggcaggaagaacaaagggctcagactcaatgacctgcaaatgattctgactcaaagactctatgagtcctgtaatctgagtaccactcatatgccaagtactaggctaagttctaacacccctcctgtcccctataaaaaaaatgttcaaaatcaggtaaatttcaaatgcctgtaatagaaagatcaagggctggggccaacagctggagtaagtctagttcagggttgaagtaaggacttcattatgtctctgcacccaaatgtcagcctgtttaacatgataattgcatctatcactgaaactttatcatatgctttggacccctcacgtggctggtactacggtaggctctgctaggtgattaactatcagaaattacccaagatagctgcccacatgtctggagtacttattgcaacatttgcccaccataaactcttagtgattgcagctgattgacagaattaatagagataataaatattttaggactcccatattcttcaactaccttgaagtaagacataaaaatccagcataatttaagcctaaaatctaaaacgaaataatgcaaagtgaaaataataatttcatttaaaaaagcttgtctccaagaacattaagcactttcatatcttcaggggccactaaaatgtattgattgagaatgcaggagaaaacctctgtttttacaaaaagttttgaagtaggaaattttagtgaaaagaattgcgtgtacttctaggaaatctcatcatgatctcagtgtaatagccatttgcaaaagagccctgaactgagtccatgccagggagcattattggaaaatggcccactgcagctacttcctggaattcctcttcgtgcttcagcagctagcttggtaggcactgggcaccaaacagaggcacagcatcttacagagcatggggaaactcattccaggatgacacagtttgtgatttgtgacttgagccttgaaacaggcagaagacaacagctcacgttacccaaatcatgagataagccttaaaaaaaaagtacaactaaaagtggccatggaaaaaaaagactgaggtaattatggcaagtatttattccaaacagccacaattttatagtgggagttcagggatgtatagaaaaactaatacagcctctgttctcatgagcctgcccagcactttccaacctgcattccatggcattgtagtatttctgagggaattacataattgcctgattcaaattttctttttaaaagatagttataattatttgttttaagcaattgtttagctactgttaaataattgtgattaaaaatgcaaatcttgtgtattaaatttaataaacttggaaaccataaacacattgactgacttatgctctcaaacaacagtttttgtgcagattcaagattaatctctgtgcttatatttatgaatgtatcattgattagagagcgagagtgtgtgtgtgtttaatgttagtacttagcaattttgttcatgtaaaattctgtatgcaagtgctatggaagtactctttctgctttcttctcaatcaaaatattttcactacaatgtaaccaaagcaatatactaaaatgaagtagatcttgagaccaaaagtttatatgactgtcatccatctaccttaatttcaaatctcataattcatcaaaatatttactatgtaaattattggaaaattaaacaattaaggtaagagttttctctgttttgccagttgtttcatttttacaaaatgttcagatgcttatgaaagttttaaaacagcaatttggattctttcttaaacaataaaatgaatctagtcattggtaaaaattagaaagttctgtgctttacataggagatggaagatggaagttactgatgaaccttagcattaattttctgacattttgcaaattttcaattattgctgtgtagaagatcccatatgaagatgaaaaaatcctaactcacttcgcagagcagaaattattttgaaatacatttctgctattatgcaacaacatgtatggagacagcacacagctcttacctctggcaataagaaatggaaaattttggagcttgtgatctaaaattgtactttatattagaaaaattccataaagatttacttgactttttccatgtctagatttgagaaaaggaattaataattttgaattactgctatacattaaaataatagattaaaacatttaaaattttataattatggcttgtgaatttgagaagacgaggattgggcaaggaggacagggaaagtgagactatattcaatgcaactctgaagggaaacctgccaattgtaatatataaaatgacttatgatgccttcaccctcttcatacagttgttataactggagcatctaagtgctttgtaccattagtcactcctgtattgcagtttcattcttacattttgtagtaccttttatacttgtgatttatgcctacagaataactaggaaaaccatatatgttttacatacagattccagaaagagacaactcggctaagtaaagttattttttaaatccagttctgtaatggtgttacaggacacgtggttttccagtaaaacctactcctgtagttccactttccctgcatagacttcttccagggctgtactgctttcttaagctatatcatggtggaatcctatccttcataatgttttggagaaggctgagggtggcgcctgcacaatttgatttggtgtaaaaatacacaccaaatctgatttctgttacattaaggcattctctgacaaaatatacagaacaagaaatgaagtgaattgtgttttagaaaaatcttatgggcttgtttccccgaatacctgaccgctaatttaaaaaaaagaatcaaaaacccactttaattgaatatttaatagatgatttaatggtcaagttaagatacattttaactgctaaatataaaaatgatttgtgtttgcttactggaaatatttgtaatataaactaacatatataataaactaatatttaaagcaaatttaccatgaagaaatgcaatgactattttcaatttataaacatcgtacattcatcaaactatatttttgactaatagttggcttttataatattaatatcataacagtggattgccattaacagtagagatagtttaactcatttttaaaatgggcaatatattttactttaaaatgaaccactggaaatataaaaatgataatattctcctatggaaaggcccaaatgtagctagagtaaaatatatcattttttataaataaatgagtttactgtcttgtaaattccatcctctacataatgcctcatgaaatagggtgatttacagaaaagaacctgggattggcaaataggatggggcatataatccagtctagtgccattctccaacaagttgtatcatcatagtaaagctatgcaagtgtactgtaccttagtgttcctctcaataaagtgggccaagaattacttcatttgatgtatgaaaaaagaaacaaaaaagatatgctaaaattttttcaaaagtaacctgttgtatacgtagaaaaggcatgctaatcatttgaaaataactcatctaatttgttttagtatctaaaaatagtggtaaaatagatattccagggtcctgaaattgctgtttcttcacagtacattctgaataaactttagttcatttggaaaacttgaaatatgaagtccctgaggaaattctgaaaactcctttgcattcctcagcattaaacacaaaccactatggtgtctgatgttaccacctggagacctcttgatatttttaccacagggaaaaaaaagtgtatcaaaacatttctttttcttctagcattataggaatcccagacatagggcaataaatatgttactgatacccacaggtgagcaggcaattctgccctgtgttacaggtactttgtcatcaccttctgaaacactgtttcacagtgcagggtatgttatataaaaaataaatgatgctgccaaatttcagcagttggaaagaaacataagtcaatggcataagggaagtaggtgatgtaatgactctagaattaagtagatggcttgaagagatggatcatgaggtttaacctttgaaattattcattgaatattaatataaacacaaggaaaagcacacttctaagttgctttgttaaaattctattgattaaatcaaatttttttaaatgacagagagataatatatcctattcctggaaaatgtctaagaacaaacacctaataatctggtcttacttaatgtttcagttaaggatgtttgtagagaaggaggttaataatgtctacataattacacaaaaaaggaaagggaaaaattgacaatgaaacccaaacttgtcaataaatggtaaacgattacagatgaataaaaggagatgaaaaatcggaccaaatattaacttatacaaattggaaaagatttaaaaactgattcaaagaggatgggtgattgagataatgaccaaccataaagaaagagaaataacctcaaatgggcatgaagaaccacagcaactcagaaggtgttactaatgagatttgaaatttgatgatcctaatgggcatttggtgttgtttggtctaaaagcaaggaggcaagctttccctcccctatgtaatgtcaacaaaatttcttactccatgtaggacatggagcactaatggttcatctaaacaagctacatttatgaaggcagaaaaaaattataaaacaatttaaaaaattaagaaaaaatactgctctacaaataaaacactaaatagatacttggacaaaatttggacacagggtttctttgcacctcctgcttttgtcagtttctgctttgcactgaaagtgtcttgcatctcttaaaataattttaatggtctctctctttcagaaaaaagctccacagcagaaccttttcattccaggtatctcaccttctgaacccagcttggagtatccccattcccatgtcctgcccacaccaaaatcatcccatctcctgaccatgccatactgccctgccttggtatctgtccccatgttattccctttgcctcaaatgcccttcttgcatcaagccctttccaactagtgtcagttgggtctcaccagaagcagattttagatgaaattagaaatgcaaatgtttattgggaagtaacacctgtgaaagaaaaagggcaaaagcagggttgcgtaaattgtgaactttaatatctcattcacctcccctaaaaatcatttactcttcctctaaaagtgcctacatcccccacttctctcacccctatgaataaggatatataagtttttaaatattattgggtgtattagtctattttcacactgctataaagaaatacccgagactgggtaatttataaaggaaagaggtttaattgactcatagttctgcaaggctggggaggcctcaggaaactcacaaacatggcagaaagtgaaggggaagcaggcaccttctttacaaggcggcaggagagagaagcgcaagcaggggaaatgccagatgcttacaaaaccatcagatctcatgacaactccctcactatcatgagaacagcatggaggaaaccgcccctgtgatccaatcacctccctctcttgacacgtgggaattacagatccctccctcagcacgtggggattacagttagagatgagatttgggtggggacacagagtcaaaccatataattgcgctattgggtactcactttcctgtgatgcccccatgcatataataaattggtatgccttttctcctgttaatttgtctaccgtctgtctatttcagcagactcacttatcaaagctccaaagggtacagagaagtttctcttaccccttcaggctctatcagcctaacagaaactctaaagcaaagaatgcctgtgaaaggaggtcaatatgggccagaaatggtgaggccctggtatcaccatcatgctcagccatcgtcccaagaagagtgtgatctctgctccaacgctgggtcagatattaaaggcactaacaactggaagctgtcagatagccatattcctcacatctgggaaaggagtcctctctttaagagggattttagcagtacgtctcttcatgtctgccacaaaattattctccaacacacatgtgaatgtctattcctatgtgaagcctctaaaattcattcccaggcagttggtggctctctatgcctttacagtaatgtgaatgttaatttctcataccacactgtgtcctcactatttttacaaccttttggaaagtagaaaccacatcatattcttctcagatttcaagtacatagcttgggaaacagagcacctaataaaatatattcaaaagaggtagagtgatttgatggctggacttaccagctggacaacagaccagactggttattgcctattctggtccagagatactaagagatatacctcatgtatgtgaaagtgaaagggtattaagagttctcaaaaactgatttcaatgtactttaaatactaatggactattggactttaaggataacatgtatcaacaattagcatgttgtaagccaaagttttgaaattatgttcccaatcataaatctaatcaccatcataagtagattacatgaacctatctgtgtatctctttccaaccattattctcacttctagttttctctttcaatttacagattgggtaacagtccatctaattttaaaattctaagatgtactgtgtttattctgtactgtaaaataatttaatttcagttgtaaattttagagttttctttgatgacctttttaggcaaggcttagtagttcagtaacatatactcttcatttaatcagccagcaatatttactctctgctaagcccaaagctaagctgtgaggacataaagatgaaagtgaatgaataggataagaagccccttttctaatggtggagacagaatggctgatgatttactacatggactgggaagtgctataatacctaaagggtacacaagggaaaaagcaaacatgggagagaaagaaaaggaacttcttgagttagtgtgactttctcttttggtttcatctccttctgaacttttttaaaggggagcgggacagaaacaaagtccttaagaatgtctagaatccctttctctaaggcagttctcggtagggttggtactgccccctagggggaggctttggaaactgcccaagtgagggactgggtttctcaatgattgtagagacactttattggcatttagcagtcaggcaccagagatgccagatggcctgcaatgcttaggaacgcctttcacagtgaataactgtcctgcttggttttcaaatattccactggtcattcatgaaaagaaaagctttgtatgtaatttcccaagtccagaacataactttgttttacatataactatggaggaatctttcaaggcttttaacatactttgaattttctaagaaggccactaccttgtatattaaggaatggccacattttgctactattgtccagtgtcaagaaaatccattttagatacccacatcactgacagaatcaccacacacacagatatatgcatcaatagcagtggtcttatgtataccacagcatattatataacagtatgttactatatctttcagtgtagtcatgcccaggattttgcacataatactttactataagttacttaccatttatttttcctttaaatgttatataaatgatgtatgtaggtaggttataatgcttatgaatttcattttaagattttcaagggagcattacaaaatattggctaggattgagagcactgagatccactacgattactttttttaaaatttcaagactgacctcattctaatgagaagaaacatgtgaggctggaagtttatatagaccatgttcttaggcatattcagttaccaaagagtgtttttacattgtccctagattggcagggctgcctggctggaggacagatattctgcacaaatatacataaagggcccatgctcatctgtagcaggtaaaagaaagaactaacaactctcctttgaattgtcttcatttcttgtagcttattctcagggggttgaaaatgaagtactctgccttggttttgccttcaaatacttgtcagcattaatttttcctggtggttctctagacagatatattgctcttgaacaaagtagataaatttgaagcaatgcccctggactaacacttcagaagaaaaccatcatccttataatcaccatttccattctctttctagtacagacaattaacatattatttagcatttctttcattctgccttggaccagagttctttgatagatgtctgtcattgtcatttattacacatccactcactcaggcaacaaacatttaatgagcacccatcatacaccatgtggtccatttgctgctaggagcacaagattaataagttccaacttttgccctcaaggagttcacagagttgggaaagaaaggcaaataaataagcaattagagtgccaggtaatatacagtattttagaaggttataaaaggagtgtagaaagtaatataaatgaaaatgtcagcacctaacattgaaccttagacatagtaagtgcttaataagaaatgtttcgagttattcaaattgttccaaggctgaaaattgggcagataaattgaagagttaaaatggaaggataaggctccagctagcaagatgactgacattctgatgggaatgggatattccaagggcactgggacaaatggataatttttccttcagccaccatttctctagcaattgccacatactagacactgtgctatctgctgagaagacaaagctctctaaatcagttgtttttctctaaaggaatttagtccctctatttaccaaaattgtttttagaactatgaatacatatccatattggctgacagaattgcatttgatggaggaactaatgtcacacaaattcccaggctcagaagtagaatgaatcattagtggaggctgacccaagccagccatgttgcaaagagggctctgtgtcagcagcatgggggctactgtaagagaccaggaatgagccagaagtccatagggaggtgatgagtcagaacacaatatgtgaatccaaatactgaggaaacaatgtttgaggcagcggctccttagaaacttctgtggataaactgtaactgaataaggagtgaggtaagtttcaggcaaggctcaggtctctaaaaatatcaaactgaaatcagatcatgacaaagtgagcagtcaagagtgaaataactatcactaacagagtcttctggggggttacaaactagattcattcatatgactatttttaatttcctgtgagcttgctgtgtgtacatctcatggtcctaggatggtgactctcagataacacgaatttcagtttgtattcacgaatttcagtttgtattcaagactttgtctggatgctaaagaatagcaatcggctggtttccctccactgctccttcttttactaattaggaattggctgaatcttcagtacaaactatctcactttccatccattcacccatccactcaataaacacttattaacagcttctaagtaagagatcattttaggtgatgggaggaaaaaagataaatagacctgatccctgtccttgaagggtcagtgtcgggaggtcagtctcagcttcggaaacaatagtgcaaaacacattgacttcagtgacagaatctagatcactttttgtcaataatttaaatgggtatgcagacaatcatagataaagtggtgcctgcacgactgttaccaaagaaatatttaactcaattcctcgatcagaccatctctgggcagagccaggctggcattctgactgctcatgaggaaaaaagatgatgaaatattccagtttttcatatgccaagatgaaaatcatcaatctcaatctccgtgaaagataaaactacttttagaaaagagcagtgaactcttatcagtctttctaaggtgatgcaatctttaagatgatacagagagggcagaaacagtaaagaagtttagaagaatgtatatgggcaaaagggaaatgatgaaatttctctctcaattttataaggagctaaaaataagatgggatatattttaaacctaaatgactacaatgctttttgaaaagtaggtaatgtattctaggtgctaaattatttatttgcttatcatatacaaatttgtctttaacacatgaataccttgatatttaaatgagattgtctattagataattaaaattaatctacacaaatgaagttttaaatttcttccactttttcccctgtacccccaacccttattcctttcaactcgtatgtgtatgccaaatcttgtacatttttagcatttaccagatggctttttcggttcccaaaaggaaccttttaaatttttaagcaataaaacttatatttctgttaattcatattccaaataaaagtcttcaatattaattacatctttattggaataacttacaatgctacaccccagctttgcagagactgcatatccaatatctgttaattgatttcttctagagaatcttttttttctgttgttatgacaaaatgttttgctgtcttgtaatcctcaactgggtaacacatttttctgtaactgtcatacagaaggcacttggtaaatatttgctgaattaagaaatccaaaaggagaattgtaggtaattgggaagcaatgtaatacggtgatgaagatctcagatttcaaagccagcctgcctgagtttgattccccgctctgccacttgttggaaataagacattggacaaattatttaacttctctgaatctgttttctcatcaataaagtggatataacaatattatctgttcctatagcattgctgtgtggattaaataaatattaggtcatatcagtgttaactgtaactatgttaatcattactgttgttattccagaaggctaagggttaggaaaagaaggcatttgcaagatgagattaaaagagaacactagtgttctaaagagaagaaattaaagatgcatgggtttcttgctaatgtccaggtttctcattcatgcatttcttagtcagatgatcttgagaggaagaaaagggcataaatggcttcagtggtcttagtaaacagctacctttccccaccccaactttttgcttggctaaatcctgttcatccttcagctcccagtttaggcaacttttcttggaagaagccttcttgagccccaaagactatgttaggcacctctttgatgtgcttccctagtctctgctctggcatctgacacacttttatggttaatgattctagtttgtatcctcagctaaagaatttcagtttgttagtttgttcttggcgatatccttagctcttgagtcagtgcatagaagcagagaggaagtggtataaagaagtgatgcataaagatgtatttaaagttttggagataggcactgtacaaaatagcatatcaaatcgccaacactccataaccaaaagtcaatcatatctgcctaactgtagcttcctagctcaatccacccaaaagttttaagtgagacattttcttgtagaaagtaacaaagaggagctctgaaatacgcatcaacaatatatgtatgtttgcttataaatgcttgtacacgctattagcatatcaacattatgtccattataaaatacacacaaaaatagaaattccaaaatgaggaaattaacacacgcacacatatatacatacaacacacacaacacacacacacacacacacacacacacacacacacacacacacatatataccttctgatgtagcataagttaagtttggcaatgccatttacatcttgttttctcaagcttgcattattcttattgtctttaaaccacggtttcttgagagagaactgttaagtgtcttgtctattttctggtgattagtttagttaaaaactataaaataaaatctacaggtcacctaaacaggtacacttgaaactgaacacaccaaggatgccttttgtagagtcgatcttccactatatcttcagcacacctggaataccacatgtaacaatgtaccacccaacatatgggccaagtcatgacaccacagtcagtcattatcactgtgctttgcccctaaaccaaaggtaatgtgatcccattacactttgtgccactagtgtgcttaaaagatttcccacaccacactagagagaaagccccagacctcactaccacatacgaggccttctatgatgtgtcctccattacttctctgctccttgatcacacgtaccacacaggcctttcctaagtgacttctgtggccataaagaagaactcacttactcctggagatcttagagtaaatgaaaaaaagatgcacttactacaaataatggcagtcagggaagagtttccctgtagggtagtcacaaagcctttccacaagtagatatccttctggaaaactcagcaggccaagaaagcctgccctgggcccgtacttctgcagggcaggatcaccaaaatgtttctgttgaatggatttttattttcttgatgtacaataaatgcatggttttatttaaacaaaaaacacatttttattatttaattttctagataagtctttgaagatgatgcatgcaataaagattatttgcaatacccatatttgatgcatcgttttcacaaccacatggtttagcatgaaatttaaattcagccaataattccaaggtgacagttttatctacaaagcctccatttctagttcaaccaatttatttaatggaacaatttagagcacttgtttaaactgatccaaataacattcaaaataaagggaaataactttcaaatgcaatttaataatagaaactattgctgtttttaaagcaatgaatctaagcctcaaatgtaagtgttaattgtacaagttcttattaaagagattcaaggaagatagcaaagtaatcattataaaaacgttaacttagataaaatcaccactttcccataaaacacagatacacaaatattaagacctcaaataaaatacatgctgtgaagtgtaataggagaaaacactaaaaaataagacaaaattacaggtttaaatatacattatgccttaactctcactttattggatttccattgctttctagacacatccctacaaatagttccagacacctggtgattttctttattatgagggttgagatggcaataattaaatattctgcatttcctttagtaagagaagcatgatttatgagaaaagaataaaaatctaagaaaatcacttagcaaattatttgatttttagttcaaactgatttagggcaaatttcttccacgttgcaagtatggaaaacgtagcttactggataacagcacagtatttaggagaatatctaggtttgcttccctgtttttagtaattttgtgtctgtaggcaagacacaaaacctctcttaagtcttagtttattcattttgaaaacggggtagtataggaagtatgtttcaaagagtaagatgtataccactggtggcatttaagatagctggtttggcaaggtgggcagattgctggagctcaggagtttgagaccagcctgggtaacatggtgaaaccccatctctacaaaaaatacaaaaattagccaggtgtggtggtacacatctgtagtcccagatacttaggaggcagaggtgggaagatcacctgagccaggaagactgaggctgcagtgagacaagatcacaccattgcactctagcctgggtgacagagtgaggcactgtgtcaaaaagaaaaaaaaaagaaagatagctggtgtggtgataaactcatatttaaaagtgtatttcaacacttttaatgagtatgataaaaaatataaaattagtatgtaaaataaaaaaataactaatttctcaggacaaacctagctagtatgatgggaatctctttcttagagtatagttcttttcagttgtactttgaaatttcacttcaatgaacatgaacattttaaaaatggtaaagtcctttacacagagaactaaatgtcagaagaagggtcttagggttcatgtggattgtgtcagaattaaaggaaatggtgagctaaatttcataagattcttagcaaagcattggaatatattaaaaactcaataattattatttttccttgtgacattgttgccatattgctataatcctaataaatcaaatatactccatttagcataaaagaagtttgagtatctgtgtatagcaaaaccatcatcttttactttccaaatgatttataaataatacgtaccaccaagaaaccaagaaagaaaaaaagaaattaagaaacgaggggagggacaggagctcatagaggacaaataagcagagttgatgaaattaaacaacatatacaatttgccataagaatattttgcaaaatgacatatgttgcaatgattaggctaaggaaatctgcctatgaaatttgaggaattactacacccagtgaatagcacctctataatcatattacattttgtcttaggacattagaaataaagataacagtttaatggttatgtattctaaaaattctatcaaccagcctgggcaacatgttgacatcccatctgtactaaaaataaaaattaaaaaaaaaaaaaaactagcttataatggtggtgcttgcctatagtcccagctactcaagaagctgacgcaggaggatcattttattccaggaggtggaagttgcagtgagctatgatcatgccactgcactccagactagtcgacagagcctgcaccccccacccccccaaaaaaaatcctatcaagtaaggcactacatgccactgtaatgaaagtataaaaacatttcctgtaattttactaagttcttgtgaatagtttttttaaaataagcaatttctcaaaaagaaaaagacaatattaatatgaaatataatactacttggatagttctctcttcgatgtattttatgtgtctcccatttaattgcaattgtagttaatattttcctgcaggtaatatttctgaaaataatatacgcccagcattttgtgaatatgttcttgttcttttaaataaagtattctaaatttcttccaccaacatataaagtaggtgtaatattctggtgttctaattcttatcacagattaaccacaaattttcttttaccataggcaaaaaaaggactattcaataattaatcaaaagagagttaataccacactttaatccaaatgtctttagtcatagtaagactaaattctatactatcaacagttctttctttaaagatgcattctggccatcttgcccaggctggattctaactcctaggctcaaaccatcctcccaactcagcctcccaagtagctgggactgcaggaacctccttatgtctaagaatgtactggggacagaattgggcacaatctggtgaaacctcaaatatgagtaagccaaatgacagaaaaattcatctaaagtttcactttgatagctgaccaataatttcttacccagaaaatggggctctgggccaatgaacaaggtaggctctcaaaattagggagaaaattcagaaatgacatctactgagagttaacaaacaatgaacaagtaacactagctgacttgggagaggtggaagaaacctatcaatgacactatgggcagccctccatatgtgtcaaaaatgcaaatgtagtcactcaaaattaattaaaaagcaatttttctgcttcttgcttaaaatatgtaatacaactataattacgtgatatgatgaaacaggagctttttcacagaggtgaatttaccagatcattaaagctaatttttggaaaataaacatgcatatgacttaaaataaccatctagctttatcaaattattaattgaatttaccataatcagcaactgtcctggcattaaaacatattctacctgttttgatctctggccttcactaaatatgccttttcatttctctctacataacactctccaatcagtaatctcataaaaacaatgagaagaaatcattaagtatttccaagaatgactcctgttttaagatttaacatttcatatgtagtaacattgctcctagtcctgaataaattaaaagaaaaccctttgtgagagataaaagaagtacttaacaatttaaccacctgtaatatgtaaatttataacatgttttcctgacaaaaacacatatttaatcacatgataaattaatgtattcatgaaaagcttacaataaagttgaaaattaaagttgtacttttttttacagtttttaatttttttaagtaacagctaacattacgataaaaatcatagaacattttacaacataaatttagactcacttgttggccctaaaccataaacattatcattaggaagtgacagtgacgaagtttgttataaaatcaaatgatctaaccataaaaatagtttattttttatatgatacttctgttgcccagaaaaggaaaactggtacatgacttttatcaaggtacaaagtaaaagcaaatttacccattatgattagggtattcctgtaatatatatcctattaagctattgctgttacttctgctttcagttttaattgcttaacttcaaaacattgttataaataatacaagctgttcttctagcaaatatttatgattataataggatctagaagtccttcaaacatttgacaattataagaggaaattgatagcagaataggtcagaaacagggcacttggctcagctcttgaagagatgatatactgtgaacttacattttcaatactctctaagtagcgatgctcctcaagttatggtggtgttacttctggataaacctatcctatgaccttttcaacttacagtgggtttagccagatataaccccatcataagtcaaggagactagtgaatgtctatcacttgtgcaccatgatataatcgaaaatcgttcagttgcaccaccataagttggagactatctatagtagaaaagttctgttgaaagagtataccaataaattttgtacttactttgcagaggcaaagtgtttctaacacactgtaactctagttcttctgtccattccagctttggcagcatctgcttcatctcacagttaccattctctgccatggacactggttgactattgacgggtatctttcccaaactcttcatgtgttgttgaacttccgccaagagaacagcttgtattgcttcagttacctgtaaggtatttttttaagtgaattatttttagtattattacaaatgcttgggtatgttgcaaaaaatccaaagcccggaatttaaatttgaataggtttccataaacgataacttttcatacttctagaattagcatccacaacaactgaaatgtgggtagcaacaactggcacccagactttcacactgtttttttgcaatgcaagagattctaaaaggatacttgaggggcattttttaaagtccagaatgccaaacattacactatgggacaaagaggagtttttaattatttttcctattttcatttccaccagaagataaagaaaattcatttgaatttatcctatggctcttaaagacaaggttagatcctcaaaccatgtctagctccaaagcattatttaaataaacactgcatttaaactatgctttacacagaaaattaaagaaatgacttcaataataaatctcactaacttttgtgtatacctatgtggttttacatagattaaagtattgcaaggcacgtcttccaattgctgtgtgtgcccagtcaaggacctatggttcgaagggcggggggaaagggacacttgccacagaacatccaactaaattcttcatttttaaaatgaagaatctgggtcatgacacctcaagcttacacagacttggtggacagaccttctgatccctgattctatgtccttcgaagtacatgtccactcaagattctatatcctctgccctcagtgcaaagctagtgacagtttcctagacctcttcctggtaacagatgaggcaaggtctagcagttaggtacagcccaaggaaggccaggagctgaattagggagagaaaagaatggacactgctgatatagacgaactagggacaccttctcatcactcttcttcagccaacagttaaaccttcatatagctacatcccagtgcctttcatatagctacatcccagtgcctttcatatagccacatcccagtgccatagcatatatattttcccctcagaagtctgtcctctgtcaagctgactcatgttccacaattcaccactggacccctccattactcccagtctacccataagcatgtctagagctagggatatgagacaacaccgagagtggtgacctagagatgctttggccaaaaactgaacgtgtatttatgtaaacaaattacattcagtctcttttgtatgtgatggtagcatgtgagaccttcaggtcccagggacatccaacgagcttattatgatggcagatacttgctgaaatcctggggcagaaaagctggcctctgacttttaaatataggaagcttcctgagaatactggagcagcttcctgattgctgattatctccctgcccttgtccagcccacactcaaatgtttaaggagtgaaaaaaggctaaggaatagtagaatatcactattgcataccatgcatactaacatgaggtactgcctaatcgcaatgcaagtgaatggtgcttactcatgaatatcatgtaatgagatatttaacatcagagtatcaattatgtgccattaatctaagatatacttctgcatatcatgatgctggtgaatagtgcctattaatatctaccatatgagaccagcctggttgacatggtgaaaccccgtctgtacaaaaaatgcaaaaattagcctggcttggtggtgcgcacctgtagtcctggctactcaggaggctgagacaggatgattgcttgaacccaggaggcagaggatgcagtgagcccagattgcacccctgcactccggcctggatgacaaatatggtatatatatatataccacttctgagatacatatatattaagtattatatatgtttcttactaacatatactgctatatatatatcacaatattggtaaaccatgctgatttatgtatctcacatgatgggatatattttattacttattcatgatgaacaattttataacactgaagctatttcattttaaatttgtcatacatgttatttgatatcactggttccatgatgtggatgatgtggtagaaagaactcaggattataagtgaaaacgtttgtatttcctattccaccacgacagttaccacaaatccaacctttgacaagccacaaacttctctgaaacttcatgttctcacttaaaaaacagtctgtgatactgacagaaattaggataagagctttcagtaacagaatagtgcatggaaattgctctttctatactcataaattaaggatattggaggatatcctaagacccacaatgtgtacagactatattatacccctcagaatgggtagtttggccatatgccttcactgggcttatggctggcctctcaccctgggatgcttatcaccccagaggcatgcccacaactgtgatctaaaatgtcatctctcccactgaatataatatcctatacaacttggataatcattccttcttaaaaatatacaggaatttatgtattttaatttaatatttctaattatttgatttacatgtcatgacttcactttaactgttgattttttacatagttgtcaccacaaatgcatattataagaataatgatacgaatatcatcaaaaacaaggagaacagaaataactatagaataaaatagattaaccatgatgagtagggtactcagagccacaacatttaaaagtgaatactgaatggcatccaactggaaagaaactcaaaatatatatttaaactcagtgtgagatgagagaaaggctgtatcttctaaacatgtaataatgttattatagtatctggaatagaatgggcactacataaataccagtggaattgaaatagattctgcagactttcaaaaataaactgtgggaagtataatttattgacagtttataactatcagtacttgagtctctctctataaatgtaatagatagattttacaggtagtcaatagaaatagaatttactccaaaaaaatataaaatgtttatatggcattttatataactttgtaattttaataatgagctagtattgagcattatggctataaagctgtcttcccaatgcatataaagaaatttcttccaaaaggtagatatcaaagaatcatattcttttatgaggcaatgtacacagattaaaaataaagtttacaaactcattgactggaaagagtcagctacaaatctgggacatatgcttattaactaaaggtattactgagtcttaggcaagctaaaaattttagtggcattccataaacaccttggaagagcaaaatactgtaaaatagcatagagcatcatgaagatgcataagaacccctgtgtcctggttgttgttccagtgtctagtttttttgtcataaaacatttttcccaacactctgctcatgctggcctttcctgtctttagggtgtctcctggaaaagcaacatttctagctggaggcctacatttcatgatgtgtacccagtggtgttagattataaaatccaaagaaatttagtgcagtactggaaacatgcaaattagcaatccccaaacttttctgtttcttttctagcatttatttttatgttgagtgtttaatgtgtgaggagcaaaacagacaatctctagacaaacttattcatcagcaaaattaattcattcttcccccaaccttaaaggtaaacattcaacttctagagctaattttgctctgttttacaaaagtattccatttaactagggttaaaatgaaagaaaaattgttaaggacagctagagagaaaggccaggtcacctacaaagggaagcccattagactaacagtgggcctcttagtggaaaccctgcatgccagaagagattgggggacaatattcaaaattcttaaataaaaggaattgcaacccagaatttcatatctagcctaactaagcttcataagtaaaggagaaaaaagatccttctcagacaagcaaatactaaggaaattcattaccaccggacctgtcttagaagagctcctgaagaaagcactaaatatagaaaggagggactgttaccagccattacaaaaacacactgatgtacacagaccagtgacactgtaaggcaaccacataaacacacctgcaaaataaccagctaacatcatgatgacaggatgaaatccacacatatcaatactaaccttaaatgtaaatggactgaatgccgcaattaaatgacacagagtggtaagctagataaagaaccaaaactatcggtatgtcgtcttcaagataacatgtcaactctcaaaataaagggttggaggaaaatctaccaagcaagtggaaaaaaggaaaaagcaggggttgcaatcctagtttctgacaaaacagactttaaaccaacaaaaatcaaaaaagacaaagaaagacattattacataagggtaaagggttcaattcaacaggaagagctaactatcctaaatataaatacaaccaacacaggagcacacaggttcataaagcaagttcttagagacctacaaagagacttagatccccacacaacaatcatgggagactttaacaccccactgacaatattatacaaataactgagacagaacattaacaaagctattcaggacctgaactcagcactggatcaaatggacctgatgtctatagaactctccacccaaaaacaacagattatacatttctctcatcaccacaggacacctattctaaaattgatcataattggaagtaaaacactccttagcaaatgcaaaataactgaaatcataacaaacagtcaccaggaccacagcacaatcaaattagaactcaagactaagaaattcactcaaaaccatacaattacatggaaattgaataacctactcctgaatgacttttgggtaaatgacattaaggcagaaatgaaaaagatctttgaaactaccaagaacaaagatacaatataccagaatctctgggacaaagctaaggtagggttaagagagtaatttatggcactaaatgcccagatcaaaaaactagaaagatctcttgttaacagcctaacttcacaactaaaagaactagagaatcaagagcaaaaaaatcccaaagccagcagaagaccagaaataaccaaaatcagagctgaactaaaggagataactcacaaaaaaatctattcaagagatcaacaaacccaagagctggtttttggaaaataaaataaaataaaatagatcactcactagactaataaagaagaaaagagagaagattcaaataacacaatcagagatgataagggggatattaccactgacccaacagaaaagcaatcctcggagaatattataagctagtaatatatacacgtgacctagaaaatctggaagaaatagataaattcctggacacatgcaccctcaaagactgaaccaggaagaaactgaatccctgaacagactaataatgagttctgaaactgaggcagttaaataaacagcttaccaaccgaaaaaagcccaggaccagacagattcacagatgaattatatgagatatacaaagaagagctattatcattccacctgaaactatttcaaaaaatagaaaaggaaaggattcgtccctaactcattctatgaggccagcatcatcctgatacaaaaacctggcagaaatatgacaaaaaaagaaaatttcctgtcagtattcctgatgaacatcaatgaaaatatcctcaacaaaatactggcaaaccaaatccagcagcatatcagaaagcttacccaccatgatcgagtatgcttgatccctgggatgcaagtttggttcaacatatgcaaatcaataaatatgattcatcacataaacagaactaaagacaaaaaccacatgattatctccatagaagcagaaaaggctctcaataaaattcaacatcccttcatgttaaaaactctcaataaagaagatattgaaggaacatacttcgaaataatgagacatatatgaaaaaaccacagccaacatcatactaaataggcaaaagctagaaccattctcccttgaaaatcagcacaagacaaggatgccctctcttactactcctattcaacacagtattggaatttctggccagggcaattccacaagggaaatcaataaaggtcattcaagtaggaaaagaggaagtcaaactacccttttcgaagatgtcatgatcctctatctagaaaagcccatcatctcagcccaaaaacttcttaagctgttaagcaacttcagcgaagtctcaggatacaaaatcaatgtgcaaaaatcattagcattcctataaacaacagtcaagctgagagctaaatcacaaacgaactcccattcacaattgcaacaaaaagaataaaacacctaggaatacagccaactagaaaggtgaaggatctctacaaggagaacaacaaaccatggctcaaataaatcagagatgacataaacaaatggaaaaacattccatgttcatgaataggaagaatcaacgtcattaaaatggccatactgcctagcaattcacagtttcattgctattcatatcaagctatcaacgtcatttttcacataactagaaaaaactatcttaaaattcatatggaaccaaaaaagagcctgaatggccagggcaatcctaagcaaaaagaacaaagttggaggcatcacgttacctgatttcaaactatactacagggctgcagtaaccaaaacagcaaggtactggtacaagaacagacacatagaccaatggaacagaatagagaacccagaaataagatcacacacctaaaactatctgatctttggtgaacctgacaaaaacaagcaatagggaaaggattccttacttaataaatgttgctgggataactggttagccacatgcagaagattaaaactggaccccttccttacaccatatacaaaaattaactcaagatggattaaagacttgaatgtaaaacacaaaattataaaaaccctggaagataacctaagcaataccattcgggatataggcataggcaaaggtttaatggcaaagatgccaaaagcaactgcaacaaaagcaaacattggcaaatgggatctaattaaactaaagagcttctgcacagcgaaagaaactatcaatagagcaaacaggcaacctgcagaatgggagaaaatttttgcaaaatatgcatcttacgaaagtctaacatccagagtctacaaagaacttaaacaaatttacaagaaaaaaaactctattaaaacatgggcaaaggaaatgaacagacacttttcaaaggaagacatatatgtggccaaaaatcatatgaaagaaagcttaacatcactaatcactggagaaatgcaaatcaaaaccacaacgagataatacctcacactagtcagaatgttgaagtcaaaaaattatagattagaaaatcaaaaataacagatgctggagagactgtggagaaaaggaacgcttatacattgttggtgggaatgtaaattagttcagccattgtggaagacagtgtggtgattcctcaaagacctaaagacagaaataccactcaacccaacaatcccattagtggatatatacccaaaggaatataaatcattctattataaagacacatgaacatgtatgttcattgcagatctattcacaataacaaagacatggaataaacctaaatgtcaatcaatggtagactggataaagaaaatgtggctcatatactccatggaatactatgcagccataaaagagaacaagatcacgtgctttgcactgacatggatggagtcggcggccattatcctccagtaaactgacacaggaacagaaaaccgaatactgcatgttctcacttataagtgggagctaaatgatgggaacacttgaacacgtagaagggaacaacctacactgcaacctactgaagaacagaaggtgggaggagagagaggatcaggaaaaactactaatgagtactaggcttaatgcctgagtgatgaaataatctgtactgcaaacccccatacacaagtttatctatgaaacaaacctgcacttatacccctcaacttaaaataaaagttttaaaaaagtaaaatcaagctaacataattcaactaactgcttaaatgaatggctttataagtaatttgaggatagccgggcatggtggttcacacctgtaatcccaacactttgggaggccaaggcggggggatcatttgaggtcaggagtttgagaccagcctgatctacatggtgagactctgtctctactaaaaatacaaaaattagctgggcatggtggttcatgcctgtaatcccagctacttgggaggatgaggcagaagcgtcgcttgaacctgggagacggaggctgcagtgagccgagatcatgccactgcactccagcctgggtgacagaaaaaaaaaagataataataatttgaggatcggttattgaagcagtagaatggatacttgcaagagtctctattcttcctgaagggccagcaatactcatttccattttacaaatgaggaagacaaataatcaagaagtttaaactatctcacagagtcatgcatcaggccagtagcagagatgagaagagaaccttgaagtctggacttcctgtagagtgggtaaattctctggtagtctttgtccacagccagcatttcacataccgtcacagaatcatagaaccttaaaggtctgttagtccaaacatgcccaaatgacattaaagtttatttgaaggtcaaatgaacaactatcaaagatcttcaagtgagagcaatttaagagaaatgttctgctgaatccttctttttaataattttttccccatttaggaattttttggccactggggaaaaaatctcacttttaatagataaacctttttagggtgactgctaatgtgctgataaagttgcctgtacttgtgtttattccaattattacagaggttgcctgcatagctactcattcactcattaaatatgtattgactgcctactgtcacttctgcttttctgggcattggtaagagaggggcaaatgagacaaacaaggtcactgctctcagcaagcttatataacagcgagaagacaaaataagcaagcaaaacagcaaataatataattttcattaaaagtaatcacagcaaaaaaactaggtaatgtgatgatgactagatgactggggttgggtagaatgtggcagcaatattagttggagttataagagaagacttctttaaggagatcgattttttaagcaaagacctaaatgattaatgaagaaatgagaattctagcccaagagaacagtaagatcctgagttcaaatgagctttacgtcttctggaaataaaaagaaagccagttggggctaaatcaaggtaagataggaggtggcaaatgatgacagatgtggtcaggctggggaaaaaatcacatgcatatttgcaggccatgataacaagtttttatagccattccaactgtgtatatttagtattatagcatcagcccctatagtatattacgagttaactttgtttccctataaccaagaataatcatttgtaattggagttattgctattttaatcttgcaaatatgatatgtaatgtatcaagttcataaaaaagaataaacttctagtaaacattcatcgaatcaacgcacaactatttattgtacaattcacaaaggtactgctaaaattttgagaccaaaagtagccttaaaggagaaagaaggatttaaattggacattgaagaaccagtcctctaagtcaactcacagatgaggtactctcagaattaaaaaaaaaagacttattaaattacaaaactatagtaaccaaaacagcacagtactggctcaaaaggagacatatggaccaatggaagagaacagagaacctagaaacaaatccatacacctactgtgaactcattttcgacaaaagtgccaagaacatacattggggaaaagacagtctcttcaataaatggtgctgggaaatccttatgcagaagaatgaaactagacccctatctcttaccgtatacaaaagtcaaatcaaaatggattgaagacttaaatctaagccattaaactatcaaactactacaagaaaacattgggggagatctccaggacattggtttgggcaaaaatttcctgagtaagcacaggcaaccaatgcaaaaatggacaaatggaatcacatcaaatttaaaagcttctgcatagcaaaggaaacaatcaacaaaaacaagagacgatccacagaatgagagaaaatatttgcaaactacccatctgacaagggattaatacccagagtatacagggagctcaaacaactctataggaaaaatctaacaatccaataaaaaaatggccaaaataattgaatagacatttctcaaaagaagacatacaaagaataaacaggcatatgcaaaggtactcaacatcacttatcatcagagaaatgcaaatcaaagcaacaatgcaatatcatgtcaccccagttaaaatggcttatatccaaaatacaggcaatatcaaaagctggtgaggatgtggagaaaagaaaatccactgttggtggaaatgtaaatgagtacaaccactatggagaacagtttggaggttcctcaaaaaactaaaaatagatctaccatatgatacagcaatcccactgctcagtataaccccaaagaaagcaaaccagtatatcaaagagaaatctgcactcctatgtttgttgcagaactgttcacaacagccaagatttggaagcaacctaagtatttggaagcaattaagtatccatcaacagataaatggataaagaaaacatggtacacatacacaatacagcactattcagttataaaaaaaatgagatcctgtcatttgcaacatcatggataaactggagatcattatgttaagtgaaataagccaggcacagatacactaatattgcatgttttcacttatgtgtggaatctcgcaatcaaaacaggtcaggtgagatggcacacacttgtaatcctagcactttggaaggctgaggtgggaggatcgcttgagcccaggaatttgagaccagcctgggcaacatggcaaaactccatctctttaaaaatacagaaaaaattagccaggtgtggtgtgcatgcctgtagttccagttactcaggaggctgaggtgggaggatcacttgagcctggaagaacgaggctgcagtgagctgttactgtaccactgcactccagactgggtgacagagcgagatcctttctcaaaaataaataaataaataaataaataaatataaaaataaaaacaattgaactcatggacatagagagtagaagaatggttagcagaggctgggaagggtagtgtgggatagaggtaggtggggatgattaataggtgccaaaaaatgttagaaagaatgaataatacctactatttgatagcacaacagggtgattatagtcaataataatttaattttactttttaagataactaaaagtgtataaatggattatttctaacacaaaggacaaatgcttgaggttatggataccccattctctgtgatgtgataattaggcattgcatgcctgtattaaaatatttcatataccccataaatatatatgaccactatgtgcccacaaaaatcaaaaattaaaaaaaaatctaatttcacataatcaaattcccacacataggtactttaatgtatggcatattttgaaatcaaataatggacaatcctgcttcaaactgaagcttcaacaagcaagaaattacctgtgatagcaagaacctccctccctcagccccgggcattcacgctcccctagtgaatggtgtacccttgcttatgttatggtccgtgttttccctcatctctatgtctgttcaaaggccattttatgaggacaagagtaactgcttgtattttcagatagaggggggtatccatgaaccacagcagcaaggaactcttctaataacgtcatgaatgtgaattatatcatacctgcacagactggtctctccaacaggaaattagcttcaaaagtgaaaggtcagcctcaggtacatgggattcattcttacctagaaatatacagaacacacttgtatctttagagtattaaaaatggataatggctcttaagatgggctgcatattagaatcacctgggaagctttgttttttataaacaccaatgcccaggttcaatcttccagagatttttattttacagatcctgtggtagaggtgggacaggcattaatgctttgtaaaagtgccacagatgatttacatatacagccagggttcacatccatttgtgtacatttatacacacacacacacacacacacacaatttatatgtaattctaacaattatactaacacatattcacatcaaatcaaattcatttttacagcttcaacacatttttgttctttttgctgacccaagacagatcaccaaatcttacaattccttccttatacaaattctgaaattctactctgccatgaattagtctctatcacatgtaaaatcaaatcaaagacttcctttgatttgtccttacccagctataccactttgatcaataggtagagcactactgttttaatttaactcattctgttatgtattatttcttctctgtttgccctctccagtgtcctttctatttgccttaatgttcagtgtgaaattttaagaatgagtgagtgcttggtctatgtaaactggttcatagagtgtccagcagtttcctacacaaaaaagtacttaataagtgccttttcattaattgaaaatgtacatataaccataatgaacaatcgatgagttaaggctttctgatggctacagtctattatctaggtgccagatcctgagagatagggaagactggtaagggcttctgcaagcggaaaagttgttactataattgtctacttaaattaatatattgatatatgtttgacattgtggtatcaactatttaaattagcatttgtctgatacacttttcatcaaatccctatttttatattaacatatgaggtatatatatatatatgaatatatatttaccacattagcagtcaaggaaaatgcaataaaggtattgtatacaatgcaatttgagaacataaaagtaatacataagaaacttctgaccaattattgatattactttttcctgatagagcatttaatataaatgtaaaatgaccaagaacactatataaaacatggaagtatggtagaagattataattttgacatgttttccatttcttcatgaacacagcaggtaagagaacattttcttttgatctctgtttttcctccctctcccactttgtggaccttgtgactcaaccatcaaagctaagtattggtctcaactgtaactacttactagcatcatggggtacttcacagcacaatttaatgtgatgttaaaattttaatatgtgatagaaatgagagccaacttatcttggcaatgtcagtgagttaaagaattaattgcaactttagggggaaagataaaagaaagtatcccagccttaccaacattattcagtcaattcctgctgacagaagtgaatactggttcctaacaacgttttagatgagcacctcggagtattatttttattctttaggatttggcttcataaaattaataccatgaagtcaatacttcctttctttaaccttccatcttcctattatttttttgaaaaacatgtttccctactccttagctgaatttcaaatgctataagtgccaacctaaattccagagagatgattctatagtaacagtagctgcttaggctttttgctggggcacccataggaaaagcaggggcctccttgattctggttagcaatcccctgtctttgcagaaacacttatattaaatcttaaattccaatccccttcccagttacgagtgctaaaaaacaaacaaacaaacaacaacaacaacaacaaaacactggataactaaccctaataagagtaactatctaaggagaaaggaggcaacccagactggggctatttagatggaacattatctgtaatcataaatgtgagaagtggcctgacacagtggacaggaaatggggttaggaatcagatttggattggaatgcaggcccctctactgaatagctgtttgcctatgagtcatctaacttccttgagtcccattttttttttttaacggtaaaacagagatgctgcctcctactgtgcagggttgtttttacattaaatgagataatatatgtaaaaccattaacataattcttggaacaaactaagcacaagttaattggaagctaataataaactctcacttgaaaatactcttttcaacagtcgtgtgagggccactgtgtactgtcattcaggtcaccccatcctatggatcatatgctgcacagctttggaggcaacatgtgcattgtatctgggatcacattcccattttacaaatgtagtaattagggcttttaaaaaggaaaagacatgcccaatagaacacaaatagtgaatggcagagctggatcttgaatctcagccatctatcttatttatctccaaaaccactgttctagtcattatttatcctttaatttcatttgtccattaattgaactcatccactaattcaaaagttatttgctaattccttctagatattgttctaggaaccagggacacagcaatgaataaaactgtcacaaaaatataacttctatggagcttacaacttagtagcaggaggcagatgagattttttaaagtaacagatgtcagatagatagtgaagaggcttatggagaacagtacaacagcgaaaggggtagggagtgctgctgcagtgataaagtggcattggagcaagacttgatggatggtagcgggtggagggtgagcaggttgagctatatgaaggtctagggaaagaacaccacaggcaaaggtacagctaatgcaaaggtcctcagacctgcttgtcatgcttgggtaagagtaaaaaggctagggtagctggaatgagttaagcagggggtgagcactaagagagaaggttggatgggggtgtatatgtgatgacataggtagagcagccagatcctatagggctttctgtgctatagtaaggacaatggcttttattctgagcgaaacagaagccaccagaaggttatacatagacgagtgaggttctgacttagttctgaataaatcattctggctgcttgggtgggaacagagtgcaggagtcaagaataggaacagagagatgatcaggagcctgctatggtcatccaggcaagacaggatgaacgctcacaggggtgagggtgagggaaaggaaggttgagggggatggagttgctggtgtagggggtgagaagcagtcagattctgggatacattctgaaggtagaactgacacaattactgacagattggatgtggggtatgagagaaagggaaagtaaaaaagaatcgcaaggttcttcgcttgagcaattggtgattggaaggatagaactgtcatttattgagatgtcccaaacttggaaaagcaggtttgggagatacatttgccatttggcatcaagaggaaatctaaacactgaagttgagaatataaccttctgaaattgcaagaaaattatctaatataataatcatttatttggtaataaagatgatgcaataaactttccaataaaacacaataataaaatacttaacatataagtatttcctttgctgaaaagtttcaaatttttaggcatttcaaagatcatttgaaatctatgttttataaatgttcaaatgttatgtctatgttttaaaattataaaatgttcaatctatgtttttaaatgttttataaatgtcacccaccttattttctaaatgaagaaagtaaggcccagaaaagctaaatgactagcctaaagccacacagctagtgtaatcacaaacataggtaaaatctatgttttatatatgttatttattttgacactgctaaccagttatagaaagactagttatgtcctttcacagaaaaaaaaaatcagatcatatctgtgccagtaactctcttaccatttcgtaagcaactgtagaagcttgacatatttaaaatgtcattcccagcacctctcatcttattatgtatactttccattctgaaagaactgttagaaaaaagattgacagcatattactaaaaagcatgaaaaattatttgaggaaataaatcaaagatatgggtacatgaccactttagcaaatttggaaattgaatacaaattatttttagcaatatctttcacatcaatttctcttgtgaatctgatttcctcactttgctcccacctaaaatcttatttatttatttttttaggctcccacctaaaatcttaatcccaattgacctgcacatcttagtttgccagaattatctgtgaactatgtttacaagacaggctttgctattttaggttacatgattactgactaatgcaacaaatttaaaaaacccaatatgttcacatctgtcaaagaattatcctcaggtatcattggagccttatgaaggcaggttttaccctaggccagtgttctaatcataggaatcttccgaaactgccagggatgttctgataagtaggcaggtgttgccttaaaatatagttaaatcatgtgcccaggtgttaagcacacaaggatttctcaaccttcacaaccacagtaaaatctttgtgaaatggtcacatttgttggaaggatttggtgtgacaaatccaatatacatgattttgatttctcaaaaaataatatctgggctctgacagcagatcaaatcttgagtggctgcagtagagaagcagtctctaatcctgacaccttcattctataatttgtttcaatgaagaattctttaaagagtcaaccaacgtgtgacaacatttgaaaggctatttaatgaaaggcgtaccaaaagtccataagcttccctaaagtgcaccagacatcagacacatcatttccatcctgtaatctgtaccaggaataaacttagaatgaaaacctctggcaaacaactaagtccctcatctgctctgtgggatcatgattagaccaataaatcaaactggttaccagcctaagcttttaagaatttgacaatcacctacaccacccacctcattttgtaaatgaggaaagtaaggcccagaaaagcaaagtgactagcccaaagccacacagctagtgtaatctcaacactcaaaagcaacagttattactaaactgtactatgtataaatgaatcactaaatagcctcttctattttattctattttaatatgccaaaatataaaataaatggtaaaatttgaggtatgaaattttcaaagttttccttctctgacgatataaaaatatatcatcataagcatttacttaaatgtttttgctcatacttgattcacaccatgtataatggatttcaagacgtatatgtgtctatgtatgtatatgtgtatgtatgtatgtatgtatctatctatcaactcattcaacatcccacactatgtctttcctggcacatattatgagaacattgaatatttgttgagttaatgaattttaaatcatatagatttattgccaaattatactctaatcccaaacaattaaaagggagattttcttaaatgttttttaaaccagaaattgttgcatacttaccccccactggaaagaaggaaggaatgttaaagagctaaatatagcaaataatgatatatatttttaatgtcataatctagtatagtcaaaatctctaggtatgtcttacctgccaactctacatgccaattctaaaggcatgttaactaatttattaactaaaaatagtctgctcaacaaataaactatagtatctgactctcgcaaagaatcacaattattttccaatcctcttggaattccaacctgatttggaagagtggctgtgtatttatctgacaagtccaaaactttcctggaaaataaatttactcctgaatagtcttttatcattccactattgcataaatcccaacctggcaacatcagtgagaaattatcttcattcaaagaaattcccaaagaaataggaccctgaagctttaaaatattgaggtgcttaatgcaaagataatctaaatctttatccactccccatggcaaaaggcaagacagaaacaattttgctgtgtctattgtgagactggcatctacttttcttgatggcttaggctgcatttttttggagatcttcattttcttctgccttttaatgccatcattttcttctgagaatttgatggtattatctccttgggccaggctttcagtaataggcttggctagtgcctctgctgaaagaggaccacaggcagttttactttttctcagtgtcagtgtcttcttctccactgtgctcttggctcttctcaggacctcaccaccatagaatgaactggaagagtcaacatcactgagtggagttggtagcaaaagttcaacaaggttttccagatcaaatagaagaatatgaaagccaacgttactccattttgtcttcacaggcaagacattaaaaggtcttgggcaaaatttggcatcagtaacctaagggaacaaaaaatatttgtgtcaaagttcttgcttattattttattaaagattccatgatgttaaagtggcatttttaaaaagtattacattgcagagcagctaaaggcaagtcatttcaatttttttgtcttagctataaaaattcatttctaaattaaatattctatattctaacattctttgaagacttcttttcttttttcctaagttttatttttcctctaaataaatatgaattatgtctctggagtaagatggcactagattaacatcctttaatatagactctcatatctttctactattattgtcataaagacatacaaggacaaggtaggtttgaaaactgaggagaacaaatgtaagaacgcatgcaaaaatttattaagtattttaacaaaaatggtgcttccaaatttgttaaaattggaagtaatttaaatgttaaccaatgtcatattgctctaagaaaaactcaaaaaactcaccttgttgacttgcatttgattttgccccaaaggctggcacagtgggttcccatacttaaattatgttcttgctaatttatgaggcattccttgaatactctattccctcatatcaacccattactctctataatcttccttgctttttttcttctttctagaacttaggatttccttacagaatatgaaaaatttatttctttattgtatgtttcctccactagcattcaagccacacctttgcaggaattttgtatgttagttgcttccagtgcctacaaaacaatgcttctatacagcattatcaagagactcaattaatgtttgttgaattaataattagcaaatttatacaatggaacaccatttaaataatttaaaatggtggtgtaaattatatcgatcggtgaaaaacatgttattaggcagacaaaataattctccttttgtaaaattttacgtacaaatatataggtatttaaaaatttgacacatatctctatctacatttgtatatataaatatacatatatagggaacatgtaaatacaaataaatgaataaagtcacaaaggatatgaaccaaaatgttaacaatagttaacatttaattgggaagaaggaattaattgggaagcagaaattaaaatgatctttatactatggtgtgttgtgtttttggtttggttttctgaaatttttttacagtgatgatatatttaattttcaataataaaaaaggaaagtttaaaaagaaaaccattacaaattataaatggtaaaaaatgaaatggagaacaaattataagagcaaatttgtcaaataagggttaatataattattaataaataatttttgcaaatcaataagaagaggctcttacagatggatgaatgggcaaagataataacaattcacaaaacaaatattcaaaagttacaatatgaaaaatttttactacaagtagtaaccagaaaaatgaaattaaaataataccattcattggcctattaatttcaccattatgttcatcaaagcagccagacataaaagaattagctgtatgtaattccatccccgttattttcaaaagacaggagaaaacaaaacaatagggtttaaggataccttcataaacaataaatctacaaagatagtggctaccttttgaggactgggaggtatagtttctggggtgctcacatgttttatttctggatctatgtggtgattatgaaggtgtgtgctttatgacaattcattgagctgtacatttttgtgctgtgttgtttacttttttctatacgtgttatacatttcatggtaaataaataatgtaaatgaactgtttaaggaatattaacaaagtgcctccatttggactaaaaagtagaatatgccctgattttttttacccctgcatactgtcagaaagtaaccaatatttgaatttcatgcttataatttctttgctttcatttagtgtcttaaccttaaatatgtattcctatttgacctacttaattttgcatgtttttgcatgtttgccaaactccagattacatctcccacttatttagaccatgtttaatttcttttgatagttttataatcactcaaaaatatgtttatattacttgcctatcagttatttagctctgcagtacctataactatgggcctcttaaaatttattacttttattgcctctgttttttcctgctagaattttgtcaattttgatactctttttaaagcatcaacttttgactttggttatcctctcaatggaataatgtttttctcaaaaggtagtcttgtgttagcttgacttattttctcccagtattcgtgaagaagggattattctgcagtctctggcttcctctgatgcagttgagaagtcagctgctagtctgtcacaccatctgtcttttctctctgctgtttgatgagatccttttggctttaatattccactgcctcgctgtgattcttctaggtgtggatgttttcccccagtcctccactgtatctgagcctccccatctttcattaactttgtgaagttgttgggcttatccctttgaatattttctcttaccatcccattatccccttatgggactctgatcaggtatttgccaaaggctgtatccccttacacgtttttcaactcttttgtctttctgtacctcatgtggggcaatcccttcaaaatttttcttttagtttgccagttgtcttctcacctgtgtttaatatgttccttaaattgcccattgagttcctaattttgatttttacatttttcattgccagatcttctatttggttcttctaaaaaaacaaaatggtcatttttatagacagctatttcttactcatattttaaaataattcttttatttttaaacctacttattatactttgcatctgtaattaaagtttctaaaatctttgtggatatggctctgcttttttattttgccaacattttcctgtttccttgtatgctttataattgtgtgtgtgtgtgtgtgtgtgtgtgtgtatgaaatgtgatcagtgagaatcctttgagatatatgtgacagtgcactctttaagagaggattttagtttgtgaataccaggtatccaggggtactaccaaatagggccctctttaaacaaaattttcagcttcaaaagttttcattccttgaaggtggtgtgaattctgactcaagattatggttattaatacttaagcaaaagtactttcccccctccatctagggctgagaccaacaaagacaaatatttttattctcttcttgtgtgaaaaatattgctcatcttggttggctttctcactgaatacgcatctcttagaggacaatgagcttatgctgtggtatcccatccgacttcctatcactgcactggacctggaaattctctcttttaacctttatagtggtttaaactaaagctaaacgtacccgaggattagcaaatgctctttcagccttctccaacctgtctggaattgtgctctcgttttgctttttacctctaagaatttctgtaaatttcttgttaattctaatatgcattattttcaaagataaattttaaaatagcttactctttatttgtagagaaatgaacaggactgatgttcagactattagccaacaaacaggtaaacattggatttgcaaataccattgaaaattgaatattcagttttgataatggggggagtaaatgggcattcttatacactgcaagattagtgtaagttggcacttattttatggaaggcaatttggcaacatgtatcaataatcttaaaatgttacaaactctttaatgcagaaattattttaaaaataattcctaaaggtatgattataaatatgcacaaaatcatataaaaaatggtcattgaggattttgctgtttcaataagctgtaaataacttaaatgtcccatacaatagatttggctgaatatattatggcatatatatatgcaaaatacattatgacatacatacatatgccaaaaattcatatatattgtcaatggaaaatatttaaatttttaaaaatataatcccattttctataaaattgcagatttcttaaaatattttgatcatatttattttttaaatttctagaaaaacttatattttaccataccaaacaaaaagctcttctaaaaatagtaatcaaaatggccaacccagaaataaacctaaatacttacagccaactgatcttcaacaaagcaaacaaaaacataaagtggggaaaggacaccctatgcaacaaatggtgctgggataattggcaagccacatgaaggtgaatgaaactggatcctcatctctcaccttaaacaaaaatcaacccatgatggatcaaggacttcaatctcagacctgaaaatataaaaattctagaagataacattggaaaaactcttctagacatcagcctaggcaaggatttcatgaccaagaacccaaaagcaaatgcaataaaaacaaagattaaacagctgggacttaattaaactaaagagcttttgcatggcaaaaggaacagtcagcagagtaaacagataacccatagagtgggagaaaatctttacaatctatatgtctaacaaaggactgatatccagaatctacaatgaactcaaacaaattagcaagaaaaatacaaacaattccatcaaaaactgggataagaacatgaatagaaaattatcaaaagaagatataaaaattgccaacaaacatataaaaaatgctcaacatcactaatgatcaggataattcaaatcaaaaccacaatgcaataccaccttactcttgcaagaatggccataataaaaaaataatagatgttggcttggatgtggtaaacagggagtgcttctacactgctggtgggaatgtaaactagcacaaccactgtggaaaacggtgtggagaattccttaaagaactaaaagtagaactactatttgatccagcaatcccactactgggtatgcacccagaggaaaataagtcattatatgaaaaaaatacttgcacaactatgtttatagcagtacagttctcaattgcaaaaacgtggaaccaacccaaatgctcatccatcaatgagtggataaagaaactgtgatatatatatatatatatatatatatatgatagagtactactcagctgtaaaaaggaatatgacctggatgagattggagactattattctaagtgaagtatctcaggaatggaaaatcaagcatcatatgttttcacttataaatgagagctaagctgtgagaatgcaaaggcataagaatgacacaataaactttggggacacagggggaaaaggtgggaaggggatgacgaataaaagactacaagtgtgtgcagcgtatagctcttgggtgatgggtgcaacagaatctcacaaatcaccactaaagcatttaatcatgtcatcaaacaccacctgttccccaataacctatggaaataaacattttttaaaaaaagaaactatcatcagcgtgaagagacaacctatagaatgggagaaagtttttgcaatctatgcatctgacaaagccctaatatccagaatctacaaggaacttaaacaaatttacaagaaaaaaacaaacaaccccattaaaatgtgggcaaaagaacaagaacagacatttctcaacagaagacattcgtgtggtcaataaacatatgaaaaaagctcataatcactgatcattagagaaatgcaaatcaaaacagcaatgagataccatctcatgccattcagaatggtgattattaaaaagtcaagaaacaacagataatagcagggcgttagaaaaataggaacagcttttacactattggtggacatgtaaattagttcaaccactgaggaagacactgtagcgattcctcgaagacctagaaccagaaatactattcgacccagcaatcccattactgggtatatacccataggaatataaatcattctattataaagatacatgcaagtgttatgttcattgcagcactagtcacaatagcaaagatatggaatcaacccaaaagcccatcaatgatagactggataaggagaaagtggtacatatataccatggaatactacacagccataaaaaagaatgagatgtgtcttttacagggacaatggatggagctgcaagccattatcctcagcaaaataatgggaaagaaaaaacaaacaccccatgtcctaatttataagtgggagctgaacaacgagaacacatggacacaggaggggaaaacacacacagtgggggcagtctgaggagggagcagggggagggagagcatcaggataaatagttaatgcatgctggccttaatacctaggtgatgggtttctacaggcacagcaaatcaccatggcacacgtttacctatgtaacaaacctgtacatcctgcatatgtatcccagaactaaactaaactaaactaaactaaaataaagggccctaggggaaaaaagaaaatgtcaacaatagatatgactagccaaatatttttaacatgtactaccctccccgcaaaacagctgcattgatcaaattaaacttaaaagcataagaacaaaattcacaagatcaataatcaaaggctaatattttaggcatataaagaactcacataaattaatttgtaaaatactcataccatcacaagagataaacaaagagataaaaatattgtagagagaaatagtttgtaaatcattagtctcaaaaaagtgtaaaatattgtatactatacgggttttgatttcttaattaactaactcttttttttcaacttttattttagattcaggggctacatctgcagatttgtggtttgggatatgattgatcccaacacccaggtactgagcatagtacccaatagttggtttttcaacccacagtcctcttctttccttttccatttagtagtccccagtggctattgttgtcatctttatgttcatgagtactcattgtttagcttccattgataagtgagaacatgcagtatttgactttctgttcctgtgttaattaacttaggataatgacctccagctgcatccatgttgctactaagaacatgatttcattcttttttatggctaaatagcattatattatatatatatatatacacacatacacatacacatacacacacacatatatatcacactttctctatccaatccattgttgatgcgcacctaggttgattccatatctttgctattgtgaatagtgctgcaatgaacatacaagatcacgtgtctttttggtagaactttattttctttcccagtaatgggattgctgggtcaaatggtagttcttttttaaattctttgagaaatctccacactgccttccacagtaggtgaactaatttacattcccaccaagtataagtatacactgtatacattcccacttacaaatatacactgtataagtattccctgttttctgtggcctcaccagcatccattgttttttgatgtttaatcatagccatcctgactggcatgagatggtaactcattgtcgtttagagttgcatttctatgataactagtgatgttgagcatcttttcatatgtttcttggccacttgtatgtcttcttttgagaagtgtatgctcacgacttttcccatttttaatggagttattttttgcttgttcaattaagttccctatagattctggctataagacatttgttgggtgcattgcaaatatgagaagacctctgaagtgatggctagaagaagggtaagaaggtatgcatatagcgtgaactgagaaaatttcagaatggctgaaaggtagaatacgggaaggtagagaatgagctacacagaagagatgagggccaggttacatagatccgtataaactctactgactactaaatgcattctaagaatagttataagtcttcaaggggtatttaagaaaagaagtcatctactcacaaactatagctgtggtttcttctggattactggttaatcaagctggctgaaggcagagttctgccctcctatgcacttccacttcctcaaagctataatctctgtctcagcacctagatctcctcaacttctgggccaatcaaaatcacagcaatgattcgagcaatatttcttgttctcctcttattattttgtggtccacacagccacaataggcctagtgcactgccataagcaaaaatcctaaatttgtgttcctaaatatggtcaccttatcaaagaagcaactgaatattttacattattttaaaatcataaatgttattccaaatttaattaacatacaacagagttggcttccatttgaaaacaagtccattagaatataagtataaattgttgctatgttttaatgtattaaaattattaaacataattccagctagtcatcactgtttgaaactttaggaagtgtatgctaaaagtcttattaacaaagggccttgaaaacataatgactatcattttggatataagtaacacagaaaaatgacagtaaatgcccataatatatattttctgagttttcacattttatagattgggcagacacaatattcagtaatgtttagcaaaggctgtagttaatattaactttatttttatgttacctatatgcaatatatttcacagacaaaaagtctattaaaagtagcatgctaaaagcaaaaatacaaatataattatgttaattttaggatgataaaatatatctaaaacatcattctaacggaagtgtcttggaaacattcattaatctgactgcaatttttaaaagtctagaacaagtaattaaaagcaagaagtatttcatcccatctatgccactgcaaaaatgtgaggagtaaatacaaattttaagtgattggtttacatgttgtttataaaacactatctgattgcctgacagataattccccaacatgtgatttccaggtattgcatcatagacaaggtcctggtattttcctcaaaaatcatcacttttactactactctctgaaatcccaggttgagaaaagagagaaggtattgtttacaattggtaaagcaagagggtggcactaaagaacaatccattccaacctctgaactttggagagtttgggagtaaaataatgctgatacatctacatgtgaatgctataaacagcaggtggggagtaggcaaaggcacacagggttgaattctttgtctggagtacaaagactttgggaaaagatactgagtctgaaagtctgcaagtagaatcccagatggctggcaggccaaaattattcctctactacccacaagagcccagaataattaaaaccaacgccaatgacacgaaatgcaaactgtaagcaatccaaagtacatataaaaaggaaaaacagaaaggaccaactgttcagacaaaaaaaaaaaaatgtaataggtgtgaaagtacaagtctaacacttttatctgaagaacaaagaagtgtactgatttattttctttttccttcagcctactatgttcttcttccttttctccctgattcagaaaaacaaaatgcttaaacaagactggttttactcctggcttttgaaggtagaaacgtactttctagcaacatgttctgataacttctttctcaaaacattttggatcccccactgagtttgttgtgaaaaaatttgacctgcccaagctactgttaccgggggtccttgctcccaaagctcccaagatggtggtgggcagcttccaaaatagcggcaggccacttccaagatggtggcaagcctcgtgttctctgacctggggttctaggccttatggattacaaggaatggaatcttgggccacgcgatgagtgttatagctctatcagaagccgtgggtcacggaagagaaccgtgggacccagtgactagtgttcagctcaattaggatgaaccaggcacttagccaggcaggaaaaatgacaagcctttagcctgattgggagcagcaacgggcaccttgctggatcaggagcacagcggacaccctgccggatccaagggatggaagtcagcggcaggtctgcgaggcggcaaagaacagtggtggacggcgagccaaagctcagctccagccgtaacaaacacggaccagaagagtgcagctgcaagatttaacagagtgaaaacagagttcccatacaaagggagaggacccaaagggggttgcagttgctgggctcaaatgcctgggtttctatcccgatctttgtccttcccgctgtgctctcaggcaacagatgattggctatttcttcacctcctgttgttgcctaattagcattttaatgagctctccttactatctgattggtcgggtgtgagctaagttgcaagctccatgtttaaaggtggaagtggtcaccatcccagctaggcttagggattcttagttggcctaggaaatccagctagtcccatctctcactactacaaccataaaatagattgggtaacactgatgcttaaatctgccctcatcttctcacttttgtcacttcgtacagtaacacttaatataaatatttaaatacaaagttaggaaatataggcagcagctgctaaaacattttagatatttccttatattcctgaatgaagaatttagaaattgtctgatttgactctttctcctcacactaaggaaaaatgagagagagaagggaaatgacttgttctaagttacccatctggcaaatagcccaaccaagattcccaagtctgtttctcctaagatgacattatccacttagattcttcaaagaatgaaataatattttttatttattatttttaaaagatacaagggtcttcattagctaaacattcattttacaatacaccacagtcactgagctgtataaggaaggaaaagtcgtcatcatgtgaaaacattcactaatgaactagtcacatataaaattagtacgtaaacactccttgccttataacataaagacctagccccatctattagacttggactggttatctgatgatgcaattcaattgtagagtagatagcaaatactgttaaagatgcaggattacactaacagtgatagcagaactctgagtcataaccaatgccattgacaaaaaacgatgtagcagagaaaaccagataacttgagaaaactaactcagaagcttcaaatgaaaaatgttttaatgtaaagtgtataagttaggcctgtggaaagcttgattatctttcaaattcttttctagaacaaaactccttaatattcttattgaaattcaaacatgaaataaaggatgacatattgtgaaccatactaaaaacatttaattagaaaaaaaacacacaaaactcacttgattcattatatagtcatttaaaaaattagtgcctaattgcaatcataaatctatgtttttctcaatataaataagctatactattttacatgtttaatttcatttttaagttaaaaataaaatactttttaaaatctccttaatagttctccactcagctaactcatcagattaatctatgctctccaatctctctgaccaccagtataccactttctactttctgccttctactcatagcaactgagatacttactttctggtaattttaattctctttgttctcaaccttcttttcccagttgtgcttatcacattaattacatattttaataagctatgtacaattgaagaattctgtgtatataatttagttcctaagaaaacaaagtttagtaatctgaaagaccctatggaatctgcattctagttaatcttcaagtttctaaattacttctacattttaagtaaataaaaactataagtcacagctgaagcattagaagtgtagttaatgcaaagaaaaaaattatgaaatttaaactatgaatctatactcaagggaaagtacctccatcaaaaggtttataacaatggaagtttttcaagtgagagatggcacagatgatattaaaaaaaagttgacacccatgtattgaatactatattactgagaaattatttaatgattagccggcatcataagtttgacaggaaaagatagtgtgatttcttgatgcggaaaattttctgagaaacaagtctacaatgtagataaatttataacctaacttataagaagttaactttaaaacttatgccataaaaaggtagagaatatggtacttagatacaaaaagaaattacagtagatgcttacatctttgctgttaaaaatttcaaataactaaatttgtgttatgacaaattaacaaattctaaatattttgaaaatactagttgatttctagtcaagatggcaaagtttggactttgaagtaaactaaattttttaaattcataccaacaatagattttttttaattaaaaaaaaacttaaaatgtttagctaagctcaaaaacaaaataaacagcttggaagaccacaaacgggaagaaacacaaagtgctaagtgaagttaaagtcacaggcctgcttaccaacaagtctataagcagataataaggctttagagtcaacttctgaggctaaatgtcaggccattggcgggtggacaacctagaaaaatcctaatctaacttttaactcaatcaacccatcagctagttcactgattagacagacatacaccgaatattaatgcagtccaggtaccattctagactaaaggccttgacaaggtatgcagacacctacctaaaaccaacagacaatatcagctgaggagagagacagcgagagagagagagagagagagtgagagagagagagagagacataaaatacagcaaaacaaaaaacccaagagaaaaaatttttctctagaaatgagcttgcaaaccaaacttctataacacagggaaactaatactcagaaagatagctacaaatataaaagctgaaacatatattaactccagataaaatcagtgccacagaagggactgaaaatgtattatttatgactatcaaagagaaatcagaggaatgacattcataaaaatgaccacgaagttatggaagaaaaaaaaagtaaaaataaaatgaataaaagagaaagaaagtttttagaaatattaggaaaagtataataattatattaaaaaatatagcaggggcagaacttctaggttaattaagttaggtccactgaaaatatgctccttcaaaaaggcaaaaagatcttgagaaataaccaaagctttgtgacaaggatcttttcttccctagtaaaatggctggatgtgagtaaaaacagtgagtgtcctagcattttaatttgccttattctcattgcccctctctagctccacagtcttgaaaatcagcagtttggcaatcatggtagctatgaaaaccagcagcctaccagccactggatcaggcatatatgtttggagaccctcaaaaatccgcatccccacaaaattggcaatatttcacctgcctcccagctccctgaggagtcccatttaccaaccttatcattatttgggaaatttacaaatatgtgcaaattaaacaatacactcctaaataattagtggggaaaaatcaaagtaatgaaagaggggtatcatcactgatcttacaaaagtttttaaaaagatctcagagaaatactatgaatctgccagcaaattaggaaatcaagatgaaatggacaaatttttaaaaagacataaacgaccaaaactggcataagaagaaatagaaagtggaacagacctataccaagtaaagaaattgaattagtagttaaacatccttctatatagaaaagaccaggtccagatgactccactgttaatttctaccaaacatttaaagtagagttaataccagttcttgataaatatgtccaaaaaaatagaagtggtgcgagaacacttcccaaatctctctaagaggccagtattaccctgatactgaaaccagacagagatatcacaagataagaaaagtacagaccaataacccttataactatagacacaaaaatcctcaagaaaatattcacaaagcaaatctaccaaaacctaaaaataattttacaccatgaacaactagaatttatcccacatatagagttgacttaatacacaaaaatccattaacataacgtatcatattaatagaataaaaaacaaaacacatgattatcctaatagatgcacaaaaagcatttgaaaaaatcaaacacaatttcataataaaaaacacccaagaaactaggaatagaaaagaacttctgcaatctgatagagggtatctgtggaaaatccacacctaacataatacttatggtgaaaaaccaaatgctttcctcgtaaggtcaggaacaggacaagtatgtcctttcttgttagttctatttaacattgtactagacgtcctggacggggtgattaagaaagaaaaataagtaagaggcatccagattagaaagaaggaagtaaaactgtctatatttgcagattacataatattgtatatagaaaacactaaggtatccacaaaaaaaacctatttgaactaataaatgagtttagcaaggttgtagtacacaatatcaatatagaaaattgatattttttggatctgtgttcctgcccaaatctcatgttgaagtataatccccaatgctggaggtggtgcctggtgagaactgattggatcacgggggcagtttctaatagtttagcaccatccccctctccttggtactacatagtgattgagttctcatgagatctggtcgtataaaaagtgtgtggcattccccctccctcgctccttctccagccacatgtaaagcagtcctgctttccctttgccttctaccataattgtaagtttcctgaggcctattcagaagcagaagccactatgcttcctgtagagcctgcagaactgtaaaccaattaaacctcctttctttataaattacccagtctcaggtgtttctttatagcagtgcaagaactaacacagaaaattgtcactgaggagtggagcattgctgcaaagatacctgaaaatgtgaaagcagctttggaattgggtaatgggcagaggttgaaagagtatggaggcctcagaagaagacaggaagatgagggaaaatttagaatttcccagaaattgttaaatgtttgtgaccaaaatgctgacagtgatatggacggtgaaggccaggctgaggaggtttcaaatggaaatggggaacttattgggaactggagtaaaggtcactttgttatgctttagcaaagagggtggctgtattgtgggtttgctctagggatctgtgggactttgaacttgagagtgatgatttacagtacctggtggaagaaagttctaaggattgaagcactgaagatgtgacttggctgcttctaaaagcctatctcatatgagcaaagagaagtagagaaaagaaatgacctgaaattggaacttatatgtaaaagagaagtagagcatataagtgtggaaaatctgcagcccagccatgtggtagaaatgaaaggcccatttttcaggggaagaattcaagcaggctgcacaaatttgcataagtaaagaggaggcaagtactaataaccaagacaatgaggagaagtcttctaagacattttaggaagcttcatggcaacctctcctcatcacaagcccagatgcctgtaaggactaaatggtttcctgggccaggaccagggcccactgtcctgagtagcctcaggacactgctccttgcatccctgctactccagcaccagttgtggctcaaaggggccaagatatagcttgggccactgcttcagagcgtgcaagtggtaagctttggcagtttccatgtggtaataagcctgaagatgtgcagaatgcaagagttgaggcttaggagcctctgcctagatctcagaggccatatggaaacacctggatgtccaagcagaagtctgccgcaggagtggagccctcatgaagaacctctactagagcactgcagaggggaaatggggggttgaagcccctacatctagtccccacctaaggcactgcttagtggagctatgagaagagggccatcatcctccagtccccagaatggtagattcaccagtagcttgcatcctcagcctggaaaagctgcaggcattcaacagcccatgagagcagctgtgggggctgaaccctgggaagccacaggggtgaagcggcccatggtcttcagagcccaccccttgcaccggtgtgccctggatgtgagacatggagtcaaaggagattattttggagctttaagatttaatgactgccttgctgggtttcagacttgtatgggacccgtagtccctttcttctgaccaatttttccccttaggaatctgagtatttacccaatgtttgtacccccattgtatcttggaagtaactaacatgtttttgatattacaggctcataggtgaaagggaagagccttgtctcagatgaggctttggcctttggacttttgagtttatgatgaaacaagttaagactttgggatactgttgggaaggtgtgattctattttacaatgtgagaaggagatgatatttgggaggggccagaggtggaatgatatggtttgaatatgtgtccctacttaaatctgatgttgaaatgtaatccccaatgctggaggttgggcctagtggaaactgattggatcaagggggtggtttctaatagtttagcaccatgcccccttggtactgtacagtgagtgcattctcatgagatacggttgtttaaaaagtgtgtggcatctccccataactctctcttctgcttcagccatgtaagacgtgcctacgtccccttcaccttctgccatgattaagttttctgaggcctccccagaagcagcagccactatgcttcctgtacagcctgcagaactgtgagccaattaaatcttttctctttataaattatccagtctcagttattcctttacagcagtgaaaaaccaactaatacaaaaattctattgtaattctggcaataaacaatccaaaaataaaattaacaaaacaattcttctctcaatagcaccacaaaaaagaaaatgtaccaagaaatcatgaatatttatgtatctaacagcatagtctctggatataattataaagataaattgacaaaattgtagtcattgtactgattttagcacaagtctatctatcagaaacagatcactcaaggggataaaatattctatattaaaaatatgaaataaaacagaattaataactttggtaaagcatgtatgtgtaaaaatactaaaacaacattacctgcatttatgaactagaaagaatacattattttcaagttgctactgacccttgtgtgtacacaaacacaaacgcccaatatgaacatatgtaccagtgatataaagaatatacattctttatggcatacattgaactttttttaaaggaacataaaaatcctcaataaatttaaaagaaacagtatctgctaaaatcttcattcttatccatactgcaatttaatttagaaatcagtaataaaaagttaagttttgaaaatgataatgtgccctcctgagtaattcatagtttaaaaatacatcacaatgtaagttataaaatatttaaaactgaggtcctccctcttacaattaaaataacctggacataaacaacaaaaatagtcagtctctggaaggtagacagaagcctgcttaactaggaacctcaggacctgaggaacaaacaacactacagtgaattccctgggttttcaccttgcctcccatatatcccagaagaggttatggtgaaaccagtgacctcaaactgcctgaaggcataggcatgaaagatcccaagaaaagcctgtcccctctaacccagtggtgtcaaatcttttggcttccctggatcacattggaagaaaaataattgtcttgggccacacataaaatatactaacactaatgatagttgattagctaaaaaaaaatgcaaaaaacttacaacattttaagaaagtctacaaatttgttttgggccccattcaaagctgtcctgggccgcatgcagcccataggctgcaggttggacaacttgatctaaccaaaggactaggaaaagggggccctagcagaacagaaagtcctttagacaatatttaacctactccagtcagtgccaaaggaaaaactgctcttcccttaccctggtgttagtgaggccaagcaggagctcaacctcttgtctcaccaaggaacaataaagcaaagtaagttgaccttgcactttcacaaccaaggtggtgccagtagggctgaatgggtagggggactgaatggtgggtagctgacttccacccttaacaggcagcaaaggtagtagtgcaagacagtgctatttgcattccacttttcctgtcagggaggtccagagtggaccttctgctctcacacagcagcaatgagccagagcaaggtggtgtaagttgacactctgcttttgcaggtatagaagctctgctttttccttcctcaactgtgtcactaaagtgacttgagaaactgcagagggtgacgatctttcagaaataatgctgactttaacttctttcctccctaccctctgcaaaccagtgagaagcacctagggtagaacagtaagtaggcctcattcaaagagatacacatttatcaccataccatcctccctggtgtagctctgatgccattttaactgaaaaaagacaaacgtaggtagagaacttaacagcttttgaaacacagcttttgcctatatgactattgttttaatttagaaaaactcagcttatggagcaaattgaggtagatcccttcacttatgaaaatgataaattaattcagaattggggccatttttgccttgccatctatagccctacacacatgtggatagaaaagctttgggaattcctattctccttgggtgggagcttaaaatttattttcttaaaaaatcactacaagagtgacttagtggagtttcaaatgctgctgttaagtggaaaccattatcttaaggaaattaaagctgcaacagaaaaccaaataccacatgtcctcacttataagagggagctaaacactgagcactcgtggacataaagatggaaacaacagacactgtggactactgggggggatggagggagatggggaagggttgaaaaactagctgttgggtacaattcttagtacctgggtgacgggatcatttataccccaaaccttagcatcatgcaatatacccaggtagcaaacctgtgcgtgtacccccaaaatctaaaataaaagttgaaaaataaaaacaaaatgctgctgttaataagacatgccattacaccacgggttaaagggactttagtgagacagcctagaaaccaagtaccctttataccattgtttcttaaggaaaataacaatcaaagctccaagcaacccatttgcaagctgggaatacgattcatcctcatgttggggctgcttgctaatttttcttttattgcttcagtgcatccactgatgctgcttggttttatgctatactatttcttattctgtataaaattttaattaaagtctcaaatgcagtggtacatatttcaaattttaatgtctttgtcaataaaggtaaatttttttctatgcccatgtcccaattaagtctgtttcacaatcaagatcgagttccagaaactgagctgaaaatgtctgaatatcctaacctaagatttgaggtttcctttgtcaatcctaacctgatctgctatgctaaaacacaattaattacagtataagtggttgtaaagacaaaataaacttttaaattcaacttttaaataaatctttaaaatgaatacccaaactacaaactaacttcactgaaactttttaaaaattaaattaaattaaatcgggaggaacagattctcccaattagatctgttaccatattttatataggtcatacatcacatatactatcaataatattacaaactatataagaaatgtagctttgagataagatagttttaagtcaactgtctattcttcattagataattatacattgagaatctactatgtaagaactcactatgtctaagactaagtgcaaggcaaatttagtcattaatctttagaaaattccaatggagtacgtcttgtgggttccaagataggaggctatagacttagataattctgtgtacttgtccacaatcacacaggtaacgactggaagaggcaacttttaaacccaggtcattctaattccaagcccatgttttaatgatttatttcttttcttaacaactttatggtcatttgcatagtatataattaatccattgtgtttaattaaatgatttttagtgcatttacagagttgtgcagccctcaccataattaagttctagaacatttctttcaccacaaaaagatcccttgctctcatttcccattgccactcccaccattaacctactttctatggctacagattttccttttttggacatttcattataataaaatcactcaatatgtggacctttttatttggcttctttcacttaacatgtttttgagattcattcatgttgtggcatgtatcaatattacattattttttattgctgcatctctattagctttatactgcacaaataatcttataattgaagagaaataaaaatgtattaacattaggatctgagatcttcttacactagtgaaaaatccttattttgcacaacgtttctctccttccgcatcttcatcatctgagtctggggaccttttatcatttaatgtggctttccccagaacatttttacttgttgtctgcttcaaacctaggctgcacagcaccactggagtaatagagtatattttaaaaagtgctttgagcatgttacttttagattctcaatagctcccaagtgtctgtagaattaagttcaaattcattgagttggcatatccaggcttccagtcaagttcttttttcctttcctgtctaactttgcatccctcttccttcatgtggtcacatttctctgactgatgccctgcatgtttaactcatttccaagtgtgtgcttttccctgtgcctgttacccaaatggcaatccttcccctcttctcagcttctatcccaaatcctacctcctttaatgcttcattcttgtcttccccagccccatattctctctcccttcaactctttagcaatgactttctgtatcatatttttagccttaggcattcacagaaactgttcatgcgtgaaagtgtgagtgagactccttcaatctaggaaatatattttctggtgtgaactatttgagggcaggtttcatgtctgattccttcaatggggggtggggagtggagaggggttacttcccatatcaatattttgcaattagtagtactcaagaaaattcattgaatgaaaaatttgtattcctttacacaaccaggaaaatgaatgcatgaaatagtactgaccaatgaaagcagcatttttttccttttaactgtaaggaatgaggtgaacaaacataaacttcagctttactatcaacacttcaacaacaaaagagctaagaataattcccaagaaatgtgtgtccaacctcttagctataacattagacaaagtcttttttcaagggtgaaatgaaaaatgttcaacaccacaatggggctatctaagggcagctccatcactgccagatattccagtgccttagcaaagtaagagatgctcaggtccaatatccaatctagcagggctttcatttccttccaatcataaaacagagggctaccctggaatagaaaaacgacacaagaaagaacaatgacagatttctactccatggcaacatgccaaaggcttgtttaaacatggtcctggaagtcaggaaaagtgacattttgttattggtactttaacatataaaatatccttctagatttgtaatcaagattttatattttctcctaatcacattcttttttttttttttttttttggtacagactggccttgcaccaaattacagagaaacatactgaaaaatcagaaaatttttctaactttaaaatatcaagaaggtattatttgtgctctgatacgtttattaagccatggttagctgggtgcagtggctcatgcctctaatcccagcactttcggaggacaatgcgagcagatcacctgaggtcaggagttccagacagcctgaccaacatggcaaaaccccgtctctactaaaaatacaaaaattagccaggcatgatggcgggtacctgtaatcccagctacttgggaggcagaggcaggagaattgcttgaacccgggagggttgcagtgagctgagattgagccattgcactccagcctgggcatctcaagaaaaaaagaaaaaaaaagaaccatggtcactgcaacaccaagtttctcactaaggaagtctactccatctcctgacatctttgtttcttgtaatggcaacattctaccagtccaccaatcttatatctagatactaccttttctttcccttctctgaatcccctctctttcttcaatgcctttcctaccacatcctttccttcatagtttgttaaccattaattaatccctctactcatcaaaagtatctcctatgtgctgggtgatgtgctatatgtggacgactcaacagcgagcagaacagacagccgcagtccctggagcagagcttgcagcctaattcatctcacttaaattcttttctgtccaggtgcggttgctcatgcctgtaattccagcattctgggaggctgagtgcaagagttcgagaccagcctgggcaacatagcaagacctcgtctctacagataattaaaaattatataaaataaaattttatataattttatttatttataaaattatatataattttatttatttataaaattatatataattttatttatttataaaattatatataatgttataaattaaaaattatataaaataaaaaaattcttttcttgccttatctcctaactgcagtgtgtgcctggcactgctgtctgattcttctgctattaatagttaatattggccttatgatctttgtgattgccctgcctttgtgtctcttttcatgcggaaagtgccctaacacccatctacagaaattgtagtcctgaagaaagctcatttccctcaagagaccaccttccctaaacctttaataatctgcccttccagttgcaatcttgccttccttggagttcccatgacattctaatatcttagagttcataaaacatgaggtattttatagaagacttcattgagcctaaaaataccagataaaattgaatcatataatcatggagtacaacatattaaatttcataacattctccttctagtaactattcaatgctgaaatataatggttgaagatgttattccaggtcttttaaaaaataataaaaactagcacacttttaaaaattaagtatgcttttgtttatggtaacatgggatatagcctttgggtgtgagtcctgcacatttcagttagcccatctctaacctctgtgtgaccagaggaattcacttaagaaactgtcgcctaagtgaaaaataaatgtcttacaacactagcccatttaagcacctaattacaaggtcagtcaaaagtcaacttgttctataacagattgctttcatcagtggcttcttgtctacccagagcttcagttaggatgcctccactcttgggtcctgatatgcttggatgccatagccctaactttgtactaagtctcctaaaaatcttactgatgtagaatttggggtaatttggaaaaggacataagttatccttacataagccatttctccacagattacaaatgaaaagtagcatttttccattctttttctaaaaatacaatcattgaacactttctggttcttttaaaaattctttaaaatgaaatttcagggtaaaaagctatgttatctttaaagtattggctaaattgtgaggctgctccagcaagtctgtttcaaaacacacttcaacaaatgtggatatatgtaagttattcttttgtcatgctgtcaaaaaatttagtacttcttttaatatttgttaataataggaaatgtgcattgtgggcttttagtgagaaaagcttaaagactagttgtatttttctgtggcttaagtgtcaatctttgcccaatttcttcatttactatttaccttttccttttcaatttgtgagtccctttatatataaagatattaatactttattgaatattacaaagatttttttcaagtctgttataaggttttaagttgacttgtaagtttttgaggtttttacaattttttaagtagtaaaaatattcatttttttcatttttttctgaaattttgcctcttagatcttttgtaacatgattactaaaaatattatcaagtattttcctttagtaatttatccctctacatttaaaatttttattcatctgaagtttatttttgtgaaaggtagagagttgggatataattttatattttatacaaaaatcacactcagttatacaaaagccttttattaactttcctctttgactttaagtgccatctttaacaaagagtaggttatgatatgctcattcctggaccatcttttttttccccatttatctctttctctgttcttgaacttgtaccaagtgctactattttactgtgtgtgtatttgtgtgtgtatgtgtgtatggagataaatatgtagacagagagataatatgtttgacatctgagaaggaagaaggaaggctccagccatcattctgctatcttagctcaattcacatatttgtttttcaagaagaattttataatcaactcattggttcctggaaacccactaaggagattttgaaatggattgttattaaatatatagagttgtgagtatggaaacctttaaaatagtgtgcttgctctctgggactatatcattttgttaaattaaggcatttttgtgtcttttagtaatttttagaatatggtttcatatggctcttgcatatttcttatgaaatctattcctatttattttctttttaatgacttatgaatggaattttaattccattgtacattctaattggtgtttttttatataagcacttaagttttgtttttagccaacgaccatgctgaacattattttttgttttattaggttttctgatctattaatattttatatgcagagtgtccactattactctatttgaataaaggtaatgcttttctttccttccatcttttttttctgtttcttatattttggcatttgcttaagctgtcagaaaaaaatgttaaataatagcagaaattgtagattactgtaattttacttggtatgattactgttgctattttaaaaactcatttgattcatatattttcttgatgttgaataagttaaatggtttttctaggtccatttatgtgagtaaccacccttctttaatccctgtaattcgaagttgatatatgcagtagtattaagtaaatgaaagaagagtgacattataatagcataaactagtaataattgtatattagcatatagtcccaaattgcttccccatcaaagataaaactaaaatagtatgtatcagaagcttagttaaaaatctaaccagggtagatctttatgtactgatactgaaagatgtctgccaaatatttttgacttgacaaagcaacttgcagaatagctctatagtatctcatttctatgtaaaaacaatatatacatgcacacaccaatgtgtacacatatgttttacttcatatctagaaaggggcacatcaacagcatcataataatagagcctaacacaagggctgtgttttgaagggtgagagaggtttctttattatccataaatgtcaggttcctctctgtactgtcaagcattcacttcctaaaattcagccttaatccattagtgatacatgaaaactgatactgctatacagtattttggaaagtcttaaattacaacataaaccatacctgaaaactcaagttactctatatattactggcataatatccaggaaaagaaaatgctttcaaattttgccccttcaaatacatcaagacatgccatctactttaactgattgaatacccataaccacataaaaattgcatgggaagtacaatgtaaatgctattttccttatctacctgcttgtctctgagggctgtttaccattgggatccaacttattctgggaactgtgttacctcccttaaaatacatatttccattagtgatggagagtcctatattggtttacctcttctttgtcctctttcctaaagctagtcattttccttatctataagcttctcctttgccactgccttgtccatttgaagattctaaagtagaaaataccagttaggaaaaaaagcgaaagaattcttcataaatgtaatgataaattaatatgtatccagtgctaaaattatttcatcctatttttaccttagaactatttagcctaaataatagaactgaaaactgatacagatattgacttaagaattccttggtttatgaagatttatgacataaggcataatgactgcctagtctccattccagcagcaaattaattaattagtcagttaattaatgttgtaataactgtttgttgagaatacttttattaaggaagttaaaccatcacccacagtacacagacacgctatgaggatttttttttctgaaatgtctctccttctgtccttgaaaagatggtaaagcttaattctcacctaaaacgttaaagtccctagttgttttgaagtccaaagcaccatggtttctaaaacagatgggagctggcttgagacatgttcctcatcaaactttctttggggcaaccaaatacaatgctaagaacctggccacaataaaagcagctactgaaggagagcctgaatctggtcttttctaactcctcacacacctagggctagtctcagaataatcccagatattgtttgcttaagttaaaaactgaaacgtgcgtgtatgtatctgtgtgtgtgcgtgtgtgtgtagaaagagaaagaaaataacacacttttcaacaacttaccatttccatgatctaacctagagtaccctgtcacaaaaaaaaatgaaagaaaatacattttcatagaatcacaatatcatctaatttaattttacatatgcaaacaaaatgtacaaaagactattttatccatgaaaaatgtgtacagtaacatacatactttttatacactgagccctcagttagaaaatccaaatcaagtttaagtttagtgtttaattgtaaatgccaagctaatattgttatctattgtaattacttcaggaataaatttctattgtgatttgatgaaaacagtgtatccatcagccttgaaatcaagtgatccttgagtaaatttaaatatttgagagggtatccatattttagataagcacaaacaaacgcaaaccaaaaacacaaactacacctcccatatacgaccggaaatgtgaaataagatttattttactgcatctgtgcttgcaattaggaaagtctctgctttagtctatcttttcttggtggtacatagtttttcttaagatgtttaaggaaaaaaatcgagacattgaagagctcgttcatatttccccatgggaattttatcttcattgacagaaaccagtaactattttttaaaggattttttaagccgattaactaaataaaaaatatttacaaagagctgtgctcatactgcaccaaatatatgtcaacatttgtaacaaataatttaattttatagggagccataagcatataggtgtatactagttatgagaagtatgtatcttgcaaagatatgaaaaatctggaaaccattggtggaataataggaacaaaaagaatcccaacaacgtgtaaatcgaacagcaaggtgtaaatgaaagtgccaaccattcattttcagattctctgagacctaggttgctgaagatcgttgttggcagtaaaactgtctccttccaacgggtcgggtggagagcagcatgattggcagggcaaatagaagacaaaggagaaagccttcaatctgcagctgatgcacaggaagaacatggggagctgagcttacaatagagacaacattaccaagctaatggcacgggcaatcatggggccactacgcatcttgggtatcagcagggcatccattttcagctaagtgttagagtacctttttgctttctctcaccactgcaggggtaaaacaacttagtgcgtgaaacccactgactggtaataaattactatattggatactttttgttttctttcagcaatgactttactgtgtattcttgctatcactaccaattaaagtggagcctgctttagcgaactgtatctaactatatatcagccctgatgctccaattgctttggcaagtatcacagggtcaagaggctcctttgacctttatcatctaagtctttctgaccactcactatttgaagcaatctcagctgaacagatggacactttctgtgacattataaagcttagaatataaagataaacgaaattgtgtttcaggcttcaagctggtttatgcctgtaaaatattattagtgtgtttacaaaatctccagatttaaagcgtataatctgactctggctaatggacaaactgctcatttcttttttaattataggttttgtgttttaagtgtgaagaatagcagaattttgtaaagcagttctcagggttatccagttacatttttaatgcatatatcaataaaccgttataaaatgaagggtgtcatttactgtgcaatgaaccttttgcatgttggtttttaaaatgatgtactaagaaagatatgctaaacacagaaaaactaaaactgtaaatgttcgatgaagtaaaaattaagatttttatttgccttaagcatgatttttctcttaaactatatcattttaactgctaggagattctagtatttttgcatatctaaatataaaaggaaaatgattaagcatcagctttatattctttaacccatttgtgttagtatgtcatacatggttatttgaatattttgaaattgctagattaaccttaagtaggacatatatattttttgctagtctcctttaaataaagtgatcatataatttattgttcaaaccaggctactttttagagtgaaatggtgcattattaacaattacctttaaacaagaggcatgagccaaaactgtcccagggaacctggatgtatgatgaccctatcttacaggaataaggtgatgatgtggcttcttaaaaagcatcgatgtttctgtaacacttaaaatgtgactattgttctgtaaatcataaccatatctctgtatgtctattttttaatgactgcaaagaaattaattttgcagtcattttcttttacactctcagatagtttatttctacttctcaaaaaacttctgatgtatacaacaaaggaaaaacaaccaaagtcctaattataaaaatattgctggattgtttgaaatttttatttttatatctcgtgcttataaaacccccgtaactcatattctcttatcatatttcccaaataatctctcagcaatcaactaaatttctgtggtgcagattcagttgcaggtaagtgagaaataatacaaataatggatttagaggtaaacaaactgctcatcatttttgaaaaacgttgtaagaccaaggtaaaggagggagtgagggatagaaaaagaaaagaaataaggtaaacaaaattaccaaaggccagtagactgtttcaggtcaccttgtattgaggactggttaacaaacaagagacaaaagctagggaccaatgtattctccccaacaaaaagaaccacaaccacaagtgtgtctccagcttctggaaagggattgaaaccaagtgccagctttaaactttcatggttttataaataattctgagaaataaatgtacaacaaaatatcctctctaggaactgaaatactgaaatgatagaaaacgtcaaataaaagctctgggacagttaaaaaaaaatggcaaggaaagtaaggtatggccaaataggtgtaataaaaaggaagtctcataaccaaaaataaaaaagggaataattaagggtctttgttgataaattactgaagtcaaaatattcccccaaattgtagggtattgcctgtactagagacaatatacaaaggattatcctttcttggtacaatgcaaaggtaaggacactattagtcctatggcagagactccagtagaaagcttagtaagtctgaccagatctcaagaataaaatgtgaaaaatcagaattatttttgtgcacaaacagattagaaaatcatataactccatgtgaaaaatggaaaagatgtgttcaattgttatgaaatcacaatagtacagaacatgaaatactaactcagacaccaaattctgaattatagaagaaactaaaggtatttatatccattcataaatttttaaaaagtaagataagcaaaggacatttgaaagagattcattacttaaaaatagcctttcctatattatttttgcctttaataaacaatactaatactgtttacaaagaattcaataataaagataatcaaaagaaaattagatcatccataattataacacctaaggagatccttaacttcctgaagcaggaatctaaagagaaaccacacttttccacaaaatttcatataattttatatagagccctacaaattatctgtgcaatcattagtatttttttcctctctcatgctccctctcctcagtcatcggtatttttaccaaatgcttacagttctccaccttttcccagcatacggcttctgcttcattagctctgtctctgtgtaacaatcaagagcagagaccccttctgaccccaggttggtacattgagtgaataagaaataataaacttgagttgttttagccaatgagatttgggacattgtttgttactagaacataatatagcctattctgatctagatgttttccaaattgatatcaatatatacatggacagacaggtggaaacaagagaggcctggtgactgattcaatgtcatatagccactcatttaatcaatgcaactactgaaatgccaaagttgaaattaaaacccagattgactactcctagtccagtgctccttccactacatgaaatgtgatttctcatgcttacgtgcattatactttctctggaaactactagaagacacagaaacaaattccccctaacttccccacctctgacagatggcacgtctgtttgaatagacacgtcatgatccaattttggtctattctgcatcctataaaaattcaatgtcactagtagaataaaagttctcaatatcaaatccaaaaaattcattaataagccaaattttacgtagcaggaaagatacttgtctcatgtgttctttaaatagcaattatttccttccatttgttttcacctctttctctatatgtttttgtcaattaagataacaagtatgtgttactaaattactctgtactcaccctctggagatgaaaactaattaaaagagatgtggtatgtacatgtaattttacttactccaaacacctttgcttcccaaactatgacactgaaatcagcagtatcaagttgatgctttctaaacatcatactaacaagcttataattggccaagaggtcaggaaaggtataggtctgaaggaaaaacaacttagccagaactggctcaccattaagtagaccaaaggacaaattttttttaaaatagtgtttctcctcttttgagtgatttgtatgtgtattcacataacgaataaccaaccacaaacacttattttgggtatatatttgtgtggccaccagatatttcagtcaattcaattcaacacatacttattaaattgaaatcaatacccagagagtatgctcactaaaaaaaaagtatataaaatttatgaaatgtctcagaacatgagttctttcaaacaaccataccacaataacttctcacatgtctagcaactgattgacaagatcaagcttgtagactaccttaaaaaagtaagaagcagaagaaacaagacaaaaatctctgaaaacccaaaagagagcttacaaaccagggctcccaaattgagcaaaaccagttataattttcagcaaatagggagctttacaagaaaatcttttaatgacaataataaaatatagttctttccagtggaaagctaccacactcctcttcttgtggcctattatagtcaattataacacaatctaatcacagcactgccaattgcagaggtcaagaaacaatgacctgtaggccaaatcctgcctaccacttctctttgcaaagaaactattactggaacacagaaacactcatttactgatgcgttggctatggttggttttgcattaccaacgcagagttgagtaggtgtaccagagactgtatggcccacaaaaccaaaaaatatttgataactgatcctttagagaaaaacattgccaacccctggcttattctaaattaatgggaattttaattgtatgcaaaatattttttctgggcaaaaatgcaatataaatataaagaaagcaattttatgtgttaaatccccttaattcagttgttacactttaaaagaggaccctatcttaagtctgtattggttgtttttgttactcatgagattttccaccacaaatataaattgctcccaaaagtccaagtccaagaattcttacaactctatagcaaaaaaccctaataataaaaaaaccaagccaagggtttgaatagacatttctccaaaaaagatatacaaatggtcaagaaatatatgcaaaatgctcaatatcattaattatcaaagaaatgcaaatcaaaaccacaatgagataccacccaatacctttcaggatggctattattaaatgaaaacaaaaacaaaacaaacaaaagtcaggtgtttgtgaggatgtagagaaattggaatcctagcacactgtgggtagaaatgcaatggtgtagctgctatgaaaaacagcatggaggttcctcaaaaaattaaaaatagaactaccatatggtccagcaatcgacttctgggtatttatccaaaagaattaaaatcaggatcctgaagaagtattagcatgtctatgtttattgcagcatcacaataaccaagatgtggaaataatctaaaagttcattagcagatgaatggatagagaaattttgatatatacatacaatggaataacatttagcctttcaagaaaggaaatttctgcaatatgtgataacatgatgaaccttgcagacatatgctaagtgaaataagcagtcacagaaagacaaatattgcctgattacaccaatatgcaatatctgaaatagtcaaattcatagaatcgaagagtggaattgtgcttgctaggggcttaagttattaatcaatgggcataaagtttcagcccagtaaaattagtaagctatagagatctgctgtacaacactgtacctagagtcagcaataacgtactatacacttaaaaatttgttaagagggcagatgtcatgttaagtgttcttaccaaaataaaataagaagttgaagtccaggttcaaagacttcctcttattttcttcaggggtacaagtcatagttaaccttccactgtgtctcactttatattccatctccagtcatatcaacttctcattaacctcctacttcttccccatcttcatattctgggcttttggacctgctgttccttatggcaaaatcttattcatccatcaagatttagtcctaatatgacttcctgcataccacagacagggttagcctcaccatctaaagcggttcctcccactggcactttgggatataggtcaactagagcacatatgtcacaccatggtttttgccaacttgatgttaaaacaaacaacaaaacaaaacaaaacaaacaccagctaacaatttctttctcttgcttcaactaagcaatggactcctcttccagacacactctctcctctaattcagtttttttttttttttttttttttacatagcaaacaaaacgaccttttcaaaacataaatcaaatcatgttactccttttgagtaaaatcgtgaaaagactccctttaatacttggaagtcaagcttcttactttggattattacacccaacatattctgtccgtccctcacttttcaatattgactcttaatgctccctcccccatactcctcttgagtcacactggcctttttgacttcattgtctacatcaacctcattcctactttaggccttctgttgtagctgtttgctttccttagaatattctcccctctgaaaggcgggagaatctctggttctttcttgcaattcaaacagtataaatcctacctccttctctgatgttctctgaccacccaggctatcgtaaacccctaagactgtctatcaaactgcccaacattaattccctgcagagcctttatcattatctgacagtcttgttttgttttgtttacgatgtatccactctcactagaaatgtaagtgccatgggcaccatgatcttgtatcaagaagagtgcctggtacatagtagatgttcaatgaatacttgctgaatgaataaagtattctgttttgcattccatgctacaaaacttacataacatgcagacacagtaattctttgttttcaaggagctttaggcctaactgagaaaataagacaaataaatagtggcaaaataattaggcaatctatagtttttgtttgtttgtttgtttgtttgttttgagacagaatcttgctctattgctcaggctggagtgcagtggcgagatctcagctcactgcaacgcctgcctcccaggttcaagcaattctcctgtctcagcctcccgagtagctgggactaaaggtgcgcgacaccatgccggctaattttttgtatttttagtagagatggtgtttcaccatgttggtcaggctggtctcaaactccagacctcaggtgatctgcccacctctgcctcccaaaatgctgggattgcaggagtgagccactgcgcccagtccatagttaatttataaattgtttaatcacttctcggccttctggctaagatcaaatgtagcatctgtttttatcagtttaatataaattgtttaactagcatgttcatggtaaattgtacatgcacatactgtagtctaggtaggatatgactaggtaaagagaacatctctggtacatgagattgggcaggaagaaatgtggagaatagagtcaccagaaccacccatgtggaagagcactagtgtacgagaaattatggaagagccttgtcatgggaatctaaatggggtcttcagagaaaaggaagaagaacaaatcctatgaagctcagtttctcctggggctgctaatccagtatgccaccctaccttcccacaatgagctacctaaaagcatttaatgtcatacatgttgaaacgtaatcagccctctcttctcctctgatgagagggtgagttaagcaattttcaaatgatgtacaaaagcaggaagcaatgtttgctacttgggggatacagaattgtactagtctttgcatctgggaaatgaaacataaatcagccctcttcatatttattacacttaaatttctgaaagttattacaaacctgttgattagattgttgctggcttcaggggttttgtattgaggggagggcttagtaaagtaattatttcagggaagtagaggctcctgatatacaacgcaatcctcaggctatttttgagtgcttattttagacaactttgttattagaaaaagaagtctaagatttaagggcaagtaaatggggtaataatatgcactgtgttggtataataagccattttaaccacattgcctcttaatcttcctttctgagtctttatcagctctgttctatgcccaccttacccaaagtgaatcatttctccctaatatgctgggcatactaagttttatcaccactatttaatacactttttcttataaacttttgtaattgagactggtgtctaaatatcagtggaggctgctgctgtgtttcaacagcctctttgctattattgactattttttgctaggtcactatcctctgtacaaccaagtcacatgtaaacctgatttggacttaaagcaattgggtggcgaaataaatacacttttttttctgtcagtcatttatatttttttctcttacaattcaaaaaaggaagcattctttactttcttaccatctattcttcatgttttagacttcagtagttttcagttcatgagtttattccacaaatatttctgaatgccttccacgtgccagatatgccaggtgatgagaatttcatgataaagttataaaataggtttatcataactgtaactgtcccctttgaacttacactggagtagagggtagagaagatacaaaatgaaataaaaaggatgctgagaaagagagtaacagaaagtgggctgctacctgcataatggtaaactgacatcgaagttagacttgaaggtatagaattgaggtgaaaatattctggcaaaagactaacatcagtggaaatatgagtttctttaatgaggccaaatagttggggattaaatatctgggtcatgggactgaacctgtagttgacgtttttcatcttttttaatgtatgatgtttgatttgggtttttatcacaagaatgaatgcaactcagattaataataatggaatgctcattcttagtttcttttctttctgtcatgcttgtggaagctgaaaataatatttcataaacagttatgtgagttcaatagactggaaattattatggctgaagaatatgtgtaaaccttacgggacatcccctgccccacatgataagtgtcaaaatcaaatttataactccaaagatactcttgctaagaaaataatagagttcctagtttaggagatataatatattttaaaataatagtactaaatagaaatttgaattttatgaacattctgaaatattaaagaggatatttcctaggttttgattatgcttaaatatacccagtctggaaatcaacacaaaattaccagtggatagtaaaaatcaattagagttctttcccaagtatcactcataaactactgacaaaacctgctctaattctcaagtgaagaaacttttaattataatatgatgtatgtgttcatgctgaatgaaattcagtatatcctgaaaacaagaatcaaaagcaaccatactaaatgatttatcaagaagacatcaggtaaccacaagagggctgcaaaagatttaagagatatgatgtatcattcatacataacgagactttcgtagattatattacttagtcccattatacttcatgatttgtctgtgaattaaatacccatttattataccctttatacagatagagaagtaagggcccatatccttagattttattaattagtgaaagataaacagattttgataattatttcctgttacaaaactgaagtctgataaaatataataactcaatgttttaaaatacaagaacttggtcctagaattaatggacgtagaacattagatgaaggcaaaaaaacatcaagttgtggccccatagctgggcctttgcggtaggtgcacaagaacagtgaagcaaaccatcatctgaggtactgtgtgttatatggacacttcctcaccatgcagctcattgaattttctgtaactaatctcagtagctatcttgattaagatagaaggtagaccatttaaatcagatgtatattgagggcataatttgtcatgattaattggattatcataaaaagtgaaaattttgacaaaacacactcagaactgttagttttctgcttctatcttactaattccatccttgttaacaccagaaatttaattactaaaaatatgcctcaagatattttaagctgatcgttagcatacataaatgttaaagtcataaaataaagatacgcttaagagatcttggccaggtgcagtggctcacgcctgtaatcccagcattttgggaggccgaggcaggtggatcacctgaggtcaggagttcaagacaagcttggccaaaatggtgaaaccccatcactactaaaaatacaaaaattagctgagcgtggtggtgcacacctgtaatcccaactacccaggagactgaggcaggagaatcgctggaacctgggacgcagaggctgcaatgagcaaggatcgcaccacttcactccagcctgggtgacagagcaagatgccatctcaaaaaaaaaaaaaaaaaaaaaaaaaaaaaagagatcttaaagacaatttgttaccatctatcaacctgactttataattgatctggtttaataaaagataggtccttggtaattaacaattttggactgacaatcatataataaaaactttgtgaaagttcaagattcaggtatcctcttagatttggggagatgtcaactgtcaaataattttctcatttgagcctcaagataatcacacatgaagagaaaggacccatactattctttccatattttgccatctgattacatgatgaatgtcatgctatggttgttgtaaaacagagattggcctgagagacaagaaaaaggaaaacaaaacatctgctaccagagaatcaatggagaaggccacgttttatataacgacaagagacctctagtgggagctcagaagaaagtaatgaaggtgagcaggactttgcattttgtaagtttttttttttgagatggagtcttgctctgtgggccaggctgtggcacaagcttggctcactgcaacttctgcctcccaggttcaagcaattctcctgcttcagcctcctgagtagctgggattacaggcatatgccaccacgcctgactaatttttgtatttttagtagagacggggtttcaccatgttggtcaggctggtcttgaactcctgaccttgtgatccacccacctcggcctcccaaagtgctgggattacaggcgtgagccatggtgcccagctttgtaagctttcttaatggctttctaaaagtcatcaggttttgggcaatatgcgaagacatagaacaactacaattttcagtcccatttgattgtgcatggagttaaatatgtgcataagaaagcccctgctgctcacagcagcttgttaggatcatttttatatctgacaggaataatcacacttgaaccaaaagattatgcaggatattttaatttaggattaaagctgtttgcagaattatataagctatatagtatgaaaaaaattacaaataaataaacgtcatttggagatgcagagaactggtggtgccttcagggcatcactattaaaacagaattcagaaaaatgggcaagaacgttagctggatgtatttttttaataagttcatgctcttagttccaataaataaagataaagtcttaatacattttgtttttaatagtatggggaaatattccatgaaaataaatgctttcttttttgagaattgcttcctgttagttttttgcatttgctactctcttagggccagtttcaacataagtcattggtacagaagtagtgctcctgttgggattgctttaaatgggtccacatggtactctcagtcaataagtggtattaccagctttcaacaagaaagattttattctcctccatttctttccagttataagcaactaatagtttgagttaacatttgaattctacaaacatcatttttttccagaaaataccatccagtgcattagtcattaaaaaaacagaatagaaacacattttaaagaggtaacatttataatcattttaatcagaaccaacaagtttgctcaataacagagcatccaaatccactggagtgaatttggaccccaataaataataacctctttaagtaggtgggatagggtcatcttttgggtactacaagaagcaggatcttaacaaattgtgagaggctacatgtttttaaaaaggaaaaacaggcctcgcatggtggctcatgcctgtaatcccagcactttgggaggccaaggcgggcagatcacaaggtcaggagatcgagaccatcctggctaacacagtgaaaccccgtctctactaaaaatacaaaaaattagccggttgtggtggcatgcacttgtagtcccagctactcgggagggtgaggcaggagaatcacttgaacctgggaggcacagactgcagtgagccgagatcatgtcattgcactccagcctgggcaaaagagcgagactccatctcaaaaaaaaaaaaaaaaaaaaaaaaaagaaagaaggaaaaaagaaataaggaagaaaaaagtctaaataagctaaatagttttggatgcataatatatgagcatgattacagaattcataggttctaaaatatctataaaattattaatgtaaatgaaggcaaatgtaaagatgtgctttaataaattatgctaacacagtccctagatcaagctaaacacaaaattaaaatgcctaaaatgttaaacttttctccacgttctatgttagaacttcccccttcaaattaactgataactacaaatggagtatttaatccaagaagaaagttataatcttagatttctatgtctcttatagggttaatgaaatattgtagggggagagaaactgaaataaatctaaagctaagtttagtactaaataaatgatataaatatttattcactgaaaaatcttactttagaaataatggaagagagaacattttttgaaaccagctaaacccaaagcagaaccaaccttttctctggtagaaatcacggttgcctatcagcaattataaaaacaataacgccgaccttgaatgagccttaaaggtcttcgctcacaattatattatcagctttatgaattttcagttgctatctcagccataaattcaataaatgcagagttgattagtaataggaagatagctattttaacagctgacttcattgaaaaaggcatttgagaaagtacacattatactggcattttccatgttaaaaaatgcagctttttcaaatcctgctcagtacactttagatgaggacttatgtcctctcaggaacagcaataaaaactaaaaatcaaactcagccaaaactagaaatgatttaaataaattatatctgtagtcctgggaaagcaatagtcagctaaaaggtttttatacctggaaatttttttacatttcaagactttaccttggagcattttttttcctcatcttaaatatataacttcacttcctctctgtatcttgaacataacagctcgcaatggtagagaaacccaatcaaaaaatagccctgtgtgtagttattgtaattaacagattcaatatctattacagccagtcaggtatcatagcaaccttgtagtgctgaaaattgcttagaaaattcttcaaaaccagcaagactctgctttaggaaaacaacactggggacatgactggctgtcaacatctgtgggtgttgctatgggcacagccacaaagaactctgccatctatacaaaaaggtatacacacagagaagaggggagggacacggaagataaactgataaggaaaatcaaaaagaagaaataattgggctggcaatatacaataggcacacaattttgtgtccatgttttacacaaattcttttctattgaagctagagaatccaaattaaacttaactgtaattgtgactaaacatgagccagggtttggaaataatatctgaaaactctccatttgtaccctttatcacaagtcttaatttgaaacttaaagtgaattacagttaaaataatatttaaacttccacttataaacccttaatagtcgtttataaatctacagaagagaaaagaacaggttactatgaacaagaacccaatattgatttttcagcagtgcagtaaggcatctccattctatttggctgctgtcaaagccactctttaacagctggagtcaaattgcactatttacagcaagagcccttgtcaagtggaccataagtatcctaacaatacactattcaaatggcactttgccacacaaattgctgacttgatgaataacctatgtcaatgactaaggccaatataaaagtttcatttttatgagaggttttacattcacacattaagtaagctttctttgaagaactattaggctatatatttcaggcctgtggacgctgaaaataattaaaatctgtttaaatacatcgagggaacttgacaacattaatatggatccggtgttaactacatttgtcacacgagtcagaacagagtccttccgttgctggcactccccaccggcacgtgctgcacaaagccagacttaagctagcctagcaccatgaaataggagcattctccttttgtgcctctgatttacatggccaacgaatgtttagatacaagccaggctttgaagtcctgtgaggaaattcggagttgcttctgggtgcgaggtggacagctggagtcatttaatggtgcattttctacttttcatagtcactcagaccttctaaattagttttgaaacgaagctgtgacatgttcctcatagttttcttcatgattgaggtaatattttaaaaacaaaaaaagtttaaactcatgccacaaaatgagaaaagggaaattcttcataaggcagttataaaaaaaaaaaaggattagatattacagaaatttttatttaacttacattacataaaattatctataaaactcttatggtaaacagttatacactgtcaaaaacttgcatcactttatgtgttcaaaaagcaaatgactttgtagatttctcccctaacgtttatttctttattccatcttcctaggctgggtattatcatttaggtactacagttttaagttgagattcaccaaatcaaaatacttaaaacagaaatcttaatccaatgtttacagaggaaaatgactgttcatcaagtgtttgaaatgtaaaataaaaatctatttattttcttttaaaattataaaaaattgatatagaatattttccacactagaaaaatagttctatgctgcttattttattaaaaagaataaatcaaaaatttactaatcaaaaagggaaaattttcattctatatggatgatttagccctatataatgcaatttattgttttaaaataaatatttgttctttttttatagttatacaagtttaatattaaaataaagatagtttaataaaaaccatggtaacatgtagtattgccatgatgaattattatttaatacttttacaagtatattttcagatgatattttccagtctcacaatttagaaactatactaattctattttggttattttttgtgtcataaaatataaaagaactaactttcattctcataaggtgataggtagtagtgggatcaaattttcaattggtggtctaccaatacaccagctgttttttacaagaggtatgagaataaaactctaataaaaattttcagcaaatggtaccagagacacatcaccataaggtcagctaaaggttaaaaatatatataaccatatgtctagaaagctcaactaaaatgtaaataatgcagtgcagtctttatttataatcaattttatatgcttagataaagatgcacatataagtgcgttatttaaagaaaattccattaaaaaaaattccaactaagttgggagccattacttacaaatttgtttctctacaaagggtggttttccaaacacatatgagttcccggtttctgtcacaggttagacttgatataagctcttttggattacattccacacagtgcagaggttgggataagttgtttcatgtaaaatacagatatggagggaaaagggaggtgttgactattttgccaatttctcctcagacctcatgatctccaagtccagtagactgtctagatcataaattgggaaatgacaaccagtgcatcacctctagtccactgcctgtttttgtaaataatgtttttattggaatacaaccacccttgttgaagaattgtctatggtcgcttctgtgctcctaaagcagagttgagtacccatagcagcaaaattctggcctgcaaagccaaaaatatgtactatctggtcctttctaagcctattttttctgttgctataaaggaatacctgatgctgagtaatatataaggaaaagagttttatttggctcctgattctgctggctggaagacaggacatctggtgaaggcctcagtcttcttccactcatggcagaaggtgaaccagagccatgtgtgcagagatcacatggtgaaaagggaaacaagagagacaggagagggaggagctcttattagcatccaatgctcctggaaactgatagagctcatgtactcccatccttacattaatctattcaggaaggatatgccccatgacctaaagacctctccttaggtcccttcttcaacactgaggaacaaatttcaacgtaaggttggagaggttaaatatccaaatcatagcaggtcctttacaaaaaagaaaaatacttatccctggtctagttcatcattgtctaatacaaatagaatgaaaaccacatctgtaattttaaattgcctagtagatacattaaaaaaaggagaaagaaatgggtgagattaattttaataatatatttcatttaattctacataaccaaaatagaatttaacatgtagtactaaccacatttcaaatactcagtagctacaaatgtttaatggctaccattttagacagtgaagctctagaaaagcaaatcacaaggagctgctgggggacctattctacagaaaatcagttttaaagaaaagacatttccaggatactacaatgggccccaaataataatccactttacccttttattcattttacagacaagaaatgcagaaaaagaatttaaaagcaactaaccaaccaacaaacaaaataggtgtttttaccttaaaatatcatgaagctacaaagatttctgcaatatatagatgattttagggtggttatttattccctactttgatgctaaattccttccattgcaatttaaacaggttctatcttgtcttatccttagataaatctaagaaaagcagttccccatcatgaatatgatattgtattcctttaaatcctttatgactctggccttcctttcctataccagagatattgtttgtctagcagcacaaattcaactcctctagcatttcaaattggaattattttcaaaatgttttgttgtatttgtttttctcttgcaaacttttccccagatctatatgcacttgcttcaaatacaacaataaaaaagaaatacagcattctaataaagtcctaatgttgccaaacacaaaaagctccgctgctagtctcctgtttaaacagttcattctattgttggagaatatttcacctgtgtcttactaaaatccacacacaaaaaaatcctgaaatacaaagtaacctttaacagttttaaatttcacaggcatactgtccctcattttttccacacataaaatgagtatgattcaaacttggtttcttaaaattaatttttttcttaagaaaactcatgaagcattttactgtattagtaacaaggagaatgggaaacttataagcacccataacatttcacacttatcaaatttgtaaattaaagaagactaagataaagcaaccttggcaggtacagtggttcacacctctcacaccagagactcaggaggctgaggcaggaggatcacctaaggcaaggagtttgagaccagcctgggcaacaaaatgagatcttgcctgtaatagaaaaactttttaaatttagccaggtatggtgttgtgcacctgtagtcccaaatacttggaaggctgagctgagagaactgcttgggcccaggagttcaaatctgtagtgggctatgatcgtgccactgcactgtgattgtgctggagtgcagtggcacgatctctaaaaataagaccctgcctctaaaaataaataaataaataaataaataaaacaatctcaacagcctaactctatcaggatgaaatgctaagagaaaaagtgtataatagacattgaagatacccagaacataaattaaaaagatataacttaggagaagcacaaataaatattgttctaattagcactaaattcaataataagagaagtatagtatgtaggacaaagaaggtgatagtcctgtccaattcagtttatgtccgaatgtaaagaatgaaagtttgaaattgtagtcatctaaggcaaggggcaaaagcaagaaaataaagttgaaatcagcctataagtaggaaaacaagactctggcatttcattgcttcttgaagtcaaggaataaacaaaattatataaagaaaatgaaatctatatatattattaccactacctaaagagtagctatgaagctcttcaagagagtgaaataaatatcagtcagtttaccttctgggagttaaattagtaaaaatgacacttgatgaatgagatttgctcctgcagaccctagacatctgaaacgcataggtcaagagacattcccccggttctcagctaatactctgacatataatttccactataagatgctaactctgttatgaatagtgagcaacaaagacacatcaagatggggatgcttggcagctggctcagctcactcactgggctttattcactatagccttatgatacctaagactgtcagtgtggttcaatttcccaccttatgttcagctgttaatgttgaagtttcaatgcatctctataactgtccttagaaaaatgaccttttcaagttaagaataggaaaaataggttttaaaaacctaaagacaatggattaaatgagaaaagaaaaaaagctgtcacctaatcaccggtttcaatatctgaaggaggaaagtacgaacaaaagcaggtgttctaaatggagtcttaagaagagaaatacaaaattcagaaatgtttccatgcattattagctttgaccaagggagatggtactctgctgggctgaaagcattggctacattcaactctcagagctcagtgaatgaatatcctctgggctctgactccatttccatcaaggcaccctgtattacaatttcccctggcctcagatttgctacagtgagaatgtaccaagcaataaccagaatgccaattaaagaattgtcattctagtttatatactcattttttaggtatttagttagtgtgactcagttctcacaaggttgacaaatcctagactcacgtgtgaaatctaaatcagtcctctaaacctaaaaagctaaagattacatgctagcacccctgccccaactctactgctttgaggcatggctttaatggcccattggcctttcttgatgatgacacattattttgcctaactatatacatacacctgagataaaataaggtcttattctaagtccttattaatagtatattactagccttcaaaataccattaaaataacagaaaagatgaacaatatgtaattaaaaatcagcaaaaccttgatttagcaatcccacttccaaaaatatatcctttaaataatctacatgaaaaaagctttaggttcatagatgtgttatttttaaaagtgaaacataaaaaccaagccatatatcaagacatagagaaacaatttataccagcaatgatagacacaccacatagagcataatgcagccattaataataaaagttacatattaataccatgaaaatatgtttatatgaaaaaatacatttgatatgtacatataaacggcatagttacaacagtatgttgaggggataatttggaggtgaaaatacaaaaagatggaaaataatccctttaagaaatcagattaaattactatatcatatttagaagtaaaaaacaataaagctagtccaaatttctgctaagctggttgacttggtttatgagaataaatgccaactccatcactgtgtattcactgaggcttggaatcctagagagttagtgatcctacagatattggttatatcaaaagaattatccatactgtgatctagtttttctgattttttttttgtttattttcaatcagcatttttaagaggtcagatactctcaagtgaaaaataaaaatatatccaaactacagaatataaatgttttcccttccttatgttaaatcacctaggattcaagggttaatataaaattgactcaattttgataagccagaacctattttgtcaaaaatcatgccatagtaagtataatagtcactcaaaaagttatactgattcacccaagattacttggtagatgcagcagtctcttagttcttgttttcatgctgatacttaagtgccatgtatttatgaatgcatataacttcttattcggttgataatgttctttgtgaacaacagcttgatttgaacttaccttacatgaagactccacctgcagaccagggcaaggtaatggcccaagctggtaggggctggaggatctctgttctatacttttgtgcttaagtgtctctgaggcaatgggaagtacagacttcacaagctgtgaatcatcacaacaattaagaataattcgtgctctttctcctgtctcatgtctttccaaagtgcctggaaaacaagattagaggtaaaaatgtcaggaaaatatttaccccaacagaataagacagaacaaacactctttagcagaagaatcacaatcctttaagttatcgtgccttagtatcttgcaactgaaaaatagcctgggagcttttcctaaattattcaaaacacttgctcataaagtctgaacttatggatttgaaaagttcatcttcctctttgcgcttcttcatccactgaaatcaacaggagattcgatagtctttaatagtaaaatctcttacttattatacagttgcaagtgatcaataacacataactatggaatattttagtgctgtcccctagtgttccaactcacaagcaacagagaacccacagtgctttgcctgggtttccaggcttgaaatgtttctattggtaacacataatttaaatgaatggagcaagtaagaacacggatgctttgtgtactgcctccctcaccgaagtgtccccacagggctttgctgttttattgttggtattgttgtgattatatcctttggcttttatttcttatgttattagaaggggaaaaaaatcctttgcctctgtcattcttccagtttcagaatttaggagtgctgtcaagttcaacttaaagttaaaaaaaaagtataaaatagaccaaaagtatcagaaaccaattcacaaataattcaatgcttttataaaatacaatgccatacactcagtgaaatatcaataaatacgaattaatcatgttctgtctcttatgagttcatttgtattattcatactatattaaatatataggttatctcctactgaataaagacaccaaggaatactaatttaataaacaatacctaaatacagacttcatttcatattcttttccaccaatgagaaagaagtagatgtactatttatattgttaagaaaatatcaacttaattacaataagaaaatagaaataataattgtaggccactatgtctttagataaaaacattggtagatacatttgaagattatgactattctatccttcctcatttctctcccactcttctatagccttcttttattacaactaaactaccattagctggcactgtggattctgaatcagtaacagttactgtgctcaaataacaggcaaaacttcagtctcgagtcccttaacaatatacttttattataacatttctacattcataaataaacatccttatcatacaagcttataaacatgttgttcttctaagctttccttttccaccaagattgatctatctggctgggtgtgatggctcatgcctgtaatcccagcacttttggagcctgaggtgggcagactgcctgagtccagtagtttgaaaccagcctgggcaacatggtaaaacgccatctctacaaaaaaacacaaaaattagccaggcatggtggcaagcacctacagtcccagctactaggtagggctaaggcaggaggatctcttgagcccagaaggtcaaggctacagtgagccaggatcacgccactgcactccagcctgggtgacagaacgagaccctgtctcaaaaaagaataaacacaaagttcgtcacaatggtatgcaacagctagatattctgggactttaatttttataaattaggaaaaaaaatattgatatatcttctgaaggatacacctcagggagaaaaaaatgatttatagatcaacaaatgaagctgacagcaacatcaagaaaacccttcctctcaagactgacaataggaaaagcttcacaaaccaaagataagagttattactgcttcctgaaaactactgcattccagaacttggaaccgtgttatgtggtaaaattcactgtctttctgagaagtctctctttgaatacggtatcatcctggatattttcttctcacaggttctctgtggctcctcaaactatgatattgtttacatattttgagaattattgggaaagaacttattgcattttaatacatttgttatgtgccttatgcaaaatgtatacattttatatatgcacgttttattgtatacctaatgtcttacccaaatacaacatttcttgtatttttttagtgatgaaaacagtttatctacaaacttaggtagttgtaatccattttcattcatacacagataattaatctgtctgagcatctactatgctaccatgtaccatccaccatgccagatgatgacaatgtatagtatttaagaatgactcagtccaggtccctgggagcttccttaaaacctaatggtagtgcagaggcaagaaacatctgaaaactgataagctgcaatatttaaagtaacacctaagctatttccacccaaaactaacaatctctcattctaaaaatgttagacactcggttttgtgtacaagggtttctatcatgattagttataaaatagtttaaaaaataatgaatattttgttttgaagaactgattaaggcatacacatgacataaggagtggttagagtcaatcaatttctgtaaaagatatagacagacagataaataaactacatgttcaaagcagtaagttaattttgtaataaattcaggatggcagcttttgaaagaccttggttaaaattctgacagtggatgggtattcccacatgtgctagttatcaatttattacctcttagattcaaattcacccttcactgcttgctttgtgaaaatgaatttgggcttgataaatattttctcattcatcagctggtgaaatgttaacctttgtggacagagcgtgctggaaacacctagtagaagaaagggttaaggccaggtataatagctcatcccatcctaactgtaatcttagcactttgggagggcgagacgggtggatcaggtgagtccaggagttcaagaccagcctgggcaacattggagaaactccatctttacaaaaaaatacaaaaattagccggacatggtggcatgtgcttgtagtcacagctacttggggggctgaggtgggaggatcacttgagccagaaagtcgaggctgcagtgagctgtgatcataccactgtattatagcctcagtgacaaggtgagacctcgtctcaaaaaaaaaaaaaaaaagaggaaggaggaggaggaggaggagcaggaggaggaggagaaggaggaggaggaggagaaggagaaggaggaggagaaggagaaggagaaggagaaaagaagaagggaggaagggaaagaaggggaaggggaggggaaggggaagaagaaagggctttcttttcttggttctcgtgtacttttcttggagtagtattagtgtcttccccagtacagctgtctgtagtacatgacggcggggctagcagcactttgcatccaaccactttctttggcatactctttgggtagttttgtaacagcgcctccagcaagacatctccctatggacagctttctctggcacccgcgagggaatatttctggaaagctccaccagcactacaccatagcagcttctttgccattcagtacatataaccataccctctctagcaaggtcaggaacttagccctagggggtggaggggggtctttcttggtttcttggtcaagctatctcaagttctagggctaggagtcatccttcacatctgctattcctatattctttagagttctcttcttactagtcaatctctcatattcaaattctttatgatagttaacaattctttatactaaattttctgtttaagttactgcatcattttttttcctgattaaaccctgattaatacactatgacaaatcacttatgatgcagaatgtttccttaaatatgtctccaaagctatgaaatttacataacttcagagatatatttaaactattagagaacatctacagcaaaaaaataaccaaaaagggaggtatgactacaaggaagatttccaacaagggatgcctttgcaactctaatatactgccttgggcaagatacagaatagctactgtttccagatattaaagaaatataagaaactgaaggtttacaaaattgcttaattcaacttccaatttcaggagtacttttgctttccaaagtaaacttaatgataattagaattttatttcattatagtacatcaagaataggagttaattcatatttattattcatttgaatcaatctgaacatgacaaggaaaggtgcagagacataggtgagttaagcattactgaaagttacactacatctcctccttcaaagtaggtgtgcaaaaatattctataaaatctattgtaagtaaaatctttattgtataaaatgctttccagtaaatattttgtatttttctattatttatttaatatgaatttttatataatttgttttaatcttaaactatacaatagtgcattagagaccagagctaatcataagaaaagatagcttaaagcaattaacatcttgataagaaatgaaggaaagatcagtttccaaagttgcgtagtttccaaaaagtcagcacacagaaatataagaaacagccaagataatctctgcagatccctagaaccatattgacaggattttcacttgtacacactgctttccctgtcagttcagcataacccacagcatacctaatcaactacatgtaaaaccagagctttctctatgaccccatgcacaaccctgcccatgttctttctatctgtccagggggacaacaaggacacatcatcacagcatggtgtttaggggcagactctggcatcagactgtcctgtagttaaatccttgttttacctttgatagctgtgtggccttggacaagttactttacatctctgtgcctcaatatcttcatctgtacaatggggataataataatccctacatcatggagttacttgaggattaaattgagtagatataacaagtgcttagaggtttcggcacacagtgaatgctgtgctatatgacagccctctttgtcacacgagagaggtcctcactcagctgcttgtgagctgattaacaaacctctttggcccccaagcactagagtctgcctgacacctaggcctgaggtcactgggcatatggccagcttgggcccccagggcttcctacctgagacttgaacctcctcaatcagcctttcctcacaggctacgttacaatcaaactcagagtaggattatatatttgacttattttttaatcctcttcagtacaccagaatggggtctggcataaattaaaggctagataatacttcttaatagattatatgacatcaacaacctgctcatgatttttttttaactggcgctgcacttgggattaaacctaaactccctgaccaagaagtcatagtctcaccctcgctctgctttctcccatgtcagcctccccttattcacaaattagattttctttttcttttgttgaaaacaaacaaattttttcctgctagctctagcacatccttcaggtattagcttaaaatctcacctcctcagagaagccttctaaaatagattcccctatcttgtactgttttctatctcagcttcttcactttatagaacttatcacatttgtaattggtgtcctttatttgcttgcttccccaacagatactaaactctttttggcaagtatgtgttccatgagcttggtacaaagcaggtctttctaaatattcaccgaagaaattgaagaattttatcctttccctgaggcagtgaaaagaggtggctataaagcatcagagcatatgagggtctcagtgtgacaagatttaatgccagaaatatgcactataaacttagaccctagagcccaggagaggccaacactgcgaaaagtgccattcacaagcctgaggcctgtcccagctttcagcaatgttgccaggtcactcctgatggcacaagaacttgtaattggagacagcgagtcagtttctgaatgtgacgtgttgtcttgacctgtgaactagccatttcttgcttcgtggactacagaacagaagatgctagtctaaagatgagatggaaataagaaaatgcacagagagagacagaaatggagaaggaagaaaggggaagagaaaagagaaaaaaaagggaagagggagaggagagatggggagaaggggaaagagggagggagagagcgagagagagagagagcacttacaactttctagttttgtttctagatccttcctaaggaatagtgcccctaaagtgtctgaaatacacacctgaatccttataataaacaccactttctgataaaattaactttacttctactgcttcctacctaataggggccctaataagaatggggcagagatgtttctattacggtaaaggccaagtttaaggatgcccaaatagacagcatgtggagttccaggtagagatcagagcagagacacaaagccttaagcattagcagcacataggtgaggattaaatgccgattaaaaaaaaaaaaaagccactccaagtgaatttggagtgagctgtttcaggagacgagcataaacccctgttagcagtttctgcacaagaaagaaggaagattctgaaactgctgtaaatcagtatgttgctaaaatacagccctcttgtaaacccattaggattgtcaaatttataggcatctacagttttttgttttgttcttaaatagagcaaataatcactttgtgatgtaccggttatgagatctgatcttgcaatatcaggctgtcttaaagcatgacatgtagtgtgaaggatgcagccttcaactgcagtagaagagcaaggcacagagtaaagagcacacttctatacatctgcccaaatgatgaaaaagatctaaacatctacctaaagaaggagaagaaagagccatcacattctacacttcaattcccttccaaacagccagaagttgtttccttgattttattttccttgaaatttgtgcataattttattatttgctgtcttctacttaaatattttattttggctgggagtggtggctcactcctgtaatcccagcactttgggagactgaggcgggctaatcccttgggctcaggagttcaagaccagcttggacaaggtggcgaaaccccatttctacaaaaaatagctgggtatggtggtgtacgcctgtagtccctgctactcaggaggctgaggtgggaggattgcttgagcctgggatgtcaaggctgtagtgagacatgatcatgccaccgcactccagccagcctgggtgacagaataagactgtctcaaaaaaagaaaagaaaagaaaagaaaagaaacttgttttcaactcccattgacatttactttccaaaattaacaaaagtatcctagcctaatatcaatgtatgaatagctttaaattacatacttcctcctacaaattaactcggtccactaagtctatgaaaaaaaagaatagctattatgctcaaagggagagaaataatttaaaaagaaatcatagtcatttgatgaatccatctgcaaatgatcaagaggaaattaagactaaacaacatcacccagatggattaacactttatcatgttgtacagaaacattttctttatgttaaaattatacataaatacatttgagactaattgacttactataactcatggtgtctttccaaagaagaacagtgtagaaacaccatttctatagaaacataaaattctcccagaccatccaaagcacatatattgtaaaccaatgaatctcaaacaaatttgtttcatagaaaaggaaaacattttaaattaaatattctgcttattattggattgtggaaaaagcatatatatttcattgtgaaaaaagcatatagggccgggtgcagtggctcacacctgtaatcccagcactttgggaggccgaggtgggtggatcacctgaggtcaggagttcaagaccagcctgaccaacatggcgaaaccccgtctctactaaaaatacaaaaaattagccaggcgtggtgctgcacacctgtaatcccagctagtcaggaggctgaggcagaagaatcccttgaacccgggaggcggaggtttcagtgacctgagatcgcgccattgcactccagcttgggcaacaagagtgaaactccatctcaagaaaaaaaaaagcatatatattcatcactaatcacataataggataggaattatttagcaaataattgtatttaaatgaacaaagcttaatagcaagaacatgtgagtggacatattatagaattaggtcttttccatattgggtaggcattttctaactgaatccattatgatattgggcaagtgattaagaggacaatatttcaaagtgactctctctgaaacagagtaagttttaaaaaatgacctcactaccaaatttgataatcaaattcataaaagtcaggtttcaacaaaaccactgactgacagttataatcaaattccacaaatcaaaaaatttgaccattgggtctgttatacaatttatcatttattttcagttactcatgaagttcattgccttgctcagaaacacatatggagatcgacctagcaccccctttctattaaaaccatttcacagttactgcatcttactccaggaaatgtataactgatgggggttcccaccacaaacaggggccctggaggtatcaaatttagctaactagaaaataatggaagggtggggaaagggaatgagtcttaaaacattaaattagggataaaggtacttaccttcattcctaaatgtagttgatataataaattcagctaaaaaatggagtgtcaaagacctggcttattttgtactatatagaggccctaatatgataacaaacttagattggcgtcacatcaatcttctgtaccttaagggtatataggatacatttttaaaaagtctctaaccaccatgaccttaaccccagctctgccacagcctccagcacattcacagcaatgctgggatttatcagctgggccacattcaaccctcacgtctaattctgaccacagacctccagaaaaacggaataaagaggtgtggcgggggacaattgaaagaaaaaaaaaggattgaaacacctggaggtttaaagttgctgagatgtgtaaagatagcaaagaatgcattaattttcaacacattttaaactagggttttcttgataaggtatctatttattaacacacgctagcagcgtaacatctactatgactttgggaggccgaagcaggcggatcacgaggtcaggagattgagaccatcctggccaacatggtgaaaccccatctctactaaaatacacaaaattagccgggcatggtggcacatgcctgtagtcccagctacttggcaagctgaggcagaagaatcgcttgaacctggaaggcggaggttgcagtgagctgagattgcaccactgcactccagccttgagacagagtgagactctgtctcaaaaaaaaaaaaaaaaatctactatgactaatttttaatttttaacctcactctaagactaaatacaatttacaaccaatttaagaggtagatattcacagccaagtgtttcttaagtataacgtaaagaatacatttaattaattgtacaattatctattatatacaaaactataaaattatactgctactgagtatttcaaaatttcattcatcacgtcgcattatttaaatttattacaccaggcatgttatttttaaattttaaaatatttcaaaagtagattttgtccctcatgcttttaattgtaggttaagttacttattgggtataatatccttgaagagatttgagtctgttcatttatatgcttctggtgtcaattaatttaatcagatcaatatcttgctgagttgatctggaatttttcctgggaagaggaagagtattgggaaaggataaattggggtatggtctcttgaataaagtgctgggtgaggggtgaagtcctatgagagttattttggttatttttttggagaggaaggatatagtagagatgagagtaccaaaacattttaactgccatcagttttcccttgggacatgatggtgatttgccttaggcaaataatgggtgactaatgctccagcaggcatgtcaggatttgttttgaaaccaccaaggctcagggtaccctcactatactcctaggtccccagtgccacttgtaaaattcaataccatattaccacacccagtgacctcaaaaggctctctcatctcttcacacttcctttctatagactcactcaccagtgaggacctccagaaaggtaggactgtcctacctgaccactaatgtaataggaagacttctactaataatccccaatgacagtcatccttatgtgattccctcccctttgaatatgataggatggccctccagtgattattaaagggcaaaaggaactttgcacatgtaattaacgtttctactcagttgtccttataataagcagattattcaaatagaccaggcctaatttgatgagcgctttgaatgcagaaagttctctccagccactcaaacaagaggaagtcgagatttaaaacattggaagtatttgatgtgccattgctagcttggaagtggcaggaggccatgaataaaggtcagggagtggcctttaggagctgaaagcaacacctggccacagccagcaaggccctcagacctacaagtgaaaagaactaaattctgccaaggacctgaattagtttgaaagtgaattggttcccagagcctctagatgagagcccagttggctgacatatttattttgcctcatgagatcctaaatagagaacctggttgagtttgcctggacttctaatttacagaactgtgagacaataaataggtgttgttttgagctgctaagtttgtgttaatttgttatacgcaataggaaattaatataaccaggacttgtggcagtacttttactcagaacaacatatttagatttcaaatattttagtcattctttactattttatacgtgaaattcttgcttttttttttttttttgacagagtctcacttggtcgcccaggctggagtgcagtggcaccatctcggctcactgcaagctctgcctcctgggtccacgccattctcctgcctcagcctcccaagcagctgggactacaggcaccctcccgcacgcccagctaattttttgtatttttagtagagacggggtttcactgtgttagccaggatggtctcaatctcctgacctcatgatccacccgccttggcctcccaaagtgctgggattacagacgtgagccaccgtgcccagccaattcttgcttcttaaacataatatataactaaatgcataaacacataaaaataagtaagtgtgatggctagttagacatttcatacttttttataactccttcccctttcttacaccctaagtactataagccattcagatattctctaaatagctggtgattccacaatcatatgccacatcaaaaaattccttttaaagcattctatttccaaaggaagctgatatgatttggctctgtccccactcaaatctcaaattttagctctcataattcccatgtgtcttgggagggaccccgtgggaggtaattaaatcatggggtcaggtctttcctgtgctgttctcatgatagtgagtagtctggtggttttataaagggaagctcccctgcacacactctctttttcctgctgccatggaggacatgactttgctcccctttttccttccaccatgattgtgaggcctccccagacacgtggaactgtgagtcaagtaaacctcttttctttgtaaattacccagtctcaggtgtgagaacagactaatacagaagcacatgtaagagataaaatattgttttctcatcctcttctttatcatcatcatcatcatcaaaattgccattatctaccactaattgagtatttttaagtgccatttaattcttaaaacaatcccgttaactgcaaagaaatggaagatcaggaagaataagtgacagggtattagtgtttcctgtggttgggagggtgattagggaaagtattttaactaaaaagacaggcaaggccataatgctatgtggtagagttacatttctaccagagattatggggactggcaggtttagggatagatttaaagtagggaatgtttggttggcaatacagagaagagaactgaagaaagaactttattggcaagacaatcagcaaatttttcaaaagttcatataaaagattaggaacatcccaatccatctgcccttaaaacattttattttttaatgtttttgccacctctgaaaatgtataattctatcttttactgaaggcttacgaaataaatgtagcaatagtttatctttcaaataacccaacttcatcactagacattattgatagtattggggctaagaaacaggtactgattaggacttccatggaatggctacacaggttccctatatagccagtagtctttggtgggctcttaactctatagaaccatttccttttccttcttttcccggagcattctaccctatcccttcttactatcatccttatttctgtagtttataatctctgctgccacttcctctaggtgttttgtatacagatgcatatactttatctctactatagagggagtcttacagaacagagactttccggcatcagcctttgtcctacccaattctgaattagagaacaacttgctcttcctcccttttttggtcccctgtctggtaaagaccccagtatgcgtggctgcgtatcctatgccacaaggttctatcccccacctctcataatgtatagatcatggtctaaagcatctgtgttgacttctgggtatataccaaaattgactgaaaacaacgatatgaatagatatttgtatacccatgttcacagcagcattattcacaagagccaaaagatggaagcaacccaagtgtccatcaaataatgaatggatgaataaaatggtgtatacacctaaaatggagtatcagtcagccttaaaaaaggaaattctgacacatgctataaaatggatgaaacttgaagtcctcatgctaagtgaaataagccagtcacaaaagaacaaatattgcatgattccacttatatgatatacccaacccagaacaggtaaattcacagaaacagaaagtagaatagcagttgctagggaatttgggaaaggacaaatggggcattactgttcagtgggtatggagtttcatttaaagaagctgaaaaagttgtggagatggatgatggtgatggttgcacaacaatgtgagcatacttaatgccactgaactgtacccttcaaaaagcttaaaatggtaaattctatgttatgtaaagatcccacatctttgtttatattttaccacaatcatcataataaaaaagcatctgtgttaataagacagcccaaagaagatacaaggaaaagaaaactttgagaataaacccaaagaacaatatacagaaagcatgtagaagtagggcagtctgagaaagagggaccattggccatcaggagaaggcagtgtcatatgaggctgaggatggagagagagagggaggaaagaaggacattgatggcagagtgattgcagacaagtacctgtgacccagagcatggcaactcaacttggcagtgaggtataggaagaagagttccaatggaaaaagtgtagcaaaagccagattaaactgtattaaatcaatgggaggcaaagatatagagtggagatggcattttgtaggaaaccaccagttactttgggaagaatctcagagaaaaataatagaagcccacaattccttatccaaaacatttgagaccataggaatttagaattcatgatttttcagattttggagagataaaataatgcacatatgcatattatataataactggagcaaggtctaacagagcagacagtaatcaaacatgctatatatctgcagcaaaaaaaaaaagaaaaggaagaatacttacacttagtgaaataaataaccttatgcaatttaaattttggttatgttgctttactacaaactattaaaaacttttattttcagagatttttagatttataaattttggctaagagaatgtaggcctatactccaaataactggtagcaaggtggccagaactaaccagaaatattctctgagataagataggttaatagaatgctcagtttcctgcaatatagtatattaactcatgcatttagctcctatttatatctatacaagtatgcttagtcatgcaattccaaccccaagcttggcggattgttttatctatgccctctatgattagatcataatgtactaacaattctgttaaattcaatgtttaaaagaagcacaagtttctttacacaattattgatgggagataactttgctaacagaccaagcttaagaaaactatcatggttgtaagatatggagagaatttctatttttaaatgacagacctctaataaggaacatgtaactgtaattttcaaacttgacttatggttgatacttccagaagtaagaaaaatgtggtgaccaaagaaagttaacctgcggggtaaatcatgggttaaagccaattgtttttattaaatcttcttatcttagttatcttcctagaaccttaaccccataaattttctaaattttttattagcagaaaatacaattcatttactaaatttacaaaaacagcttgttatctgctcaactgatgaactgtaagatggcatcatgtgcctttcagtggagtgttgggtactcagatgctccaagggctgaagcaggtcctttgtctactcagcatatgggtctcagtggaatggaacctgcttcccccaaatgtgaaaaggactggggaaagtggtgggccaatctattgcctgggatgcactgacaaggctgagatcagcaggcaacattatttgcagcacagaagataaaatctgacattccctcagtcgaattctctgctcaccactcccaagccaaggacttgacctttgaatttgttttcatctagttcatccctagaaacacaaaagacctttcccatcaaatcttaacaggtaagcaaatggtaggagttggatattattgatacagtcagatgaatcaagtgcatccagtatcctttatctctcagccaaatcagagaacctactttcccagagaataacaatcattacagtccactgagtcttgcgtttccaattgtttctgtggcagctggctactgggaagttgctagggaattgaaagaaggcagcgtggggagggcagatggctcctttgggtttatttccactaaacgttacagctgtgaaacccactaacgttccaagtgtcatataaaatgcttgaagaaagggcctagttaaggaggagccaaagagcagccatcctgatgtgtttctttttctactgttgtaggtgaagcccccgtaaacattaaatgcagataccagatacataacaaactactcagccagaactcaatccaaaagtgtaatcagaccacaggaatcgctaaaactgattacagccagtattttctttactaaaggaaaacccaggaagatagcaactgccaaaggaaacaataaaggcagcaaagggtgggacttaattgatgaaagtaattttaagagcagacaatatttatttttatcattagaatgagactgtattgattttcctatttgtttctgagcatacaaaatgttctgaagacatcctgcaaataccacaataatatgcctaatatatattaagatgccaggagaaccaaaaaaaggtggagttgaataatatctcaattaaaatgcacacacacacacatccacaaatacctgtgtgtgtgtcacttgaaaaaaaaagtgaatcaaatgatgtagaatttttaaaataagtcatggatacctaaaaacaatatagaaatgtttatataaagtataatcctgtaataaaatgtaggtaattcttccaatgtttataactaataaagattgacaaaaactctaaatttgggggaaaaattacatgtgcctgttttgttgacagcctttcaatgtgatacctgaattttacaatgcacaccagaaaccacttcatgcagaccattttacaatgcacaccagaaaccacttcatgcagaccattttactacttcatccttggaatgtccttactttgaaaagtttgtaaaactataagatcaagttaacaattacataatttcaccaaagtggagatccatgttcaccacatggaactaaagacgacgactgtggtgggcctgtggggtgggaggatgcactcatgtgtctgtttgcatgcacatgcatgtaaagatgtacactgggtcttgtctctacattgaaataaaatatatatatacaacgagacttacatgcctctcttcagtgatgcagtattaattgtttatttaatttggttcaaagtaaggtcaaactctttcttattactgtatttttgctctgatttttttttcccaccatctcttcacggatgcataaaactgaatgttttcagaataatccaggtcacctcttgaatgcttaaaaacttattccaccagataccctaaatcatctctctcaaatttgaagtcccacatatctctagggcaggggcaaaatacggccagactccttgctaaagcataacaagagtcacctttattccagttcccaacatatacttcctgtcttcttctgagccctgtaaacagttccaacctccgcttgttattcagttccaaagttgcttccatattttcaggttatctttatagcagtattccactctacttataccagttctctgtattagtctgttttcacactgctataaagaaataacagagactggacaatctatggaagaaagaggcttaattgactcacatttctttatgactgtggaagcctcaggaaacttacagttatggcaaaaggtgaaggggaaacaagggatgccttacacagtggtaggagagaagtgtaaaggagcaacttccaaatacttttaaaaccattagctcttgtgagaactccctcactatcatgagaacagtatggaggaaattgcccccatgatccaatcaccttccaacaggtccctcccttcccttgacacacagagattacaatttgaggtgagatttgggtggggacacagagccaaaccctatcagggtatacacacatacttagaaggcgtaagttctgatgtttggcatcagaatagggtgactagaattaactgcaatgtattatacatgtcatagtagctagaagagataatctgattgttcccaacacatagaaatgataaatactcaaggtgatggaaaccccaaataccctaacctgatcattacatatactggcatataagaaagtatcacttgtaccccaggaatatgtaaaatcttatgtatccatacaaaattttttaaaataaggatagtatcttctctacataaaatttactttcatttttatactaactgaatcctatgaaacaactgtctttggctactataaattgctctctttcttacattatgtattttacatgtacctatttccccatagaaaatagattttaaaaacacacacacagaatatagtgaatattaagtatattaatttataattacttgggtaagaaccacacaggagagagagaaagaggaagaagagatctaatcaatgatacatctataaatctcatatatatatatggtctgattttttaaaaagtatacggatggcaaatacagacagcctggcaaataaaatagcagattttcacttatacttcccaactgtactgctaccattgagtaattcaaaatctcttagactaacaggagttcttaaccttttttacaccatgaaccccatcaacaatctggggatgtcaacgaaccctttttttccaataataatttaacatttgtaaataaaatgcatataataaaggatatcaattaatttttaaaatcagcaaaatcttaaaatcacaatatgaaaataagtatgagcatatctttgtatacgttaatatataaaagaaagaaaacattgcaggtataatagacgaacctttaacaatgattttctgcaaatgttgagattctactgtttttaagaattgccggaggagccaagatggctgaataggaacagctccggtctacagctcccagggtgagcgacgcagaagacggtgatttctgcatttccatctgagggaccgggttcatctcactagggagtgccagacagtgggcgcaggtcagtgggtgtgcgcaccgtgcatgagccgaagcagggcgaggcactgcctcactcgggaagcacaaggggtcagggagttccctttctgagtcaaagaaaggggtgacagacggcacctggaaaaacggctccctcccacccgaatactgcgcttttccgacgggcttaaaaagcggcgcaccacgagattatatcctgcacctggctcggagggtcctacgcccatggagtctcgctgattgctagcacagcagtctgagatcaaactgcaaggcggcagccaggctgggggaggggcgcccgccattgcccaggcttgattaggtaaacaaagcagccgggaagctagaactgggtggagcccaccacagctcaaggaggcctgcctgcctctgtaggctccacctctgggggcagggcacagacaaacaaaaaagacagcagtaacctctgcagacttaaatgtccctgtctgacagctttgaagagagcagtgattctcccagtacgcagctggagatctgagaagggccagactgcctcctcaagtgggtgcctgacccctgaccccgagcagcctaactgggaggcacccccctagcaggggcacactgacacctcacaaggcaaggtattccaacagacctgcagctgagggtcctgtctgttagaaggaaaactaataaacggaaaggacatccacaccaaaaacccatctgtacatcaccatcatcaaagaccaaaagtagataaaaccacaaagatggagaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgacgcgatcaactggaagaaagggtatcagtgatggaagatgaaatgaatgaaatgaagcgagaagggaagtttagagaaaaaagaataaaaagaaatgagcaaagcctccaagaaatatgggactatgtgaaaagaccaaatctatgtctgattggtgtacctgaaagtgatggggagaatggaaccaagttggaaaacacgctgcaggatattatccaggagaacttccccaatctagcaaggcaggccaacattcagattcaggaaatacagagaacaccgcaaagatactcctcgagaagaccaactccaagacacataattgtcagattcaccaaagttgaaatgaggaaaaaatgttaagggcagccagagagaaaggtcgggttaccctcaaagggaagcccatcagactaacagcggatctctcaccagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctaaaggaagtgctaaacatggaaaggaacaaccggtaccagccactgcaaaatcatgccaaaatgtaaagaccatcgagacgaggacgaaactgcatcaactaatgagcaaaatcaccagctaacatcataatgacaggatcaaattcacacataacaatattaactttaaatgtaaatggactaaatgctcccattaaaagacacagactggcaaattggataaagagtcaagacccatcagggtgctgtattcagaagacccatctcacgtgcagagacacacataggctcaaaataaaaggatggaggaaaatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcactcaacacaagagcacccagattcataaagcaagtcctgagtgacctacaaagagacttagactcccacacattaataatgggagactttaacaccccactgtcaacgttagacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagagctcaggattaagaatctcactcaaaaccactcaaatacatggaaactgaacaacctgctcctgaatgactactgggtacataacgaaatgaaggcggaaataaacatgttctttgaaaccaacaagaacaaagacacaacataccagaatctctgggacgcattcaaagcactgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaatcaagaaaaaaagagagaagaatcaaatagacgcaataaaaaatgataaaggggatatcaccaccaatcccacagaaatacaaactaccatcagagaatactacaaacacctctattcaaataaactagaaaatctagaagaaatggataaattccttgacacatacactcttccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccggacagagacacaaccaaaaaagagaattttagaccaatatccttgatgaacattgatgcaaaaatcctcaataaaatactggcaaaacaaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagacgcagaaaaggcctttgacaaaattcaacaacccttcatgctaaaaactctcaataaattaggtattgatgggacgtatttcaaaataataagagctatctatgacaaacccacagccgatatcatactgaatgggcaaaaactggaagcattccctttgaaaagtggcacaagacagggatgccctctctcaccactcccattcaacatagtgttggaagttctggccagggcaattaggcaggagaaggaaagaaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttgcaagggaagtcaaggacctcttcaaggagaactacaaaccactgctcgaggaaataaaagaggatacaaacaaatggaagaacattccatgctcatgggtaggaagaatcaatatcgtgaaaatggccatactgccccaaggtaatttacagattcaatgccatccccatcaagctaccaatgcctttcttcacagaattggaaaaaactactttaaagttcatatagaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacagctatctgatctttgacaaacctgagaaaaacaagaaatggggaaaggattccctatttaataaatggtgctgggaaaattggctagccatatgtagaaagctgaaactggatcccttccttacaccttaaacagaaatcaattcaagatggattaaagacttaaacgttaaacctaaaaccataaaaatcctggaagaaaacctaggcattaccattcaggacataggcatgggccaggacttcacgtctaaaacaccaaaagcaatgccaacaaaagccaaaattgacaaatgggatctaattaaactaaagagcttctgcacagcaaaagaaactaccatcagagtgagcaggcaacctacaaaatgggagaaaattttcacaacctactcatctgacaaagggctaatatccagaatctacaacgaactcaaacaaatttacaagaaaaaaacaaacaaccccatcaaaaagtgggcaaaggacatgaacagacacttctcaaaagaagacatttatgcagccaaaaaacacatgaaaaaatgctcatcatctctggccatcagagaaatgcaaatcaaaaccacaatgagataccatctcacaccagttagaatggcaatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgacccagccatcccattactgggtatatacccaaaggactatgaatcatgctgctacaaagacacacgcacacgtatgtttattgcggcattattcacaatagcaaagacttggaaccaacccagatgtccaacagtgatagactggattaagaaaatgttgcacgtatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaattagatcacatggacacaggaaggggagcatcacactctggggactgttgtggggtggggggaggggggagggatagcactgggagatatacctaatgctagatgacaagttagtgggtgcagcgcaccagcatggcacatgtatacatatgtaactaacctgcacaatgtgcacatgtaccctaaaacttaaagtataataataaaagaaaaaaaacttaaaaaaaattgcctttagacttactgtatgttgtttttatttaaattgatgtaacattgacataatatacattaactacacaattcagtggcatttagtgcattgacaatgttgtgtaaccaccaactctctctagtttcaaaacattttcatcttcccaaaagaatcccccataccattaagtaatcattccccattctccaccctcccacaaccacatctcctgacaaccaccgatctgctttctggttttatggatttgccttttttggatatgtcatataaaaaagaatcatacaatatgtgcatttttgtgtatgtctgacttctttcacttagcatgttttcaaggttcattcaagttgtagcatgacaacttgctacattttgagggtggagtaacacttcattgtatgtgtatattatgatttgttagattaacaggagattagtctatggagattcctccattgatggacatttaggttgtttctgtactttggccattatgaataattctactgtaaacatttatgtacaagtttctgtgtgggtatgtttttatttcctttaggtatatacctaggagtggaattgctgggtcatttcataattctatttttaaccttttgaggaaatgtcatacagtttctacagtggtggtaccattttatattcccaccagcaatgtacaagggttcctattttctccatttttgctaatactctttgttttccactttttaaattataagtatcctagtgaatatgaaatggtatttcattataactttgatttgcatttccctgaagaataatgatgttgataacctttatagggtctcattctgtcacccaggctggagcacagtggcacgattacagctcactgcagcctcaacctccccagctcaagtgatcctcccatctcggcctccagaatagctgggactactggcacgtaccactgtgcctggctaattttttaaattttttatagagatgggatcacactatgatgcccagtcttgtctcaaactcctggactcaagtgatcctcctaccttagcctcccaaagtgctgaaattacaggcatgagccaccttgtccagccctatgtcctctgcagaattgagtggctcgtcttttgttgctgtgccataagagttccttatacattctgggtattagaccattaacagatgtacaatttgcaaattacttttcccattctgtagattgtcttttcacattcttgttaatgacctttgatacacaaaagtttttaaattttgtaaacttcatctatttttttctttcgttgctcaggtttcttttttattacagcaaacatgtaaaatgatagacagacagacagacagacagatagatagatagatagatagatagatagatagatagatagatagatagatagatgtttaacaaaaataaagccagtattccacatacagtaacttcatacatcttttctgcaaacactgtgtgttaagtatcttcattattaccatgaggaaactagggctctggtcaatttagggatttgccaaagactgcacatgttaacagtggaaaaatcttctttctttgaacactaagcaatagaattagtttgacagattaaaggtgaataattaatcatgtggcattacttgtgctcatggaagctaaatattttttcattcaataaatatttgttgagttcttcctatgtggcaggtgccatatcagcttctagaaatagaacagtgaaccacacaggcagaattcttgccctcaagatgttttcagattagtgagaaagacagatgttaaccccagaaatgtaattatgagaggtgaagtgcactgtgctatgggaacaagtcataaaactctccccacaggaatacttatcagtacacttggacactttagtatattccatatgccactttcttatatgttgctttatattttttcaaattgtttcaaaggtacaagttttccctgattacactgaaagctctttaaggagggaaaccatatgtgataattctagtgtccttcacagtggtatgcatttcaccagaacaggaaataattattgagcacaattagaatggagagaaggagttaaggagtcaggaataatgaatccttagtacacactagtacagtaattcatgaaggatttataataaataatagttaatgtttattcagccctcgctgccattaagagatggtgttttgaggagttcaaacttgatttatgtaatatagaataaaaagagtggaacaagaattcaaacctaggcaagctgactcccagggctcatgtacataactcctctggacattgtcgcctacttaagagatcaaattttgacaattgtgtaaatatttcatagctaaactgcaaagttcatatacaacagcatgtgcatacacatgcaaacatacgcacatgcacaatattgcatgaatcaaaatcacaaattgcagtggaactgtgataactagggcaaaggagacagaaacaaagattcaaaaaatggtcagtaaactaaaaatatatgtcgagtaataacatcagtaattattataataagaaagaggtctggaaaaggtgacataggaaaaatcccaccctatactttaatgtatcctattttttctttcctaaaaccaatcaacccaagagggttccatctgtaatctaccacaacaaaataacatggcttcgagaaaatgacatactagagagactattacctgcaggatgcggcataccccaaacctacttttaacatacctataatgaaaatcgtatactggttatgctcacaagactgtcaacacaacataactttgacctgatatctacaaagcggtgaccttgaggagaaaaccaagcaatattgtttctgagaatggtatagttggtcactagtgtaatttttaatgttattttatatgtatgggaatagtagatgttgtctaccataaaagaaggtgaccaagtaaaacctgtggactggcaaattacttctccatgtagtaaacttgtataatattttggtgtggcaaagtaggaatttaccacacaattctagtctattgaggcaaatacagctatatttctgaaaaacgtgtcttgcacatattctacatacccctcactgtaaactattaaagcaaactcaaatctatacgacaagattaaacactgaatatttttgaaaaacatgagctattagctgttggttgacaaaactcatttctttatatttttatcttttccttttttcttctaaaaactttttaaaattagttatttcaaagcctatgcactttgaaaacatggaagaacaagtgctccactttgcagtattgtggattgaataattttccagctaactactactatttctaataagaaaaagaaattaaaaggtggaagttttgacttcttactggcaaggcaaaaaaagaaaatttaacacctgtggtgaaaataactctgaaacgtatcttcttccttacttccttaatttcttatgaataggttttgtttcaatgctctgtacaaaaaatgtttgttttaaaacttggagtgtgttttcctacagaaaccacgtcataatcagaggctgggtgctcatgctatgctataatcatgaggctttctgctcagtgttacacagtccacattacctgagcaggaactagaagaaatgaacaaaaacagactcccatggaccctgatttctacctactaattggtcaaagacttcagtcccctaaacccaagccccaagctgcttctgagatgtccttaggtctggaatccaccatggatacaatacttttaaatattcctcctggagcccagcagtacctgggaagaagccagcccagttctccaacaggagtcacgggatgtggactggcagctttccatggtctgtgcagagatctgtaggagcttgctgagtaagggaagcaatttcagcatttttatattttggcaactatcttcctatgagcacaagaaagacagccctgagcagtgatacatagcttttgcttctcctcccttcccatcagctgtcgcttctgctatcagagtgccagccacgaacagcctccccacttgtaatttgctgcggctaatctgtcatctgagaaatcagatgaccagagccgttagaactatgtgtaaatttagagccaaactctgaaagacagccagagaccctctcctttaggagatcttatagcaggcttcctggcagccatctcctttcttttcaaagctgttcttatctaattccctgcttgacagtctcaaaaggctgacctccatctgcaagaggtgtttgcattgcacgataagtgaagaacacaccagaatggaagaaggagacatataatctagtgcctgtgccaacacctactctggggaccttcaaactcacaaaacctctctgtgttctatttcctcactggtaaaatgggtataactatacctgtcctgcttaacagtgaggcaaaatggatcaaacattttctattgctttaagaatgagttattatgaaatcaatgtatttaaaaagaacaatcatcattctcaggggtctgtaaactatagatgcaggccaaatcaggcctgctgcctgttgttgtaagtaaagttttattggaacacagcgtcaccctctcctttatgtagtgtctatggcttcacttatgctacaataggagagttcagtagttgtaacaaagatcatacggaccacaaagcagaaaacatttactatccagccctctacagaaaaaagtgtttctgatccatcttaaggtatttttaaaaagtattatttttaagcaaacaaggtttcattgtcccacacaaaaaagtgcaattacttaatatggcatatttcccaacacagtttgtacacttaacagaagaccttcaacagaaagttacattaataacacacaagaaattcattacacaaattatctgctatgtaaatccactactgtgaaaagagtagtactcagaattattttaaattcaattcttaaaagaataattagctcagagctaagatttatttctggtatgtaatttagggaaaataaaatcagtaatacattattacgcctattgtgtctcacagcaatgagggcgaccaagccgcccagagttgtcagtgccaaatacactgtgggagctcaaatattaatcaaattgacatctgcaatattttcctttcctaatcaggcctaaacatcatgggacatccggcaaatcaataagcaaaactagatgccctcatcactcctaacctggcagcgccacatttttagccagaggacgagggccctcagtgtcacataaacatttctttacctcagttgtttgccactcccaagagtgtgtccacctacgaccccaaaatttaccctgtcatccatctcactatgccacctatcacagaaaggaacacccttatcagtccaagataaaataggcacagtggtacatgactctagaatatgcttacgtattctgccaaagagactcgtaagtaaagtgagaataggctcttataaagtattcgtgaaaaacgcaagaggcctcgcaaactttcctctataatcgaggaagggtggcacagggacttatgctataccccatactccccaagctcccaccaaggcagacttctggcaagttgagaattaattacttttggcttcaagccccttttcctgccttttctttctaggcccctttcctcaaaactcttctcccactaacacctcctattttctctctgtgggctctggagttgctctagtgctgaaagatctgataaatacctttatgtcaatttattcctccttcacgtagttagaggaggcagagtgctggagaaatgaaagtaggaataggtctgtccacacatggaactaagtgtgaaccctgtggagagaatagtaaaactaaaaggccaaggcccaggaaaaattgactggagtaggaaatacacagaccttcacctgaggaggtgaaatatgccctgtgaactccaaaaccctagggaagacttgaagcagaaagctaaggacctgcttacagttgggcagtcaggatctaagagccataactggccaatgttaaggtgaattaattcatactcaatctactgaggtaagggcacttggattaattagttcactcattcatttatcattcgtgtgccaggcacatccatgagcaagtatattccataccttcaaatagctcttttcagcctgttttggctttagttcgtattttccccctagctttatgaaaatataaatggaaacacttcctgatctcagaccattcaacctttgtaagtaaagaataaaacagaaatcaagtgcagtaaacatgatggaagcatcttagccagctgaaatctggcttggaaaagaaaacataattcactaaattgtaaccaaaattaaaattgcacagattaaaggcaaaacacaacaaaggcaatacccaacacgagaataaaggaacagcataaacttattcaaaaggaatgaatgtgatatagaaagttgggccaccagccaccttcacagggtgttgtaaggctcaaatgaggtggtcaatgggattgtgtctaaagaagtgaagaggcacgtcacaaatgtgaaggtctgggtagaatcattaatactatcatcaccaattataagctcatcttaagatgagttgagattgtttttaaactattaatatagacaaccaaaagatgaacaacttatattctctaggttactttggcactaaacctatgcatactgtttgatacggaaattctaaaacaaactttttatagaaaatagtatagataaccaactataggagattcctcaattaaagcctagtatgtccataatgacaactctatcgattattgtccatgtgacaacccactccgtcctttcctacccttctgtgtccttccttttttgtgcacagggaggctgatgcccagaactgaatgcccttcctctctcactttcagtggattaaattaatggaggtgactgcagaagaaaaaagaatttcttccaaccctcccctctctatgtgagtcctccatctctggcaggagctgcttcttttctatgacttcatggggtgaccattcctcctgagcttcaactctcactgggttccaacaacaatgttttctcctctttttgcttcagtcctagaggtggccagagcttcctgatgctgccagtgcctgggtgctggaggccctcaccatccattccttgtctggtccctaatccctgcccacacctctataaatagtcctttcattcaagtttcttcatttgacccatctgggttgacttcagtttcctgccaggactgtgactgaaatacaatatagactaaaatacagtaaatatctatttattgacatagaaaaatgtctgacagaaagtagatcaaaatattaatagcacttattattattatttttttgtttgagacagagactcgctctgtcgcccaggctggaatgtagtggcgcgatctccgctcactgcaagctccgcctcccgggttcacgccattctcctgcctcagcctcccgagtagctgggactacaggtgcccgccaccatgcccggctaatttttttatatttttagtagacaagagcacttattaagtagtaggataggattatttgtttttctttatatttatttttcaaacgttcttcaacatttggttatgtatttgagggtgtataaaaaagaaataacaaaattaaaatacagaatgggaataaatataatctcaagaagtactaatggtttggctttgctttacttcccactctggcaaagaaatacataaataaaaagttacatagcctaagggtatcccgatgggaaaaggggaccataaacactcgtgagtgcccagatatttatttattcttgctggattctatcacctatgaaaaatatgtttagttaccaagtgttcacaactgaaaatgcaattgggcacattaataagcatatgtgatttacaggcttatattttataagcagaagtcaagactttgctgcattcattgataataacaatagtcaactattactaagggctaaccacctgcaggtactgtttataagcattgtaggtattagctcatttaatcctgataggaaggcagtattattaccccatttcatagatgaggagattgacaagcaaagaagcaatgtaatatgatccgaggtcctattaacaggttctggaggcaagcccaggctttagggcctattttatctattataattaactgttgctcaaatcaagaattctaaaactcccctaattttgtgtatattgtgcaaagaacaagcaagaccctcaaactggttcaccacttattagttgtacagtcttgtacatttatgtatcacatctgcaaattcctcatcaataaaatggtgaataatacttctctgacctacctcagaagttgtgagaatctgatgggaaaatgagcaggaaagcccatcaaagctataaaacaatttacaaatgtaaggcagtattaggttgcaccctctaaacactagtacactagtcatcatcacttacacatgacagtaaaatgcaaagaaaatagcaattattttggtgaagtatggctctaaactataatattataaactatccagtctgttaataacacccaacataaaaccaccactgattaatcaataaaaatcatgctacagtttcagtgaaatgtactctcaaacgaactcccctgactcacgttcattaattacctcaccttatttgatatgttccagcattttctggaatgtattactctcaatctttagttatttagtaattgttttttaattttaaaaagttcaaactctacattctctatgatatgatatcaaaagttcaattgagccactcagttttcagtttccctgactcaactttttggagttttataattaattatattccattattactgatcatcaattagctcaaaatgttgctgagatggtgagcatgctgaagaaagcagaatttaatgataatttgagaccagtaggacactaaatttctctcttgttaataattaaagtagataacttatgtttttatttatagcttccagaaatatccggctcattcctgtgcactgccctgtcagctaatcatcagttggtcaggatctgacttaggccgttgtgtttaattttgcacacatgcctttaactgaagccattaaatgcagcccaaacaaaggttaaagcaagtgaggtcatcaccgtgtcttctctgaaactttccatctggtcaaatgcttgtacatcataaatatataaagaatgaaagggataaaatttcaacttacctgtttcaatttcccagatataaactgagtcatctgcacatccaacaattaaaaaattctcaaccgggtgccattttatcatcctcacaggaaaaaggtgcttccgggcatgcaggaggcaactctttccctcaaggtgaaggagagccacggaatggtcaccgcacacacagcaaattatctgctcaccccttagctgtgaaaaaacaacatgcttatgtaagtaaatagtcaaatgctttctttatgagtaagtcagatttttttctcccagtaacataaaaaagttttgttaaagccccatttacaaaaatgatatttctgctttctacagcacctttcatgtaaccctctacagaggagctttaaacacagagtggagtctaagctcaacaacttcacaggaaggtcaaaagatgaatccaggacagatctacttataagataaatgaaggacttgaccatcactcagcaaattcaggcagcgaggcagacatcggaaataatgcagaataaaataaaccccagaactaatttgttgccacaaaaagaagctatttgtagacacaagcttaggcccaagggtatcatgagctgatattttccacttaaagcctcaaaatgtgatttggtgctgttcccagaactatacaggttctaatccaaacaggaaactcagtgtagacacagtctaaaagaggtaagcattagatagctccaactgaatgtacagcctcaaagacataaggaccaaaaataggctcccaggacaacaatccttaagatactttttaagaagtcagcatgtggttaccttgaacaggttacgacaattactatccaaggtggattctaatgatctagccagaaatttggctgttttgtttaaagcatcagtttggagaccttgagacacccattactcatcattaacctctctggaggcggggatgcagggaggattgggatacatgttttctttcctaattctttattaagtgcactccagaaatcgtaaggaaaaaaaaaatcacaaaatggcaggtgtgatagatctggagcctagacttgcagaacggatcatatgtcatttttccctaaccattctatttcctggagaacctgcccatcccacggcttctagaacaggcagcccaacgtgctccaggaaacttacatacatacacacacataccgtgtgaacacaaatcttatggtcaggaatagactatggagaaataatgtttataagccaattaactgacttaaaaaatcattttacctgtgttaccatgtccttttactacagaggaaactcaaaagttggttgttcatgttttttttaagtcaactttacaaaagctgaatttaagttgacatttcatgagaaaattctacctaaagcgatttcattttgcccataacaaggtagatgctcacaaacttattaaagctcattctctgttaaataaatgaataagcaaataaaaacccatttaagaagaaaatgtgctgggcacaatagctgatgcctgtaatcccagcactttgggaggcagaggtgggaagattccttgcacccaggagttggagaccagcctgggcaacaaagcaagatcctgtttctacaaaaacaaaaataaaaaacagtagctggactacatgcctgtagtcccagctacttgggaggctgaggcaggaggatccctggagcccaggaggttgaggctgcagtgagccatgatcacgccactgtactccagcctggatgacaaagtgagaccctgtctctctctctctctctctctctcacacacacacacacacacacacacacacacacacagaagacaaatgtaactatttatcaatattattataaaaagaaattcttgacaaggtcttgctctgttgcccaggctggaatgcagtagcatgatctcagctcattgcaaaatggaagttattgaaggcaaaagttaatttctaatttatagattcctatattgtttgacttgtttttgccttgagtatctacttttttaaaaaaaagataattccattaaaaatgaagatatagaatgagaggaaaaaaatagatgtaagtacttgaagagaattaagtggttgttgtaaagctaagcattgactaaatctttgctttagagccaaattatccgtctaatgtaagttataataatactacaattcatatagaaagattagaaataaatatatatgaatcatccagttgtattataagtacatagaactcatgtttttcttttctttggaaatatgggtcatttttacttgtcttattaagtattctataatttatataattttcaaatttagatgttatattttactcttcgtcttactttaaacttctctggtgacatcaaaagacttgttactggaccagcttccaaaaagaatttatgcaaaatttcttcagtaaagatatcccacaagatcacacatgagtccaggtccccagacaacatccaactttggtctaatttcgaagagagaccatgtggatagagtaatgaagtgacactttggtggtggcctttaagaactttatgagggggagaatctgaaaaacaatgaaacaccaaataatacagatgttatttttgttcagaaaatcgtcccaagattctcttctataaaattttaacataaggaaattacatataattaaagcatgcacttggctaagaaaactagtgaacatccttagatcatcttgaaaaacaagtgcctcaccagaagccagagtatgcttttgatgaagcactacagttagttgttcaaagtctattaattctaggccaggcatggtggctcatgcctgtaatatcagcagtttgggaggccaggatgggcagatcgcttgaggtcaggggttcaagaccagcctggccaacatggtgaaaccccatctctactaaaaatacaaaaattagctaggtgtggtagctcgcacctatagtcccagctacaaagtctattaattcttaaggacattagtaagctaccaattccagcgtcactgaatagtaaacactgctctaaaagagtgaatacttcgtacatttacctccacaaaaataaattcagaatattacttattttcattcatttttttttttttttgagacagggtctcactctgttgaccaggctagagtacagtggtacaatcatggcaccataagacaaaacttctattcctcaagttccctgggctcggatgatccttccacctcagcctccctagtagctgggtccacaggtgagcgccaccatgcccagctaatttttgttttttttgcagggacagggtgtcaccataatgctcacactggtctcaaactcctgggctcaagggatccacttgcctcagccttccaaagtgctgggattacaggcggtagccaccgcgcccagcccgtcattctttaaattagaatgactaagtctagtatacaagaaaataaaagtttcaggaaatatttttgctttgaaagatgttagacattacctaattctacctcttggctttacagataaagcatctgaggctcagagaggttaagtgacttgcatccaagtgtgaaaaagcaaagcaaaatgtttaagagtacagcattgctgttaaattaatctgccttttctccctgggtctatcacttactagatatgtcaccacatctagttgccttttccctcttaaccacagatgttacatctgaaaatttaggataataatattccttacttcggacaagactgttgtgtggaataaataagataatgtctataattttgtagcactctgcttggcacttggtaggcatatgggcatttcaaatcacagctgtatgagagcacaggactactgacacactactgtgctagggggttactcttcccactaaccacactgcttcttccttcatcattagctaaactcccccaaactggaaagaaccataaaccacaaactctctttattcaaaatgaaaataaacatcaaattattattatacttcggaaacttctattccttcaggcatatcctcactttttatctcctaacccacctggatgaatgttcattgaggtgctacaagtcaaatatggctttttcttgctttctggatattagggtaaatcagcctagataaaaactgctaggtctttgctttttcactaacttttaatggcagccatttagctgtataccagtacattacctctctttggttcattgccatttactcctccacttcagtcaatcactgaagcacaagtcagtaacatttagtaagtggccaaagatatatactcacacatctgtacagatatgctcacatatatgtacaataataatcaattctgcattgtccatagtagctaaaaactagaaaacctacatgccaattaataggcaattaaagttcaattattactaattatttaaagtcagctcataaagaatgaactccacaatattttaattagatttgtttaaggacatttgagtaaagcatgtagaatacatttttatttgtgcaatataattaaaagactgtatgttgttatgctgatatgtgcttgtacacacatagaaaatttcaagaagagtataaataaactgttattagcagttgcctttggagaaagaactggaagatcaagtaaggagaaaaaatcatttcttattgtgtagccttctgcttgagttttttttgtttttggttttggttttttttgagatggagtggagtcttgccctgttgcccaggctggagtgcagtggcgtgatctcagctcactgcaagctctgctcccaggttcacgccattctcctgcctcagcctcccaagtagctgggactacaggtgcccgccaccatgcccagcttttttttttttttttgtatttttagtagaaatggggtttcaccgtgttagccaggatggtctcgatctcctgacctcgtgatccgcccgccttggcctcccaaagtgctaggattacagggagtttaaaaaaaaaaaaaaaacctatatgtatgttttactttaacattaaaatatgtacatatttatcagcaaatgccagcaaattatttaggcctctaaatcttgtttagtgcagtctgttgaaattgcagctttagataaatcaaataaatagggtcaaataaaattcaaggaccttttactaaagaaccaccttccagaagtcttgctttggcagcattcaaagcctgggtaatgataattgtcccatcttcacagccacatattagtttatcaagacttggaatatactctgatgaagtgactacagcagttcctgccccatctttaagcccagagaaatagtcaataatactttgtgacatagtatcatgcttatcaaaattatcttgaagagtccaggtggcagttactggtatctctaaaaagaaaacagacataaaaagaaaatttggtttatcagtacatcatagacatggaaaatatcaaggcaccctcccttcaaaaatatgaatacagtgttacagcctatcccagattcatattgccagcattcatctcttgggaagttcaattgatgttaacatgaattatattggttatattagtatataagatccataacctttgtgtgtgtgtgtttttaattaaaaaaaaattttttttttgagaccaagtctcactgtgtcacccaggctggagtgcagtggcatgatctcggctcaccgcaacctccacctcctgggtttaagcaattcacctgcctcagcctcctgagtagctgggattacaggtgcatgctgccatgcctggctaattttttgtattttagtagagacggggtttcaccgtgttgcccaggctggtctcgaagtcctttgctcaggcaatccacccacctcagcttcccaaagtgctaggattacaggcatgagccactgtgccccgcctaagctttgtgtttatacctgctttcatgttgtcatttaatacgtagtagtacacaataaatttttcttgtttgtggtcccatgctgctcaacttagaagaacaatgaattaattacaaattcattctcagaagacatgttactagaaaaggaaactgacttacctctaggagaaccatcaaacttggatacaggaacatcagggatgtgccacaaagtaattcttcctgagacttctccagagaaaagtaccttgtaaaaaggctctttcctttcattcatgtagcccataacaaagggacggctctgttcctaaacaaaaagtgagcttttatgtaggaaatattctaactagagagagatggccactgtttttaaatggagaaacaagacttaataactgaataaatcttttcaatttatttcccactcttttgacattttcaagtaaattaaatgaaataatctgtgatctaggactaaagaggctttataaaacaagaagcaaagtcatagacctcagaaagtcaataaaagtatctaacatttactgaccatgttatatgtgcgtgtgtgtgtgtgtgtgtgtatatatatatatatatatatatatatatatatatatatatatatggctatgtgtacacattactgcaaggggctttctacatattcagttaaataatcctcacaataaccctataaaattggtactatcattgttttcattttacagacaagaaaacttggaatgaagagattgatttgtctaaggcgattagaagaagcaatgggctttgagtccagtcattgtgattcagcaacccatgtcttgatgctaaagatgtccactgagaaggcttaatttctttacagttcctttatagttctaattgtcagttaaaacagcaacaagtaacatttgtatagtaattttgttattaatatgttttctacattttgttgactattttcagattgaacatacttgatttctgatttctcaagtggccacaaaggaaaatgattccataatttataatggtgtgtatatacatatataatgttatacattatataaattatgtataatattgtacattgtatctaaattatatataacttatgatcttgctgaagcagaatatgaatattgggcaccagcgtttttaaagctatgccttcactcatgaatgcatttagagcatccctagtccttctcagggcagtatagctgttcttcgggcaggtttgtatatagagattatgcataagggatcaaaatcatttaagcgattacaaaaacaaaacccaaactctctttggcgcagaaataaaagtcatcctaaaaagaaagccaactgctggtgctagaattaaagaagttcaggaaagtgatgcttcctagtcagaaaatacatgctttaaggtctggatttagacacattagtgaaaaattctattcattagtgattattaaaggccacgatattgctacatttaatcttcacaacaaagctatgtagtaagtaaacattgctattatcctgatatgaaaatagggaaactatcacagaaaataagaaaccaatccaaggtcatccaaccaagacgtataattaattccctatagtcccaagaaataagagcatcacagaaaatggttccaataaagtcagtttctaaatgaatttttttttttgagacagagtctcgctctgttgcccaggctggagtgcaggggcatgatctcggctcactgcaagctctgcctccagggttcacaccattctcctgcctcagcctcccgagtagctgggactacaggcgcccgccaccacgcccggctaattttttgtatttttagtagagatggggtttcaccgtgttagccaggatggtctcaatctcctgacctcctgatccacccacctcggcctcccaaagtgctgggattacaggcatgagccactgcgcccggccaataaatttttttaagactcagagggcactttggtgtcttacagccatgatttttatagctatttgaaatggtgttgataacatttggttaaattggctactcaaactctcccacccttgtatgcacttagaactgattgttccaactccctggttattctgatttgaaaaggaagctccaagaggctgctgggttactcgagttggtggcagcacaactcctcccagctggtgctttgcctctggcagctgaagttccctgttgctctcatcccctctgccttcaccttccacattgctgcttctcacttgctcacactcaccgcttggtccctcgctcctcctcctcccaaacagttccctctagttctgctattcacctgaaaacttcttcatagtcccttaccatgtgaattccgatttttcatcactgtgtccatcataagagtctccaccacccaggaggtaataaaacatagccattagcactgaaatccctggggctaactgcctggatttaaatcctggctttaccacatcctagctctattgaaagagcaagttggttactgtaggcaatttagtgcacctcactgtctcattttccctaactgtgaaataagactaataaaagcacccgctatatgggattggtgtgaggattaatgagtagataaagataaggtgcacaggatggtccctgacatttagtccctattcaattaattttaacaattctggtaattcttttctcagaacaattaagaaactcactccaaaacccattactggatttgggctaaaccacttgaattcaaatcctgggaattcacctctctgaacatcagtttcaacatgggatcttggtggcaactaaagtaaatgaggttgtttgtatgtttgacaataataaggactcaaatgaagtttttgtcatcatcatcaccatcatcatcatcaccattactcttagttcatgcacacacattttttatttgcaattcttaggctgtttctatcccagctattcccacttcagcacagcagtcttactctgtggctgagaccctgggaaaaccagttccttgtctcaatagccaggacccctgcaccacaggcctcagcaattaccagctgtgatttgaagctagggagatcctcatgcagctgctggaaggaaagacgaatcctcattcttaccactgtaactccatcagcagatatgtacatgggcattacaaacaataactgagaacctgttactgtcaaacctggagatttaattctatggtattactccaaaaaatgagttcagacaatagtacctgcttacagagcagtcttttctaagctcactgaatgtatcaaattcatctcttcatcctaccacaatgccttcattacttggtaactgcaagagagactaaggactcttacatttagtgaacactagtgatgtttgaataaggggaagaaagtctgactttatgccctggataaaaggcaagtaaggacaggcagaccagctttttccagtttccaattattctattcatatttcactggcttctaggctttctcgcttttaagatacagaaacatctatggttgtttaaacaagaattactggtaaaagacctataagcttatgtcttcacattttgagaaacaaagcaaggtaacttcccatgagattagttattttttaattgttgtattctttcctcatggttatacataacattgaaattttcaggaacaagaagcccctaaagggcacaactgatcattggctttcagggcaaactgtgctttgtaaaaatgcattcaaagctaaggaggaaagaccagatcctttaaaaaataactgaatatgcttttctgagtaagccccaatactgtttttgtgatcgacagcaaaacaggaacctattactgcccacaaataattttagaaatagtggttgatgcatgccgtaattataaagtttgcttgtgtcccagtggcacttggggttctaatttttggctgacagtttcttaatcaagttttcacaacaaaacctcacagatatgttaaagggacaatcactgaactataggatttccaacagctatgctgcctaattaagcaaaccatcattctgttaaaagtagcatgcttccttggttgacacatcaataattcaaaactcttccactctccatgaaataacgtttatggataattaactgatgacaaagtccaaaggctcagggaaaagaaacactttggataacactactgaaagaaaacaactgcttaaattttcaggcttcctagaatgtcagaggtatgattcagtcaagtaataagctcacatttatattctcaactctctgccaaaagcataattatatttgttttaacaagaaaatttattcgtaagaatagctaaatacatctgaaaatgatatcaatatatgattaaagaaacagaacataaaacatttcataaagtttaaaaattggagtagatacgtaaaaatgttaacaatgttttgtcacaccatttatcacaagggtcagtgaaaaaatgtgtggtgtgtgtgtatgtgtttgtacgtatacacacacacacacacaaatgcagagagagagacagagaatgagaaagtaaatatagcaaaatgttagcaattggtgaatctaagtaaaacgtatatgaataattactacactactcttgaaacttttccaattatttgaaaattttccaatcaaaataggtaaatacatacaacaaagtaaaaaaaaatctcagtgaatatgtactgcggtgaaattaggaattttaatttctcctttctttttaacatttataattttcctataataaatacatattgtttcattataaacttaaaatacagacttaaacatagcagatttttaaagacaaagttttctctttggtagccattgataattaaacttgattttctcattaacaacttgatgggatgcttcaattcaattttttcaagcctgattctgtgacagacaaagcaacacttatccaagaaactgagtgaaacagctttgaggcagtcactcttttcttgcattaccttattttcctgcacagaagtagagcacagtaaatgaggataaatggtctctttaagcactcttccatcagcagggtatatgctttttgaaagcccactgcgtggcaaaaataaaaagcaaagtttagaactttgaggttctttattcgttttttttccccctcccactttcaaaagccggatggtaccgttcaagtttctaaactctagttagaaattgttgggttaataattacaagtgactttttgaaaacccagcaccagctgtacaagttatacatggttaatctcattcctccatcccctgctgttttgtacaaaggctgaagcctaccaagcccagagtaaatcttctagtgccaaagttgttttgttctggtttttgatcatgggcagcatgcagggatttttccataataaacctcccaaagttcattttctacctgaatgttttgtatgccgctcccatctgagcccacctgttcagcagctgatagatgtaactgtgaccatcttctgtccagatgaggattctgtgagcagcaatcacttctccaccagcaaagaactgcccatttctactaacttcagtcagcagaagggaaaaatcacaataatcataaacctaaaatatgaagttgatgcacattatcaaaggcttaaatctagtctgccaataagatgaatataaattatgatagtaataatataacaacatagtaagcgttaataacagaccatactgtactctcatattaagatgatattttaccatgacttattgacttatatttatcttagggtaggtttcaggggatacagttcatctggttatatcattccagagtgtgtacactaaacatagaaaccccaaatcccaaaatttctaagtaattttattctttccataatgagtactccaagttttacatttgaaaatgtattatgcacataaaaaatatatatcacgtaaatcttttgctagaccatatacttttaaatctttgttcaaaaatacattatcaccacacaagtaagactgtatagttttgttaactgagccagttataaaaaactttaaagaaaaataaatgttatgaaatgatggcaacttagcttttctttcttcttggaaatgtcagcgaacatattcacaagaaaataacgtttgtccctcttaaaacaaatgtagtgacaaagtagaaaaagtaaaacatctaaaaatataatcaaactatgtaggtgaaaagtatatttttagttctgaaatgtaaacaccaaattttgaaaacaatttagagctaaatattcattgttattatggtttgttactaaaattaggatatgctactacatatataatatcttgggatacaaaactgttgcatataccatgatattaaatatgtagtagtatatcctaattttattaattagagagttaaaaactgatatgtcaggccgtgtccagtggctcacgcctgtaatcccagcactttgggagtctgaggtgggcagatcacgaggtcaggagtttgagatcggcctgaccaacatggtgaaacccggtctctcctaaaaatacaaaacttagccgggcatggtggcatgcgcctataatcccagctactaggaggctgaggcaggagaactgcttgaacctggggggtggaggttgcagtgagctgagatcgtgccgctgcactccagcctgggaaacagagtgagactgtcaaccaccccaccgccaaaaaaaaaaactgttacgtcagtcataaaagacacatcattccatgttctggtaatactattacagagaatttgtatcatatttaaatcatattcttatttttgtacaaaacaaaaaaaattacacttgtacatcactggtatttattatgttactttataataccttccaacatttagaaaataccaccaatagaagtctctcagtatatgtgcaaaatcgaattgtctggcagttcaaggactcaagaaacttggattctttttcatagacatcttgcttttccttcaaaaggaaagaaaatcttttagtactagttccaggtaattcatacacagccatgagaagacctgcttcccgtacatctcaagtagatcacaccattataaaacgaaaagtatctgagttaccttttgagtgttttgaactaagaagttacttggcaatagaagctgtgtacctgggtgatgaaataatctgtacacccaacccccacaacacttaatttacctgtataacaaacctgcgtatgtactcctgaaagtttaaaaaaaaaaaaattaaaaaatataggatgtatttcttgaaaaaaaaaaaaagctgtgatcaggaaatccacttagattcaagggctcattacatgcaaccattcaacaaacattctttggggaactacggctggatgctgagaatgtcaagatgagaataagctacagactgttagatatggcagaaaggtcaaacaaaaaaatctaaaatgatgactaaaaaaacctacagtattttattttattttattttgttgtattttattttattttattttattttattttattttattttattttattttttccttgagacacagtcttgctgtgtcgccaaggatggagtgcagtggcaggatctcggctcactgcaacccccgcctcccgggttcaaacgattctcctgcctcagcctcctgagtagctaggattacaggtgcactccaccactccctgctaaatttttttttttgtatttttagtagagacgaggtttcaccatgttggacaggctagtcttgaactcctgacctctggtgatccgctcgccttagcctcccaaagtgctgggattacaggcgtgagccactgtgcatggcctagtattttgattgcttaaacagaaaaaaaatgaacaaagtgccaacacacagcacatagaatagtacgttctcaataagtttgtgaaaatgctggatgtgtatttcttaagctcagcataccatcacaattcctaggcttcctcaaccaataaattcctaaaaagaccccagaactccttggggaagcctaaataattttgtcatcaacacacatagtatggctgttcttttgtccatcatctcaacttgtagcctgatgccagtgaatagatgaatatactggactccccagggacatgcccctcaagtttttagggtcatttgcttgccactgttcacatatactcagaaaaaagggggatttcctctgtaacgaacagagagatgttctattttttaaaagattaaaaatgtaatctttctgtgtgtgtgtgtgtgtgtgtgtaaatgaaaacatttgtatatacatggagaaaaggttggaaggatacaagccaagtgtaccaaggctcacccctgggaagatggatgggggaaatatatggaagtagaatttatacacttctatgttatttgaacttttgacaataaacatgtaatagccttaaaatttataaattttaatgaatatgcttgaaattgtaaggaaaaaagagtagggttcccaagccaacctgaatgctgttgatagatgaggaaagatcccatactttgagctcaccagctactgataccaccaagagagaatcttctgtgaaaataataaaagtcacatataagcttaccatggatataattgggtaggtaaaaatcatttcacagtcatttaagaattacgcagggctgtgtagatagaaaattttcagctttggagttactttttaactagaaaaaataaacattttacatcgtgctccaaatctgttttaaaatttcaaagtgattcctaggtataagaagagcaccactagaagcagaaccacattgcaaatcatcataaaatgaaaccttcctatttcggaagtaagtgaggcgccaacttccacttccctttgcagtcactcattacagaaactgaattatcaatactacatctagaagatacagcagggcaaaattccaggagtcctgctaatccacaacaaaacctgcttgtcactcttaaaatgtaacaagcagaacttggttataaaaacacaaattctcctctttccccctcatcttaaccttttgctgactttccaatgttttgaaccactggcatgggtgttcttagtttttcttgatcaggtgtattacagacatatcctcattaacaggtaagcataaagaagcattctttctgaatttctgcccaataatttgacaaataattcaaaagtagatatttttatatgcaatctctctactgtcagataatatccaactattaccttgaattctcatggagtgaacaatgcacatgcagttgatccagtcaggaaactgagatgatctaaaactgtgaacaacagccaaagttttggcatcaattataaggacatcttgatattctccacaacaaagaagccagccttctcctgtcatccggaatgagcagtggtaatactacgtacatggaaagcaaagcaaacatttaattatcactaaaattaacataatttggctacattgaagatttctctagactttagttttagcatatgatcaattaaggtattgaactgaatagcaactaaaatttctcttagttcagttattccaaactcctattggcactttagtctcatttgcatctcatgatttttctagggaaagagagatcgcttggaagaagtaattttattctaaatcatggaaagctcacaattatattatttctggagtgcaacttggaactaaacaacaacaacaggaccaggcacagtggttcatgcctataatcccagtgctttgggaggaggctatggtgggaagaccacttgaggccaggaatttgaggttgccgttagcaccactgtacttcagcctgggtgacagagcaagaccctgtctcttaaagagaaaaaattaatagcaacaacaaaacccaggttccttgccatagcaacaatgctgtatgttaaaaagaaataaagtatttgaagggcatttgaggattattatgccaaataagttttggaaatcttttattaaagatcaagtaatgcattctactttcaaccagctctctctgtgcagggttttatttccaaaaaaaatagaagagagttcatgaatgttacaatgcacatcagcaacactaagagtgtaaaatattttaaaacacggtcagcaccattggaatcatgcaaccacactacatatgcttggaaaccatctactaaaagccaagatttgctttaaagattgggaagtgattataaaagttatatacagagaaattaagaacctatccaccaaaacatagggtttaaaattggaaatgagggagaaaaaaactgtgtgtgctttataagacagcacatcattaaaactgaatttttacacatgtacaagtatgtgtatgttttgtagcactaaggcaatatatggaaattgtctttcaaatctgttagaaagatacaaaaatgaaagaatcagggggaaaatctgcttgaataatactttttgggaaagcaaaatgccaaaacagcagacaattactggtgatatttgaccctcatgacaaaataaaaattcaagcaaagaatattctccaaagatgtttctttagaagtgtatttgcaaatgccctaaacaagttgcagaatctagaaatgccctgaaggaagtgagtgtacttacacagattgcagtgtgcctgtaaggaagtgtagccttctccatgcactgtccattggtgacattccaaacacacatctccctagcagaagataactttgtgttattctctgtcatttccactcaattggctggaataatttttgtgccaccaagtttttctttagcagcctgatcatttatgtggctttttgttacagattttgggcaagaaaatgttgtggtcattagcagggatgacatactgtatctgtatctttttgtttgggtaattacaccctgctgccagcctgcaaaccttactttagagacaacctggcctacaacaaattgtggggatacagctatcacagcctgttagtgacagtacaacaatctttcagtggaaactgtatcctcttgaaaatgctttatttcactgaacttaaactacatattctgaaaatcacaatgcatcaagcgctgcatcttctgaggccaatgtatcatttttgtaaaaacaaacagtgccaccaagaggctacatttggtctatcatcgataacagtttatctctgcttctcctgatttgaaatcctaaaatcatccttgccacttaatatttagaaaaatattattattttgaaaactcttacttcgtttatgtattacaaagacatagttttaaaatacaaagtacacccagcatagggtagtttatatgacttcacaaaaatcagaatggctgtttcagaattgtttggtaatattcttcagtcttgagagttttaacacataagcaaaattttccatgcaagaaaaagaaaagttttataggccttaaaggagatactgccattatactaagaaacaaaatatatagactaataatgtcaacaactgtatgcatttggtgatttgcaggcttttttgtttttctaaccaaccatgggaactcaatcttctacatgagtagttcttaaaatggggcaattttgctaccccttattccccctacattccaaggacacttggtaatatttggagatatttttggttgttggaactaggaacacactagtggcatctagtggggagaggcaagggatgctgccaaatatcctacaatgcatagaacagtaccccacaacaaagaattatctgttcctaaatgccattagtactgaggttgagaaataatattctagaaatacacacaaaatattcatagcattttccctctgtttatatccagcctcattccaaaaagatttcaggtaacctgaaaagacatataattctataaaataggaggaaaaaatctctctgtgtgtgtctgtgtgtatgtactaaaaaataagattgggaggaaggtagatattgaaataatatatctcaaagggaaacaaactaataatgcatctataaaataaagaaacatattgcaaaggtaaagtaattgaaccttaagcagtcaacattataaaattttagctctttaagggatttgagcttattaacaaggtttttgactctagctatgcatcaacaaccacctgatactattccaaatattatctccagagattctaattccatgactctgtgttgggatcctggcatgtgtggttttgaaaagcacctggtcagtcgacttgtttctagcccatttctaaaccagtagctctaaattctagctatacattagacttatttgagaacttttaaaaaatactgatggctgaccatgcagatatcaaatcaggccaattaattcacattttccaggattggaacctggacaccagtaaaagttcctttaaaaatattaatgtatttaaaccatcttggatcccattgctttccctatttgtttgcttatcattttattttctatattaaatctgaaaataaaatgaaaatatatcacaaagcaaaaatttgctctttgcctatcaattttgcttaataaaagaaagcaaatttgtggtgtatgaaatggaacactgacatcttacctggaaccatataagttacataggtaaaaataagacatgaaattgaactattaaaaaacataatcttttcattttctgaagctgtcgcctaagtttgtacatagctaaaatcacattctgttataaaaaaattaaatttaagaatttttaaaaccttaataaattttaagaattttaaaaatcttaagatttttaaaaattttaaaaaccttaagatttttaaaaattttaaaaatcttaagaatttttaaaagcttaaaaattcttaaatttttatttcaatgaaaagaaaacagcagatgaaagtgtctacgacatataacattagaaaattgttatattctcactacaaattccttgaaaaggggaattttttggtcttactcaactttacatccccacctcagcacctcaataaaaatttgttccatggataaatacatcagccaccattcttccatacactttctatcttttggaaatatattattttctcttgacctcattcttatttttcatatttgtgtgcttataacactatagttttgatcaaactttaatgaagtgtctggaaggagaggagataaacatgaatgcttgctttgccatcttgcattggaagtctattacatttttcaaactcttttcccttgtcttttattatactttcattttttctttggcattctcagcctcctcttcttcctctgtctgcttcttaagtgctggttttccctagatatttgtcttatactttcttacatccttatatttcactctcttcctgggtaagttatctactcccctggcttcaggtactgttattatgctattggaagcccagagcggtttacttcagctctatatttctataggcaactagcttttagacatctccacctgtgtgactttcaggagatcacacactttcatgttcaatatgaagcatagcatcttctctctttggttcattatctcaatgaatgatatcgttactaataaatttcccgtaactcttgacccaacattttctctcacgctcccaaatgtgggtacttgctacttcaaatatgggctctgggccagcagtacccgcatagtctaggaatgctttggaaacgcaagttactagaccctagcccagacctactacatctgtattttcggtagtggggcccagaaatctctaattaaacaaactctgcaggtgattctggtgcacgctcaggattgagaagcactcacctagcggcttccaagtcctggtgccctacttctctgggctcatctcttgccagtaactaaacctttattaataagttataaacctttctattggggccaaggctttttgccttaaaattttattaactatacatatataaaaataatatagtcataccaaccttattttgattagtatacatatgataatatgtaattggaatgactattttattcagatttattctactaatttattttgtgctatttgtcccattttttaaaaaaaattgttttctttgaattaaacatttttttaattaaaagttacatactctttcttttattttttatttcttttgtctattgtttctgtagctactaaacaatacttgaaacgtaaacatataaatatagcttaaggtctaaagtcaatcaacatctttacccacctctagaacaccagaatgtgtgggatcttattactacattattatatgctattgttgaccagaatcgcgtgtgtgtgaatgggtgtatataaatatcattatgtcttataaagtttctgcagctttgctgggttttgtccaaaattccttcttccatctcaaatcttccttctgaaatcattgttcttcttactaaagaatatcatttagaaatgtgttattatacttatcgtgagtctgttggtatagtgagtacctttagtttttgtttgtctgaaggtttattattttgccccaatttttcaaaagtgtttttgttggatatacaattccaagctgacagatattttctgtccactttttgaagggatttcactgctgtcattacagttgggaagtcagctctctgcttaattaacactccttggtaaataaactgctttttctcactgtctacctacaggatcttctctttttctttggcattctgttgttttaacatcagatctccagtggtttattttcattatcctagaattttctgtgattgctgaatctgaggatgtatgcctacaaataaaataataatttgagaaaaatattaaacactgagccataaagcaactctgggtcccctctggtcaccataaaggcaaaaatgctaagtccatagccaatatctgggacttctcaaatctaaatatgcattgttgtttggaaaataatggggcaagcctagtaggagtaataatttccagtgaataaagttaagacttgctaagaacacagtagctgaagcataggtactacctgaaaagtatcttatagatacagcataagttttagaaacctcaaaagcacaaagttctagaaaattcaaatcaacttggtgaaggaggacagctaggtagactgaaactagactcccaggctcttcaacaatatttacagggctcatacagcagaattcatctttcatcaaaaatatatccattaacccctagtttctcttttggagttagatcactatgggcaaagatctgaagctgaaactcagtaacttttcagacctttttctcagttagctattatgtatttctcaattttttcatgtagccccagaaaaaaattcaccatccccaaaattctctagattgggaataaatatctcagcatgtgtagcagactttgtggcagccctggtgaatgaaagctacaagcaaaggttaaaaaaggaatgtattaggacatttcactttagacttatccaaagttcaatccctctaaatattacaattaatgatttactataagctatgaaaataggtatctctttgatacctgttcaactagccagcatattaaactattctgtttatacaagctggaccttgattcctcactattcttttggttttcagaattcagaagcgtataatttctctttgtattaaaaacaaaagagaggcttatcttgtttcaactagaaacccaatcccttattcataaatgcatattgaattgatatgacattcctgagtatattttggaaaataactcatcaggagcctagttcatagtatttcttccatcagtggaactttttcctacaggtaagtcctatttcatgagggcaagctttgctcccgtgacactgcacccaaatcactggctatgttccttttccatctctctgccaccattctactgataattgagtcctctcctctgtgagatttatttatttatttatttttattttttatttttatttatttatttattttgagactgtcgcccaggctggagtgcagtggcgccatcttagctcactgcaacctctgcctcctgggttcaagtaattctccctcctcagcctcccgagtagctgggattacaggcatgcatcaccatgcccaggccaatttttctatttttaatagagtcagggtttcgtcacgtcggccaggctggtctcaaactcctgacctcaggtgatccgcctgactcagcctccgaaagtgctgggattacaggcatgagccaccgtgcccggcctgttagttttatagtagcatcagacaagggtacaacatgaagactgtaactattaaattgttttgtaaaactatgaaagcttggatgggtttgcttaagagctcaaagtgtgttactacatgagaaaagacaaacacctagactttttcattgctgattctacaatactaggcattggtcactgaccctcacccagtaagagtgctacaagttctgatacacatgttgagatgcttaacttggtcccaatccagcaacaagagtattgagtgagggttcataatactgattacattccttgggatcatcacacaagttattcaaactttctatatctaaatgttcctatatgtgagaggcacatgttgatcacaaaggtttccttcagccctaaaattgtattccattgtagtttttaaaaagggaaggaaatggagaaggggacaaagtttacataccatacctacccattttcagcagcactaacaatgtagggctgtttagagaagtcccttgctcttgccaaacatgttaccgaagctgaatgaccaaataggagttctttcgctgaaatctgaaaataatgagagtgagcttttaaataattgtaaactgtttgaagaataaaaacaccacaatatagtattcataactctgattaggaaattctgttgtttttgttgtatacaagttttaagaaaactgatatatgtaataacaacatccacagagtaataaacttctaggtagaggaattgtgctgtagacaggttttgtttgttttggtttggtgtccatcatgaaacctccatgactgccagcctgtcttacaacagctaggttgtgaatacaaataagtctgtgttgatgcttcctctgaacaaaatgtcccctcaataatagtagcacattaatgttcagagttcagaattcaaaataacttcacaaaataatacaagagaaaatattaccctttttgaaaccaccataataccctatatggtgataggaatgtaaattggtacagctatttttaaaaacagtatagaggttcctcaataaaaataaaaatagaacttacacatggttcaggattcccacttctaggtatatacccaaagggaatgaaaccagtatctcagagaggtatctgtacccccatgttcattgtagcattattcacagcagccaaaatatggaaacaatctaagtgtccattaacggatgcagagataaataaaatgtgtcacatacagtcttccctcattatccatgggggactggttccaggacacagctgccccacaccccatgccccatcacttaagtacctaaatgccaggatgctcaagtctgcaatataaaagtattggcatatagcctatgaacatctttcatatcctttaaatcagctctagattacttataatacctaatacaatataaatgctatgtaaattgcttttatactatattttttagggaataatgacaagggaaaaagtcagtacacgtttagtacagatgcaatcctcttttctttttccaagttttcaatccacagttggttgaatccatggatgcagaagccatggacatgaagggccgactgtatacacaatggaatagtatacagccaaataaataaaaaagaaataaatcctgccatttgtgacaacatggatggacatagaggatattacgctaaataaaataatccagacacagaaagacaaatactatatgatctcacttctatgcagaacctaaaaggccaaactcatagaaacagaattagtggttgccaatggctgggggtgagggaagaatgaagtaatgttgctcaaagggtacaaacactgaattacacataagttttgggatctaatgtacacatggtgactatagttactactatatggtatacttcaaatttcctgagagagtaggtcttaagagttcttgccacacacacaaaaaatgattatgtgaggtgatagatgtgttaactaatttgattgttgtattagtccattctcacactgctataaagaactacctgagaccaagtaattcatgaagaaaagaggtttaactgactcacagttccacaggcttaacaggaagcatgactgggaagcctcgggaaacttacaatcatggtggaaggtgaaggagaagcaagcacatcttatcatggcagagcaggagacagagagtgacgggggatgtgccacaaacttttaaaccataggatctcgcgagaactcactcactatcacaagaacagcatgagaaaatcacccccatgatccaatcacctcccacggggtccctcccacaacatgtggggattacaattcaacatgagatttgcgtggggacacagagccaaaacatatcatttgcggtaatcatttcacaatgtattcatatatcaaatcatcactctgtacatcttaaacctatataattttactagttaattacagctcattaaagttaatataaaaacgactaaaattccattagtcatagactaaatatcagaccagttaccatggaggaaattttaggcttcaagtttcacttctaaattatctatattacctaaaatttctaaaattaaaacatctttcttatttatataaaaaataagaaaagatcaagaaaataagaaaacaagccacagattgagagaaatattttcaaaagttatacctgataaaggactattatccaaaatacacaaagaactcttaaaattcaacaataagaaagttaaaaacctaattaaaatatagtcaaaagatctgagcagacacctcaccaaagaaaacatacagatggcaagtgaacatataaaaaggtgctccatatcgtatgtcataagagaagtgcaaattaaaaaacaatgagaaaccacagcacacctattaaaatggccaaaatccagaacattggcaacatcaaatgctggccgggatgtggagcaacaggaattctcactcactgctagtgagaatgcaaaataggacagccactttggaaaagagtacagtagtttcatataaaactaaacatattcttaccatacaacacagcaatcatgctcattgatatttaacccaagtaagttgaaaagctgtgtccacacaaaaatctgtacacaaatgtttacagtagctttatccataattgccaaaatgtgatagcaaccaagatatccttcaagtggtgaacagataaattatggtacatatatacaatgaaatattactcagcgctaaaaagaaatcagctatcaagccatgaaaagacacggaaaaaccactgatgtgtattaccatatgaaagaagccaatctgtaaaggttttatgattccaactatacgacattgtggaaaaggcaaaacttagcagacaataaaaacattagtggttgtcaggggtttgtggggagcaggagataaatagatggggcacagagaatttttagggcagtgaaactattctgtatgatgctataataatggatacaccaacctggctaacaggacgaacctcgtatctattaaaaatataaaaattagccaggagtggtagtatgtgccttaatcccagctacttgggaggctgaggcagtagatttgcttgaatctgggaggtggaggttgcagtgagccaagattgcaccactgcactacagcctgggtgacagaatgagagttcatctcaagaaaaaaaaaaagatacgtgtcattatacatttgtcaaatcccataaaacgtacaataccaagagtgaaccaatgcttgatgatatgtaagttaattggttgtaatatatatatatatatgtgtgtgtgtatatatatatgtatgtgtatatatatatatatgtatgtgtgtatatatatatgtatgtgtgtatatatatatatatatatatacacacacacactgctctagtgtgggatgttaatggtgagggagactgtgtgtacacgtgtgttgggaggggggcggggctgatcaggtatttctgaaactccctgtaccttccagtcagttttgctttaaacctaaaactgctttcaaaaatagtctattgaaatactttttaaaaatatcttatttatcttcctgcctcagaaatactaaaattaaccttcctacattacaaacaaaattttaactaaatgattttttaaaatatcgatgctggccaagcatggtggttcatgtttataatcccagcactttggcaggcagaggcaagaggatcacttgaatccagaaattcaagaccagcctgggcaatgtagtgagacctcatctctacaaataattttaaaaaattagctgggcatggtggcgcacatctgtgatcccagctactcaggaggctaaggtggaagaatcgcttgagctctaacagtcaaggctgcagcaagctgagctcatgccactgcactccagactgggtgacagagtgagatcccatctcaagaaaaaacaaacacccaattttaaaaatatgacactaagggctaattcccctatctcatgtgtgaaagaagtaaattcctcattattttgtaaaacaagatgatgaaaattaaattacaaaacagaaaacatgtaagatctcctcagatggagaaagttgtcaataataaaccaaacatcgccccggcacggtcggtggctcatgcctgtaatcccagcactttgggaggctgaggcgggtggatcacttgaggtcagatattcaagaccagcctagccaacatagtgaaaccccatgtctattaaaaatacaaaaattagctgggtgtagtggatctcatcactgcactccagcctgggtgacagagtaagactctgtctaaaaaaaaaaaaaaaaagaccaaaaattgaatttgaatggctagcaaatgtcttgtgggtaataaaaatctattttccaaatgaattaatatctattatgttttttctgaactatacgaacatatgtagatggtaactcagccatattaatgaggacaaattatttcatgacataattgttctctgcctttgtatcatttctatcataatcagaaatatttccttcttaaaagagctgttgtcagactaactttttagtgctacaagaagtgttttgtggttgattagaatcctgcacaattcaagttcgcgctacctttttcctgagaagtccagaaggttccatctcagagaacaacatactatctttccctgtcatcacactcaggggtgcatatccctgtgcatttaatccctttccagtctattagaagccaaattaagcaatcaatgagggaacatcaaggatattccctcctccagagaaaatctaccatggacaaaatatcagaacagaacatcatggcctttcatatgaagtcctcattctattactaaatccccacatatatttgaataagctgtgacagttcactaaaatttcctcatttaccatattgtagaactgctgtgaagaataacaaaattcaaaaattctacaatcacacttagtcactgtcatgatgaaatctgcaagacctttcctgttgtccattagctctacttttatgaagcattggttcctcctgaccaccaccatcacttccaggtacttccaacagcacaatgggagactgaaaagaacacacaacttgatgaatgtattagtctgttttcacaccgctgataaagacataactgagaccgggcaatttacaaaagaaagaagtttaatggacttacagttccacatggctggggaggcctcccaatcatggtggaaggcaaggaggagcaagtcacatcttacctggatggcagcaggcaaagagagatattggcagggaaactcccctttttaaaaccatcagatcttgtgagactaactcactttcacgagaatagcacgggaaagaccaggcttatgattcaattatctacccctgggttcttcccacaacatgtgggaattgtgggagatacaattcaagatgaaacatggatggggacagagccaaaccacatcaatgaacatctaccgtattccagacaaaaacacaatcacagagtagtgtttaaatccccatttcacaggtgaggaaattgaagctcaaagaatataagtcatttgcccagtatcacagtgttggtaaatatcagggctggcacttgactaagatctccattctttgtctccacacattgctcttcttcattttattgtgtttccttctgagtattagacaggcggaagagcagaacatagcaatactaagggaatctatctgacaggatattcaccacacctttctctatgcttttaagaaaacaagcaatcaatgccagaaaacccaagtaaagaatttgctgccacgggatttggagaagctcctcactggtagacttcacaaaattctggggaaactagagggctatgggagtcagacttcgaactcaaaggcagcatgtataatctaggcatgcagtgagaagcccaaggcagggagacacttattctctagctcccctgtgccctgccatcccactgcacatggtcaaggaaagactgaggcacatcttcaaacccctattgaatacttgggcactctgagacgtgcagaacttacaccaccttttttccttccctattcctattctccaatcccctttattccttatgcaaatgaataataccatcattctaccagtcccatccagctcccaaaccctaaatctgggaaagatccttggctgttcctgctcccttaccctacatccaatcagtttctcagttctgtccatcctctcttcttaatgtcttttcagttttcatctcctcttcatcctcactgccattcatttggtttatcctcaaaacctttcttgagtaaattacagtagaagtctgctagccatagtccctgtccctgatgtcagctccccctttctccaatatgcccttcacattgctagcaagtgatcttctaaaacccaaatacaattgaatagtattatgtcatcttctcacataaaatatcctctaaagcccttaaaatcaccactgcttttaattatcatgtgctattagctctatctagtgaaaaaaaaacaaaacaaaacttacaaacccctcagcctgtgggattccatgctggacccatcctgtcctttccagatgagcctgtcacctctaattcaccatgtatgctccaggtctactcaactacttttaccagttcccttaaggcaaaatgctcatgtctttcacacacacttgtcattgcctgtgtttgcaaactcaccttcaactcctgtgcattctttagaactcagctcaagcatcactctcagaaaggctttccattcaaaaacataacaggataccacttaacacccattagaatggctattacaaaaaaaaaaataaagtaactagcactggtgaggatacagggaaattggttgccctgtgtactgcaggtgggaatgcaaagtgtgcagccaccataggagtgcctcaaaaaatttacaatagaattaacactccataaatatgtacaaaattatgtgtcaattaaaaataatttcaaaaatagaattactacatgaaccagcaattccacttctcagtatgtacccaaaagagttgaaagcaaggatacaaactgttatgtgtgcacccatgtgtatagcagcatcattcacaatagccaaaaggtggaagcaacccatgtatgtatccatagatgaacagataaacaaaatgtggtatatatatacagtggaatattattcaaacttaagaagaaaggaaatactgtcatatgctccagcatgaatgaaccttgaagacattatactaaataaaataagccaatcacagacaaatactgtatgattccacttacaggagatatatagaatagtcaaattcatagagatagaaagtatctcagtgctttacaaattcctatttacaagtctgtctcccatactggactccgagaaacttggaggagggatttgtgcctagaacaaaaagtacctgtgtagtttgcctaatgaaagcgtaaataagtgttcctggtttgtttttccattttgcatggtggcaagcgagtgtttaagaccacagaacctgatgtattctcttacctacatacttttggagggggaaagaactttccaaacttagtatgaagagaaaataaatggctccctgttcactttacaacctcccatgcccgacttccttctcttcttcctaccatcctctccctgagatgctgccctacggtgactcagtcaaccatgtagttacatccttttttacagtctcttctgtcctcaaggactcctttttttctacccctacccaaattattcctttatatacacattttttaaacaaaaataaaattaaaccactaagtattaacccattaatctactcacttgaccaccttatggataacaagaggatttgttgagaactgaaaagtgcccttgatttttttcagtctggagttttccctgctaatagttgattagttgcaatgtgggggggcaagattcatgggaaaataagagatgctatttattcagtctggctctatggttagccgtagaaaatgttcaggaaaatctttacatggagtatctcacattcatacgaatcaataacttctttgtgtaattaacttttgcacaatgtcctcacagtgaatttcaaaaacacaaagctgatcccatccccaacttaaatctcctctatagttctcgagaattcaatataaattccttcacttgtcatctcaacttctccacgcctaggcccgtcttcccctctggccttacctctctttgatcctttttcacacctaggttaaggcaacaaacagctcctccctttcctccaagcacaggcagtctccttaatgtagaataactttgcttcttccactctcaccaatctaattcctattcccagcccatatctctatccctggatttctctgtatcagcactctgggcatttggaatggaaaaattatttattgtgaggagctgtcatgtgcactatatgacctttgtagtatctctggctccacccactacatgccaccttgtccttcaattgtgacaaccaaaatgtctgtagatagtaacagatgtctcttcggaggaaaattgctccctgtaagaaccactactctgaatccaagcagaagacttgctcctaagagacccatggcataacttctccactgaatatggagtgcagaccattccctgcttagagtgccttatatcataactgtgccacagtagccagtttttttctgtactgcactgtaacctcctgggcagccagcaccaggtcttatcattcacatttgaatttacaaatgagtacccaccataccacacaacttacagcatgcactcaacaaatgtatgctaaacaaaagttgaataaatattagcaatgcctttataaatatgaagatgctagaattccagatttcttaagcttatagtgacctacatattattacacaactattctagccagaaaataatacacttaaacattaaaaataagtaagatattttagtcacttagaagtttgtgtttaaactataatagaaaattaatgttttaattttcaaagggagccactatttttaaagcacaactgttgcaataatacccatccttccttcaagaacgttcattaacattgagctgagctggtctgcaatgcagttcttggcagtcctgtagtagaactgttcagtgatgggagatgttaattaattacactataaaatagaattacaattaattgttaatttaggttttaaagtgacaaactttaaaggctaaaaatagtctttgatctttaaaaggcttcttaatgagggcagtatactttaactacatcattagtttaattgttcaaattgggtctagagactgctagagttaagcaaatatctattctgatacgttaaatgtttatgacttgagacagggacaattaattgctaatcaatggaccaaatcctaggtgaggtcaggttctgaaatagaaggatgacaatagtaaattggatttagagcattttgatgtgatctgtaaaaatcacaggcaggcagagactaaaagaatagcaagaaggccaaatgagcagaaacacccacataattaagatattactcatttagttaatcgtggctttcaagggtgccctttgtttagattaatgagccataatttttaaaattatacttacatgcctgtagttcagttacttaaacatataattcaggatataaaatagtaaaactcagcatagcttaaaggatgataacacttagctgtagctaagattagcaatattcataatataattttcaaatataatcttgatcaatcatataatactttattttctcaaaattcagaagtaaaatcaatttattactttaataaacatctttttaacaatcatgcaaaccttccactgtcattgcagatagaaaatgcaagttgtccgtattttgtgagtggtgtctgtttcaatatcagtagctttcactaacctttagttcatgtgagagattccagagacagagctgaccctcttgacttccagtcacaatcgttcgctggtcatcagtgatcatgatggcagtgatgctgtggggaggggccttctgtccccagagtgccactgcctgcagggaagtcctcattttgggcgaatcctgacatacaaagaagggaagaagcatacatggtcatctttttgaaatttgaggaaaccgataatattacaagcagatttatgatgaccaaacttcaatgatgtgttctcccagtgctatggaaaagggtgtttccccgtcaattagaagagaaagtagtcatcagaaactgaaattaccatgcacactgctaattcatcaaacaagaatgacttatcttcgaattccttattattgttgaagagaaagaaaggaatggtctattcacttcacacccagctcttcctgtggctacatccaacttgctgcaaagtcctgctgggcctctcaagaagcatagagctgtctacatggtataatttgaagccagctttgcagactctctctccctagaaatgttacctcatctaggtaataaatacctgaaattggtgaatttgctattaaaaaaataaatcttttccataaaaacagtgtttcctagtcttcaagattcatgtatgactgtcatgatttctgccatattctatttttaataataatttttattttacctatttttatgtttggtatcttcctaaacaataatctttatgaaattactacattcatatgttagttacaagggttaaaatgaatacataagtatcaaaaaatgttatctatgaccacccaaagtatcactcagtgatgtgtgcattatattttgtgaaacactgagttaaatattctccccaaattgtcattccttcctgaaacacaaacaattttgggagacaatttagcattatatatttaatcccattaaaaatgtccgaaagagaggagaaaggggccaagcatacttcccacattgctttgagaaagtcaagaaaatgaaaaccttctgtcctgcaggatttctgttgctaaaccaccaaaagtgtaaataccaatataaatttttaaaacttatgatacatgttatttctaatgttcaattatatgtctacacacacacacacacaaatatatacataaacatgggtgtgcactgacactatgaacacaaattttccttgtagttccattgtctggaattcagtatctagttccccattttcacttcttaggtcaatatgttagtctatctagtctataatacacttgcattattctaactgccatgtccaaacaccatgaagccaaagtttctacaggaaatgttctgagcattgcaattctgaataccaggattatacatattaatcatactacaaagctacccagagagttctgatttcaataatactgtaaccagaacatggaccttcttctgcttcaaacacagagaaaaatgcattatacctatttttaagttgttgcttcctgaccaagcttatcaataagtctggaaaatcccaagcagtgaaaaactaagagaaaccagaaaaccagtacaataagtattagaactaaattagtatgtggctttttggctaggagtttgcatattaatccctatgtaaggataggaagcaaaactctcagaagtggccttgctcaatgaaagaggaacagaaaaactaccccaggaagataagaaagagtatttccaaatctcccaagaaaaatctgtcaagcctgaagtacaaatgggttgggactaaaaaaaaaaaataataatattatatataattccggaatgaatttcttcacatggggattctggagttatgtataatacttttataataattatatataaaaaattgtttccaggtcaatgatactattgggaggcttgtcagaaacactacagacctatttgaatatctaaatttttttaaaagaccatgacaagtgttaatggctaggcgcagtgtctcaggcctgtaatcacagcactttgggaggccgaggtaggtggagcacttgaacccagcagttcaggaccagcctgaccaacatggtgaaactccctctctactaaaaatacaaaaattagccaggcatggtggcacacactggtaatcctacctcgggaggctgaggtggggaaatcacttgaacccaggaggtggaggttgcagtgagctgagattgtgccactgcactccagcctgggctacagagcaagacaggggggaaaaaaaagaccatgacaagtattaagaagaatgtacagcaactggaactcatacactgacggggggaacgtacaatggaaaacagtttggcagaaataggtcagtgattgctcagggaaagaaagaacagggaacagtgacattacaatggggagtaagaaaagttttgaaggtggtagataagttcattattttaattatggtaatggtttcatgagggtatacatatgtcaaaacttaatcaaatttatactttaaatgcatttatgtatacacacaaatattatgtgtgtcaattatacttcaataaagttgtttaatgttgtacttaaggcattctgaaagacactctcactatcaagagtgaacgagatttctgtaaaacaattagccccagtagcaaataatcttacaataaaaaattataaaacattcaagataaaccatgagcaaacagaaagattagtaccccaggaactaataataagtgaacaatctaaaacatatttcaaaagaagaacaaatataataaattattataaatcaataaatagacaaaagatgaaattaaaaacccaaagaaaaaacctacaaaaggtagacttttaaaagaaacaaatattacttctagaaataaaacataatcgttaaaatataacaaatctcaaaaggacaaatcagaatagacccaagtgaagggagaataattaacttgaatacaattttcaggaaatttcccagaatacagcaagaagtcattaaaaaaaaatgaaaatgttgagtaaaaagaattcagagacattaagataaatcagagatgttaagagatatagatgctaagtgaaaagacccaatatttatctaatataagctccaaaaatgatagaaccctttcccttctttgctaattcagtcctaaagccatggaatattaatagaacagagcaagagtggagtgttggagttcaaatagtatgaggagggcatcaggataggaagacagtggagtcagaggccagggatggtgagtgaggtgtccaaatgtgggggcagctgcatgtaaggtgcagcctccaaggagggtgaagaggagtaatgtatacagggctgtctggcactgggtattggagcaggaacaagtgagaaaggagctcacataatgaggttcctcaacaaggagtgtcatgagcctaacaggggtgaggacagtgaaggaagtggccctgctgtgaggggccagagcttgggcagggtgaggaggacatcaatttacaaggatggtctggcacaaagtgttgaagcccaaggaggataggaaggcatgcacactgaggggtgttgagcatcctgagagcacttgtaggatgagaaaagttgctgcctgaaaatgtaatcagatgtagtaaaggaatacagggataagcaggattttcacatattaggcagtggacaggtccacaagaagtgttaaagccagaaaatgatcaggagggcatccacacagaggacagggtagcacgtttacaggaaattggttacataacagactgatggcaaataattagtatattgcttatttataacaggaatcagatttcttactgttagaaaaaaagagttagaaatatggaaaggaaaaaacttgaatgatccctgtggtactggagtcgaattagaggaactggtgtaaaacaaaggtagatgtaaaacacacacacacacacacacacacacacacacacacacacacacacagacttgccatctctgttagctggagtcttgggagaagcaacactccaatagcaatgagcttacatagcatctctaaatactattctctactaaaaaggaatcaggttttattgggaaactggttgattccaggcctggagcagggaaacacaagatgctactggactaaattgctgttaaaacaaggaagtgctcaaatagtgaggatatatcaaaggaacacagaagtctgcttgaaggacctcccacaggccaaaccatggacaatttgagcatcggaataaataatgttagcaacagaatgaataaatggattaaacttgctagttaaaagacaaaaattatcaattagaatatatcctactatatcttacttacaaaagattcctaaaatattaacgtagaaaggttgaaaataaagaggtgaataataatgtaccaggcaaatagtaataaaagaaaactgatgtaatactggacaaaatgggctttaaagcaaaaccactgttgggggaggtggtggtcactatataatgattaaataagtcattcaccagaaaaggataatagtctctagatactcaacagcagagtctcaaaatacataaaacacaatatagcataattactaagaaaagctggtaaattaactgtgacacggagagattttacatgtttcaattagtaataaacagatcaagcagacaacaaaaatttaaggatattaaatacttgaaccacataatttgtattagtaacatcacaaaaatatatagattcctgcatctaggaattaaataaaaatacatttcaatgagaccacgcatacaacatttataaaactgtgaccctcctggaccacaaaacaggtcccaaaacatctaaaaggattaataccatttaggaaacattatctgaccacaatcaataaaaatctgaaattgcctccttccccactcctgtaacatatgcataacacaaaagtttaaaatattccctgtctgaatgtttggaaactaaaaaaaattctaaatgatccctgggctaccaagaaaacataatataaattcgatgtagttaagactcaaaagtatgaaaacgttgtataataaaatttgccaaatgtaggttttgtattaaaaaaattacagccttaaacacataaatacatcagtaagaaaaaagacagcaaattaataagtaaataacagccaaattaaaatcttatataaaagaagagcagggtaaatacaaagaatgcaaaaggaaacaatgtagacaaaaccatatatattataaaaacaacaacatataagaaataatctacaaatgaaacccaggttttgaaaagagaaataacatgaggaaatctatggcaagtttgataaggaaggccctaaaaacatcaaaattaatatacagagaaaatgagtaaactcagatatcttaaatgagaatattattaacttaatgctaaaaatttggaaaggtaagtgaaataatttttagagaaaatatagatcacaagccttttttttgtttttgtttgtttgtttgtttgtttgtttgagatggagtctcgttcttgtcgcccatgctgaagtgcaatggcgtgatctcggctcactgcaacctccactcccgggttcaagggattctcctgcccctgcccctgcctcagcctcctgagtactgggattacaggcacccaccaccatgcctagctaatttttttatttttagtagtgatggcatttcaccttgttggcgaagctggtcttgaactcctgacctcaggtgatctgcccaccatggcctcccaaagtgctgggattacaggcgtgagccactgtacccagccagaaaacacagattattaaatctgaatgaataagaaatagaaacacaaatacttgtaaccattaaaatggaataaaatatgtaaaattatgcacacacacatttattttagcaaaaacttcatattgggtgtaatcttggggaattaacagatacattcttatatatgaaagcacataggacaaacctacataaattctcctaagtaaagcaaaatgacagctcatttaacagctcatttatatcaaaatcaacagatgagagacagaaggagaatgaagtgaagaaagtaggaacataatgattttcaactgaagtaagcatcaaaaaaaagtgaatcggcaaagagaaaggagatcaaaaagcccacaaaacctgccattaaagccgcagaatctggcagtcctgggacccttagtgtaagagcaaattggcctacatctctatcactcctgagggctccgcagtcctctaaggcccggacaattactgcctctgatggcaaccacctgtctgaataaaagatgctgagatgtccaatatactctactataagaagagggggaagtagaaactagcagttttaactatttctaagacaagagttaaatagatagtaagtttcattgacaaggaaaattcacctttggggaaaagctcactctcatgaataccagataaattggatacaagtgaagactgcaaagcaggtagtgagaaggacacacatgggcgtgttttaacattctgctcctaagaactactgctcctgactttgtattgctcttttcaccacagcttttagtattgagacaacgaaaatcaccatacaaaaatcatttgaccttcattcttggcttggctaacgtgtgcttagctaagaattaaatagtgatacacaagggaaagcttctgggtcacactgctccaaaggaaactgggcatttttttacgggcaatgtgcactttggctcttgtccaaggacttgtgtcattttttaaactttacctaggaaactagtcaaagaaattcacccaccctgctgagtagaacagtaggagaaggaaattccgaggaacatttgccaggtaattaatatatttgtaatgattaacattacactaagggataaataactcttgaggtgcagtatttatattcctattgctctggaaaattagcttctcttacttgaatctttgcaacactgtctacccagtaactagtcacctgtattccggttttgtatctccctgaaaattatccgctctgcattgatgtctcccttaatgaagtgatacacttcccccaaggatagagatcagtccttacttacgtagcatattgcctatcccatagcagaaaatattcttttctactgaaaaaaattgattcaactaattttttttttttttttttgagacggagtctctctctgtcgcccaggctggagtgcagtggcgcgatctcagctcactgtaagctccgtctcccgggttcacgccattctcttgcctcagtctcccgaatagctgggactacaggcgcccaccaccgcgcccggctaattttttgtatttttagcagagaacggggtttcaccgtggtctcaatctcctgacctcgtgatccgcccgcctccgcctcccaaagtgctgggattacaggcgtgagccacgattcaactaattttgatgcttcttccttctacattccttctgaaatatgggaatcatttcttaatcactcatctattccctacaatgcctgaagaacagtgctttgaagatagggacaaaataaatattggttgaataaattcctcttttcattatttttaagctctgtataccaaaagagagggagtggattaagagtgtaaacttgaatcaggctagacttaaatttgagccattttgtccctctgagcctcagtttcctcatctataatatgtgaacaataaagataccttacagggttgttgtgagaatgaaatgagatcatgcacacagtgtggagcagagagcaatactaataacttactactattatttttattttggctctcatacttctggataatccatatgtcaaactttttcaccataacacttttgctttattcttattcaaattaaactgacatcaacttcactttcagtagattataaattttctgagggcagagacttctgtctcatttgtctattgctataattgcagggcccagagcagtttcacaggatatagttctaaagactcacgtatgataaaacatccccccattcaaatatttacaaatgttattgtattgttaaaagacaaggaatttggagtttatggaggtgaaagtaaatcaaagcatttcacaggttaaaaacctttatagccacaggattcctaacacaaccaaattagaaaacaaaatggaccaaggtcaaagccacaagaaatcagatccctagaatcgatctcgaacaatccagatttgctatgtgtagtgcaacatacctgaaattcagagacgtacttccagggctgcttttaccatttataaccgttattaccacattgtaaataccgtaattagtaaaattaggttactaccacctgagctgcctacatttcactattcttatgaggaacaaatacaatgatgtaaacaaaagcatatgggcaaaaatatacatattatgctatcattatattaccttgcatattttactcataaactcccataggatttagagcaagtggccttggatcattaatgtaatccccccctcacttataagaaagctgatgatgagaaatgtgatccagatttttttttttttttggattaagagtcttgctctgtcactcacgctggagtggtggcacgatctctgctcactgcaaactctgcctcccaagttcaagcgattctcctgtctcagcctcccgagtagctgggactacaggcacctgccaccacacctagctaacttttgtatttttagtacagatcgggtttcaccatgttggccaggatggtctcaaactcctgacctcaagtgatctgccagccttggcctcccaaagtgctgggattacaggcatgagccactgcatctggcttgatctagataattcttacgatcacttctaattctgagattctgagaaagaccaaatgaattgtacagtgaggagaaagaactgattaaaagcttgcacatatcagaagtcactttcttcagactctttatctttccccagcaaaatttaaaaagtaaccccagaaacgtagtgtcttgctatcaataggatagaaagcaaatccatgtcttctgatatccctaataattccctaggaatctctaagtgaaaataaacctcaaaggaaaaaaccattttattaaaaactctctatagaatctctgtggtgcggaggagaaagttatgttcctgacagaagtacacctgttgtgtttcaaataattatgtgtctagacaagttttaaagaagtctttggaaaaagattacaaacctctatcatagccctcaatttataattattgtataccaaatttgagtacctgaatgatattttgggtgtctaaagcaagctggtaggattttgtaggataatttttaaatctcatctatttaaaggcaattcaaaataaatactttcactggagaaaataagtgtacactgagaaagaaatatagcattacttcttggccttttggctaagaaaaaaaaataggcatcatagccacagatagggataaagttagagactatattatagaggtcaaatgaatttctctcacggggatctctagtcacaggacaaacaacaatactgtagtacattacactttgtacgtaaatacttggtaaatacaaatagtaaataaatgtacttagtacatcttagtactaagtatattttgatattgcattttgtaacatataagcaatgtaatcaacattttatcatataatcaatacagctatggaaataattatataaacaaccaaacatacagacataaaacttctcttaagtaactctcaaataattcctacacaaattcttgactgcagcctactcagataccacactggattctcaggatgaaaggatgaatgggcttcaggaagctcacagccagtaggtaaaaaaacaatgtaaatgaattacttgctagttatgtagttgcatttatgtatatcctaccattttcacattatgtatgtatacaattttgtcatttcttggtggcataatgaaaaaaataattctaagaaaaaatttattttaggtgtaataattatgaaagtgttaaaaagctgatttttatagagtttaatttatagagtttaattatatatagatcactgcaatttatacataacgatgaaataaaagcataatattaaatttaagcatgttattttagtattacatatttaatatagattgaaatttaggtatatatcaaataagaccaaaacagcatttgtgatatattttgggacttcctaccttttatagttaataaagtaaaactgttcatgtttataatttccacatttgtttctaaataagagatgtttcaaatcgttacttgcgaatgatttttagccattcgaaatataggaagttcatgaatatttttactttctagaaaaagccatatgcaatgttccaaatcattaggatttccggttttaatattgatttttaaagtactagtgatagcttgatattccacataaaaatctttatcaggccaggcacagtggctcacgcctgtaatcccagcactttgggaggccgagatgggtggatcacaaggtcaggagatcaagaccatcctggctaacaggtgaaaccccgtctctactaaaaatacaaaaacttagccgggcgtggtggtgggcgcctgtagtcccagctacttgggaggctgaggcaggagaatggcgtgaacccgggaggcggagcttgcagtgagctgagatcgcgccactgcagcccggcctgggcgacagagcgagactcgtctcaaaaaaaaaaaaaaaaaatttatcaaatgaatcttctcttcagatcaaaggaataccttcttgtagtaaatgtgcagtaacgtttctgttttcattctcattgacacaggattttagtaacggagttccctgtgctcctttctataaccaacactctattgtgatacaaatcagctaaatcagggcctcccatcagcatgccatcgtacataatgagctatgaagagtttataggggtgagaggaactgaaactttcaacctggtgtatacgaaaataattattttctatgtttatgctttgatatgaagaaggatgagaagcattgaattacataaaacttgtctagaaatataaataatttaaagccgtagagggctcaaaccattattgagctcacaaaactatatccacgtctaagaaataaacctcccagtaatgcagtcctgctgatagccactgactgttgcgcactcacaggatgacctgccagctcccaaactgttctgctttaaagtgaaaatttctttaaataatatattttgaaatagaaatagcaataggctacctactctagcaacattaacttcccaatcacctcctaaaccatagggcctctcaaatcaccagcatggggacactttgcaaaactgtacattacagctggaaaaaggtgggtatgtcttttcattgtttgatccctagtccctggcacactgcctaacacatagatgacattcagtaatatttcttatatgatgtgtttgacctggatactgaagcaagagttcactagaaattggaagagatgtgaagaatgtaaagctgaactcttattctgctgatgaggaagtggaggaaaggtggtgtgaccttcctaggaccaaagcatagtcttgctctggaagaagtatattctggggaacgtaaccaccccagttcctctcttcatgttctaccaaaatacacagaaatataaagtttctgattctgagttcatcattaggttgtatccagcatgccactatttgtattattttaattcaaactatactttattgtaaaaaaaaaaaaagggcaagaaaatattaatagaatgagtcagataaagttttgccttcctttcccacaccttagtaacttgcaaatattctttgagcctcagttttcttatctataaaatggaaaaaaaaaattaccttggagaactgatgggggtataggtgattctgcatagataacttttatcattattccttgttcataatcagcactcagcatatggaatgaattgactggatgaggcaatgaatcactataattttgtactgtggatagagattttgactatcactttctagcaatacctttgagagtgtgagatttccttcctttacttttacagtattgacactacagtttcttttcttgaaaatactgtggctatatgctggaatatttggccatgaaaatatacaatttgttattattacttctaaactatatgatgatctttaaatcaatgactccaagccaaattagggttgtcagatttagcaaataaagatataaaatgcctagtaaaatgtgaatttcagatgaacaacaaataagttttgtatagtatacactatgtaatatttgggacatggttatactaaaaattattgtttattgtatgagacatgcttatagaaaatacgtatttttcatctgaaattcaaatataactaggacctgtaggcatagtagggtctctggtatctctaagctgaagacaaaaaggagccttgtagatcacaattaccgctctttccttctacagatgagtaaatgaaggcccagggaagttggttacttggccaaagtaaccaaagaaatgagtggccgagacagaaactgaaccaggtttactaacagcccatccagaacttgctccttacacacaattgcaaagatgcccttgtcttgcccatcggaaattcttagggatttgcgatgtgaaattccttcgttattttggttgttctaaaaaaagaaaaaaatcaagcaaaacaagagcaataaacctcttattcatccaggctccaacatggccttcattgcctttaaaagctgaactgacacttcctgatcctctctccataaatacaatacctggcaagaacaaggaaggacaacacgccattacagctcccatcctccagcccgccttcatcttcttccccgtaacaatttgtttttatctttctgacttgtctgagggtagcagaataatgagtatgatgcaaatgtggttttgtgggtggtgtctactggacactggaattgtttaccttgtcataaatagctgtcttcagggacacacccagacactgagtctgctttaccaacctcacaaacatagacaaatctcaaaccccttgactgaggacagcccactagaaacacaaaggataaagttcctggttacaatgcatgaattttgacaataacatcctaaccagaataaacactaagaggaaagtaaatatagtacagcagtgaataatatgagctttgagataaaataggcctgggtttgaatctcagatctgccacttatagttatgtgacctctgtgaatcccatctcttaagtggagaagaatcccacctactttcttcaaaactcataggtactgtgaggggcaaagatgaattacttaaagattttttttttccagaaaacataccttggtcatctttatcccaggagggagttttgcttttaaaagtttgagtttaggtggagataaaaagagctttggtgtgaaaactgtacactcaatttggaattgtgcactttaaaagtatgcagtttattaaatgtattataaatttaccctaataaacttgatgaaacaaatggatagataggacagcagagtaaagtggcttggccagtgtcacacagctagctagtaagtggaaacagtttgggaaagggcaaagttgagctttaggaaggaacaaagaactcaaggaaactgaggaaagctggagaaagtaactgggtgttctggtaggccagaatgagatctactttaaccgtagaagactatgaaccaagcagcctctgcagtccatagggcctgacttcagtccatgagaacataccagtccaagctggcatgggtcagcagaagccctgtccacccaaaatctatttgaaaatgctcctgaagccaaagttattattttatcaacagattgtaattagatcactccttagaaaaggtaaaaaaataaattttatgaggtcaaagagtgtccaaggcatatttaaataacacataacattctgtctggtcaacccactggaacatgactatttcggaattaacccctaaccaacatcaacgccaagctcctccaaaaatgttgttactgagtaattaactgctacttagtaaactctagaaaataatgtgttttagatagagaatatcttagcaggtaaagtcaaagctgaaacagcccagagatcaaaggaggaattaaacaaatgtgcaaattaatctttgaattccaaacactcatgacctggaacacatataaagcaaaacagccaagaaatcacatctctttcattacatggatgaggtttccatcacagctcacagctcttccagacttgtgagtcaaagattttcacagagtattgccttcaaacttcacctcctcgctcaataagctgtagtgcaacagagctgacacattcaaagaaaggccaagggtgtctaattctagtcattgtcaaggaaatgagcattagatgtggtaagagaagtatgagagaacaattcaattctttctgggtagtaacctcacttttatttatattcaattagtgaacaaacaaactgaaaaaactacaatccccttgtctaaagctcaaagttcaggctttaagaagtggatatgtatttagcttataccacatttaaccctctatttacagtgaaaatctttttttttttttacttagatgtggctaacataaacaaaaaataccattgtcctagaccattcttaagtaaattcaacaaatatctattgagaactaaatatagccaggtggtgggttgggctgcagagaacacaaagaacagaaaaacaccatccttgccctcaaaatatttaccatggagtcatctttggattaattttaactaagtattcatgctactagacaaaacaattgttttgcgtgtgtataaattctgcaaacctatttctggtcttgactcatgtttttctttcccatatccaaaaacaatctggaaaactgtttgcctaatatctctctttaaattaacttgccttaagtattaattaaacttaggtaagaagaaattaagctacataagtatatttgttttggaatcaccttaatcataagtgtccataaaatcatgaggtttaatgtacaggttatatttttaaaatacacattaaaagaaatacttgtctattaacacaaatacttggtatgtactacctaaaatcacattgggaaacgtagctttaatcctccgtcatagtcaaatcctttcctctacctttcaaaactccaccctaactgaggtagttcctcatatcccagcactcttagttgatgatcctttctttcaattaaccaagaaaatcaagtctctcatacatgagcttcctcattacttcaacattccatcactttttcttatttttaagattattttcttctgagatatccatactagtctcctctgataacatttttacctttattccagatttcatcttctatcaactcaattacttcctttattaatatttattttgtcttcaactgatttctcttctttggtccctttgcctttgtttacatatatttagtttaaaaatatttattatctgctacatgtcagagactgtgcaaggattctagggatgtagacaagaaagacaaagcaagtcacagacctcaaggagcttactggtgtctaaggagacaggcctgccctgaatcatcccatagtgtgataggtgctatgttaatgtaaatgcaagagtgtccagggagggagcacaattagagctcgaagccaaaattgggaaggatttcccccaggggagggaataaaacttcattttattgtacttctcagataattgtgtttttttacaaattcaaggtttgtggcaaccctgccttgagcaaatctataggcaccattttttccaacagtatgtgctcacttcatgtctccgtatcacattttggtaattctcataatatttcaaactttgtcaataacatttttattatatctgttgtggtggtctgtgatcgtaaatatcactactgtaattgttttggggtgccataaattatgcccatataagatggcaaacttaattggtaaattaagtttttgttctgactgttccaccaactggccattcccctgtctcctctctccctctcctcagtcttctctgttccctgaaacaaaacactattaaaattaggtcaattaataatcctataatggcctctaagtgttcaagtgaaaggaagagttgcacttttctcaccttaaatcaaagccaaaaatgattaagtttagtgaggaagacatgttgaaagtcaagacaggtctaaagctaggccttttgcaccaaaccattagctaaattgtgaatgcaaaggaaaagttcttgatggaaactgaaagtgctactacagtgaatacatgaatgatcagagaccgaaacaattgctgatatggagaaagttttaatgatcaggaaagatgatcaaaccatccacaacattcccttaagtcaaacactaatccggagcagcactctaactctcctcaattttatgaaggttaaaagaagtgaggaagctgcagtggaaaagctggaagctagctgagttcatgagattgaaggaaagaagcctcctccataaaatgaaagtgcaagatgaagcagcaagtgctgatggagaagctacagaaagttatctagaagctctaaactcagataattaatgaaggtggctatactaaacaacagattttcaatgtagatgaaacacctttttattggaagaagatgccatctaggactttgctagctagaatggagaagtcaatgcctggcttcaaagcttcaaaggacaagctgactgtcttgttaggggctaatgcagctggtgactttaagttgaggccaatgctcatttatcattctaacaattctagggcccttaagaataatgcctgtgctctgtatatggaaccagaaagcctggatgacaaaacatctatttacagaatagtttactgagtattttatgcttattgttgagatctactgctcagaaaaaataaaaaaatcctttcaaaacaatactgttcattgacaatgcaccgagtcaaccaagagctctgagatgcacaagagattaatgctgttttcatgcttgctaacataatatccattctacagcccatggaccaaacagtaattttgactttcaactcttactatttaagctatacattttgtgaggctatagctgccataggtagagattcctctgatatacctggacaaagtcaattgaaaactttctggaaaaggttcaccactttaggtgccttgagaacatttgtgattcatagcaggaagtcaaaatatcaacattaacgggagttgagaagaagttgattccaaccctcatagatgacttggagagattcaaaattccagtggaggaagtaactgcagacgtggtggaaatagcaagagaactagaattaaaagtagtctgaagagggactgaattgctacaagctcttgataaaatgtaaatggatgagaagctgcttcttatgaatgagcaaagaaagtggtttcttgagatggaatctactcctggtgaagatgctatgaacatagctgaaatgaaaacaaaacattcagaatattacataaacttagttggtaaagtagcagggtttaaaaggattgactccaattttggaaaaagttctgctgtgggtaaaaggctatcagacagcattacatgctacagagtaatctttcacaaaaggtctgagcacagtgacatatgcctgtaatcccagctacttgagaggctaagaggtgtgaggatcacctgaggccaggagtttgagaccagcctgggcaacatagtgagactactttaaaaaaaaaaaagctttcacaaaaggaagagtcaatcaatgcagcaaacttcattattgtcatattttaagaaattgccagaaccacccccaaactccagcaaaccaccaccctaatcaattagcagccatcaacatggaggcaagaccctcctccagcaaaaagtacaacttgcagaaggctcagatgatcatttgcactttttagcaataaagtacttttaatcacagtatgcacattgttactttagatattatattatcgtatacttaataggctttgatatgcactgggaatccaaaataaattgtgtgacttgctttactgcaatattcactttattagagacgcttggaatcaaacctacaacagaacccaccatatctccaagatatgtctgtaacgcctaagtttaaatcacaaatcttatacatttgctggttttgtgacccaatgagcttattttgtcatccaggaaaggggatcaattatctattgcacccagccgtaatgagtaaggagacagcatgtaccggtgggtcaggccctccagtcagtgagcctggattcaaatgccaactctaccaatctatgtccttgggaaggttattttacaactctgtgttggatttttatcaataaaatgaggataaataataatatcaatctaataaggttgatgtgagtaaataatccttggaaatcattaattagtaagcattcaataaatattagactctattatcagaaggtttttcaaatctcaaaatctgtacataaatcctgctaagtaaacaatattccgataaatgaaattcttgtcatttataattcttcattctatcattcataacttacagtagatcccatctattaagtgaattaagtaggagagataaagataaaacttcaaaagtatcaaattggcaaagtaaagtaatttaaatttaaaaaacaatttgattttttcaaaaatctgccacattctcatctaatatgagttgaattgagcctatccaaaatttatatgttgaagccctaactcggagtacctccaagtatgaccttatttggacatgggctcattgtggctataattaattaagtgaggatgaggtaatactggattggggtgagctcctaatccaatctgactggtagtcatataaaacaaggaaatgtgcagacagacacacacacagagaaagtcaggtaaaggtgaaggcagacgttggggtgacttctgcaggccaaggaacaccaaagattgacagcaaaccacgagaagctaagtgagacatgggacagaaccttcgtctcaccctcagaaggaaccaaccctgctgacactgtgatttcagacctccagcctccagaactgtgagacaacacatttctgttgtgtaagtcacccagtgggtggtactttgttatacattcctagaaaagtaatacagcatttgacagactttgtttctttcgagtcagaatgcagatctcagtaacacatgtatcaattcctgaaacatatatttaaattttagtctgaatcacacaattggtcatataccaaaatctattctctacctctttgtgtaataaatctcctttccatctacattatcggctccttgagaaaagaatatattcatttattaattcaataattagtatctagtaaagccctactaaatgaaagatgaaaaaacacaagttcctgccctctaggaattcacaacctataagtcaaatcctaagtatgtaaagaaccaacgtaaagtaggttggtagaagcatttccgaggcacaacagcaaaccaagtttcattcccatggctgtcaacgggtcatcccttacactttggcttctcgtgtaaaaatactgtgttcttccaaggactagttatcttcttccttggccctgacatctacttcccttctttcagtttcagcacaagttgacattggaagtcagtccactgtaattataacaatccatttttcctcctagaataagcaaatggcaggtactcccataggcagaaatacaggcctatatggacaaggcctatttggagaagcctccctaatgcccacgattctagtgttttctgactctgtcctagcaatcaggaatacctgccagggaagactttaaactcaccttttgcactaaaggattctagcagaagctaggccaaaacagactttcatcagcaaggctatgaatgcagaatcccaaggtggtttggaaaaagtggtagaggaagtacaggatttgaggctcataatctgaaggaaccatagcctttgtagcttttgtgaacatctttgtggattttctgtcatgagccaagataagccccacctctgtttcatagtccctatctcaccacttgattattcaaaattttctctagtcctggctcttcctactttcccttattcctaaacacatcccaccttctgtcttcactatccttgcctcttttctcagtgttaaggcacagtgttgtatactcaattcagcaagtgtttactgaatgccaactgtgttccagaccttgtgctggtggctttcctatgcattttctcaagtaatccacacatctaccattactgttattaggaaaagaaggctaggtaaatctaaatcccctggctacgactacatccctagggattacatccctagatttgtatgacctcaaagcccataccacttcttaaaggccttgaaagtgagaattcataatgatgacatcatcatctgtttacagttccacacagacaagccagtccacctatttctttaaagaaaatgaaacaaaacaaaacaaaacaaaacaaacacaacttaaattcaactacaggggtggttaagatgccaaatcactcttagactaaagactgtttagtctaagagtcttaatctgtaaaacctattcattatgtatgtggaagtgtatgcatgggccagaatgttttcaaagcatcagaacttaatacaaaaacactaaaaagctcatcgtaacactagtgtcatggaaaaagactcataatacacaatgtgagatttccacattggggtgactgcaatgcagtttatgacataagaggtagcagagggagacacgaaagggcttgcctgaacctacaggccaacaaaaaccaggcaatatgtggcactatggcactttctaaaacatcctggcctctgcttattctaagaaaaaaaaatccgtggcaaaggggatccctcttctctgcttgatttctactgaccaaagaagtcactgtccagtgatataaagaaattctgtccctagggcataaataaatatccaacacctatagttcatgggtgtataagagcctgagaggcctggaatcgatccaacccattttaactagcaagaaactacctggtaataccttgtttgtatttcttggaggagggacacaagaaacacttatttcattccacacaataattcaccacaatcagagagagcacagcaagggcaacaccatctcccagctgctgattacatcaaaggcttgcagcacaaattcaattttatgatgttaatctcagcctgccactcagaaattttctctgagggatatgatttttctctggatttcattttaagaatgattttcttcatccacaatcaataaagatatgttttcatcaaaagactctatcttggcagaattcaattggctatttcaaccccttttggtgacacaatgttaattaaaatagtttatgttgcacctcaactggaaaaagaggcagtgaaaataggagctactcagaacacatgttctatatacatcaacatggaaggcagaaaataattttctccttccccaggcgacagctattagctattcaagagagttgctctaacttggtttatctctgtgatctcactggaaaaaagaatgaagtccttcctgtttatatttttttgttcaattggaaatcaaaatgcatataaagaagatactttaaatgcttacatcccagttcctcaacaagaggagaaataattatctgtgctcctatgtggcataacggattattaggcatcacattcattatttcccttaactaaaaattaatgatgctattacaaattatttttattttcaattttaaataataattacagctaaatacattgtatttctcaaaagcaggcatatagattctcaaaagcgggcatatagaattagcacagggttttgcacatttaagaaagagaagaaaactatgcaatgcatcacagaaaataaagcaatttgttttaacagtggtttgggaagtggcagttaattaatttaacaaagatttataaagcacctactgtgttcttgactctgttctcctcttgagaatgagatgaaggccccacttcctgtcccatgatgctgacagatcatggggcctccattaccgcagaaagagaagggctaggcctggttcccacaaagcaggtagagagcgcagcagaggctgcacttaaccctgctgggaggagatcaagaagagtttctccaaggaagtccaattactgaaacattcagctggtaatttacatatccagtctaaaaaagtggggggcatagctcagtctctaatagaaaaggtagtctctatcaaccacaccttctcactcccccattctgaaattcattattcctcttaacataagaaagtggtaacaaagaaagtaggagtactgataccctaaggagaataaggatttcacaggactctgtgttctaatctatactaaagcaatctaaaaatcatatcagctttctgggctaatatggtttggcttcatccccacccaaatctcatcttgcagttcccataatccccacatgtggtgggagggacccagtgggaggtaattgaatcatgaggatggtttcccccatgctgttctcgtgatagtaaggtctcgcgagatctgatggtttcataaggggcttccccctttgctccgcactcattctctctcctgcaaccctatgaagaggtgacttccgccaggattgtaagtttcctgaggcctccccagccacgtggaaatgtgagtcagttaaacctcttttctttataaattacccagtcttagagcagtgtccttagagcagtatgagaaaggactaatacatgggccctcacaactcactgccgactcacaagcaacaaaatgtcaattaaccaaaaggttgactggttcagtaaattacatctccctcatcctgtactcgcttattgttttaaacacttactgtgtagggctttacatttctcccagttgaatttcaacttgttaaaaaaaaaagacagagagagagaggaaaagtcagtgtcaaagtaaacaattgctaccacttactgactatatgttaagttgtagacactgtgctgcttagattacgttcactgcttcatgcggtcctcataatatcaatatgcattattatcactattccaaacatgaagaaaatgagtcttggagaacataagtaacttgccgaaggtcagagctaggaaacaaacagatccatcagtctatgaaaaactcaattcttaatcactgcactatgctggttaggtggggcagaggtggtggtcagcatgtgaggacagcctctggaaatgagagcaaattctggaatcagtgttcccctacagcaatgatatctagctctgtaaatgaaaatttgcattttttagaaaagttcaaaggggcccaaatgtcttttcagaccaaagatatctctctcattttgaagataaacgtgacacatgtaaataaagaaactcctgggtccccaaagttgattaggaagaggtcttgcaaggacttcaaagctgacctgggcctagacctcagtgcacagatagatacttttagtccaggtctccaccacatctgcctgcttccaattcagcctagagaagaactgaatctacaaagcttaacaactgggaaaaaataaccatacatatagaaaaggcctccagaaaggtaccttttatgatgtagcgatagaattattcctaaatggccaggcacggtggctcatgcctgtaatcccaacactttgggaggccgaggcaggtggatcactagaggtcaggagttcgagaccagcctggtcaacatagtgaaaccccacctctactaaaaatacaaaaattagccaggcatggtggcaggcacctgtaaccccagctactggagaggctgaggcaggagaatcacttgagcccagggaccagagggtgcagtgagccgagatagtaccactgcactcctacctgggagacagagtgagactccatctcaacaacaacaacaacaacaaaaaattaaaaattaaaaaaaagaattattcataaaggacatcctctattgtgagcaacattattactaacattattattattaaataacagaaatttcgagtatatgaattgtcaagctacaaagatatctgaatgcaacaaacttgaaatcttaaaatcttactgataccattattttcaaggttcctttaagttatttcacaagtcaaatgcactcttccattccagtaggcatgtataaactagaacgtcagatttctaaagcattcagttcattgggtagagaccgttaatggaagatttcacacacagggagaaacttaagagtttattttctctctctctctctctctctctctctctctttttctcttttgagacagggtctttctccgtcacctagcctggagtacagtgaagcatgcaatcatggctcactgcaatctcgacctctcaggctcaagtcatccaactccctcaggcttcctagtagctgggattatggactgacgcacaccaccacacccagctgatttttgtagagatgaagttttgctatgttgcccaggctggtctggaactcctgagctcaagcgatccacctaccttggcctcccaaagtgtttgaattacaggcatgagccacagcgcccagcctagttaatattttcttgacaaaatacttataattttaaaataccttttccaaaagaagtgaaagctttggaactcaatataaaatattaatttttaggttaaaaaaatcactttactagacaccttcaagggcagtttccctttctcctacagccttttacattctttacagaagactctattggcacattttaatattgaaggagttaaaaaaagacaaaggaacaagtgatgtttacaaaaaaaaagctgcacaagaccaacttaaccacaagtacttgcatgacagaagtggccgctttccttttcactggtttgtaagtggtgagagctgaacagggaagaaaggaatggtgttttggcagtgacaatgggaaggggtggaggaaaacacttcaggtaaaaagatccccaacaggtgacctagtctccaatcggtgaccttgaagtcatttaacacaaaactgcggggggggggggggcggtgcgggcgggggaagacaaacgtaccatacacctacgttttgtttaacagaacgtcgttaactgtattgaaatggatacaaaaatgctataataagtggggaagatggtataagtcagcaccagtttccaaaaggaagtattcccagtgcatcaccttttccagattttgtcagcacagacagtcccccctttatcttcctgcctctcatccaaccttacaaggggcaaaagtcttgtccccgcagtctttattgccgactcagcccaagcggcagagcaaggaaagtttcgccagcccccgtccccacagccccaagctgtcacaccccagcaggcttaggcccacccggtcgttttccctgcccttgaactcagctttaaaattaattcgacctaaaattaaagttttaaaaataaataaataaataaaattaattcaatcgattccgttccatagaagtccaattcccaagttccaagaaattatcctaatagggaaaggcaggtccctaaccgtatctggggtagactcctcccaggagcataggtagggatactgcgagatgagcggctttgttcactcctgatgccacatctggaaaagagtttgaagagggacttttccagtttccaagtgcaagaacttagagcaaaggaaggggttagagatagcgctgcgcacgcccaccctctttcccggcccagctgtatccaagcgcgggccgtcccctcctgcgccgtgctctgaaggcgggaaggcgtgcggctgcaccagccaggggcagacgaagaccaccagcctgggacccggcagcccgacctgcgctctgggggtgcctgccttacctgagccgtggggcggaggagcggcagagg

SEQ ID NO: 1031 - DNA, 249138 bp, Homo sapiens
tcaagataaatatattttaatacaatatttataaaaattaaattactgcaaaaactccacaacatcaacattttacataaagatggtatctgagaaggtcaagatgaaggtgaaaagagtaaaggagttgtactaggacaggcctcccattagacacatgctgtcttccaggggtcccaaattggatgggtgtttccagtggcatgctcttacagacagacctgttaatttccagtttaccttctcctacctgccatctgtaggctccttcttgagcaaactacagtgcgaggtgatctggggactattgtacatgaagccatgcagctttgtctgaaagatacctactcaagtaagttttaattttgcaactcttttggttaagctaattttttaaaattacaaaaaacactaagtattatgcaaatgtttacaaagcaatgactttcttaggaaattaaacacaacttttggcactttacatataagacaacattttgtggagaataaaggagtctataacaccgcttttatataactgagcaatcaaaatgtatgaatataaaatttaaaaaattgaatgagtccactctgtgaaaataaggctttaaaatcagttggaattaatgtaacctgaactttcattttaaatacatggcataaaatttaattttaaaatactcaattattataatgtgccctctaaggatggaagagaaatagtatcttttctaaagtgttcattataataattatgaaaggattttaaaaatacagaacactggaaaaaatgtatgagaaaagaaataaaagtcaccaaatgctatcatctaaagatagaatattaatatttaacaaactgtattctaccatttttctaataccatcatgttcaaagcagccttaatttagtttctaaaatagtaacagaatgtttgatacctggggctactttttaactgtgtgtttctaacattatacatttttccttatatttgaagtgtttaatagtgctcacattgctttctagcacctctggatgagccctgtgagaaagctctccaacacaggggagggaatgaggctctgacaagcacagcaagcacacacggcctggacacgctgccgaggagcctctgcttttaaccctccaggctttccaggtactttttcctgcaatatacaatggagccaatgtgaaactcaacagcaagtcaaagaatcaaggcttgcaaatgaaaatatgatattcctttgggggatatgccatatatatatatatatacacacatatatatgtgtatatatatgtgtgtatatatatacacacatatatatgtatgtatacacacacacacacacacacaaatacattcataaatatcaccaagatgattaccaaaaaagaaacacaagacaaaatttttaaataaattttttattacaatgacaggaagactccggatacaaacacatttgctaatataatcactccactggttacctaggcctagacgtacaaaaggacacccatatctcatcaggagaaagacaattttgagtttctgggtgtagtaccaagtggttatgatcaccacgtacgtggtctatccagttaactgtgtggcaatttgctatttcaagtcctctcataacagaaattactgaaatatgtggaacaccagtcaatataaagaattcatttttaaacagactagtgaatttgtgtcataaacacacttgcgtatggatattaggagagcattgcttgaatatctctaaaactatttttaggaattaaaagctttcatagttaatggtatgatattggccttcagaattcatattgataaaagcaaaccttagtcatttaacaggaatgtttaaattttagagattctaacatgcgatgccgaaaaatcctaacatttccacttagtaatgtcagggttgtgccagttctaatttcccatagctagtaacatcagaaaatatttatcagagattcaatattggtttcattagaactgataaatgctaagtatggcaactattaaaacctattgttattcttgtttctaaaagggaataataggatgtagctataaaaataatgaagcttatttttcataaacatatcataacctgagcgtccaaatagattttaacaattaaaaatgcctcatttgagaggacatacacttatttgatattgccatccttcaaaatgcttttgggagtccttataatgtccttgacaactggtatacaacaagcaagaaaatataatccatcgcctaacttgctaccttcctttattttgaaacttgtttgaagtggcttttgactgtttctaaaggagggggaatatatttatcaatcagttttcaaaggataataattttccatgattattcatattaatgctatgttagtttctaaacttcaactcaaatgtaatttcaagcagtaaaatcatattttaggaaacaaagaatgcacactttaatctactttaagggagtcacactcatttgacatctttatcctggtatgtttattcagatcatcattaattataagttccttaagggtgcagcccacgtcatttcaattacacagttctcttttctaatttccccatctcctgtctactgcatcccagcataagacctgaggctggtcccatgctcaaaaatgtttctttaattgaagtgacttgaacttctctgttagatacatacatagatatagctatatatcatatatttaatgctttatatccctttttcaattatatagttctcttttctaatttccccctctcctgtccactgcatcccaccataggacctgaggctgctcctatgctcagagatatgtttcttcaattgaagtgacttggacttccctattagatacatagatagatagatatagctatatatcacatatttaatactttatatccttttttctatggattaggcaatatttatatacataagatatgtagattaataattttgatgattttctgtaaatcgaggaactgtacaatataaatcatagtaaatagatcaccaaaggctttaatagaagagcactttatgtctattcctatttatgctgtttgatatatttcagttttagaattcctgctagtcaagcttctttctgggaaaagacctacaagagtttatacttaataaggatcaattgtgatatgctgtaagttgattccccttccctagttcacatctatatggccaacaagatcaaccttgagctaaagacattagcctcaatgtcattagaagttcaaattaactcaacagtacaaggttggtcactgttatactttgtatctcttatttgggctaattgataactaaatggaactgggtatttgttgacaacatttcatgcttagggatgagatttactgcagtaattgatccgaattaaagcatatccactaaaacaaaatatcctaaccagacaaatcaaagttggtaaaattttagattaaataccttgaagcagtattaaatttgtaagtaagtattgtgtactacattggttttaacattgtttattatataattcagggactaaaaggataggagaaaatttaaagcagtattaaatttgtgtctgtggactggcattccctgttggaaatattaacagaaaaagtaagaaacaggaatagagaatgatctaggcaatatttttctaaaattagatgaatatgaatattttcaatcagtatgtattgcattgtaatcagcatgtattaaaatcactttaatacatgttggctaaagtattagcaaatccactacagcctaataacttgaccaataacaacaatgcttttatacagtaataaacaaatggcatcttttggatttcttaatttgtccaaattcagctcctactgatgagattccatttaagacaccttgcaggggcagacctttgctatccatgaatgatgccttggctcacctaggaaaaaagcagatatcttgggttatatggtgaaatctaaaaagagaaaaaagagaaagaccaagaggaggggagggagagaggaaatgaagaatagatacagaaaggaagaagggagagaatgaggaaaaaaagaaagaaaggaagaaaggtattgcttataatttctacatgtcttttccatcctaaaataagacaagttaatataataaaaatatacttgtcttataaagtaggtaaatacactttaattgcacacattattaatagcttggggatttttttttaactgccaaggaagatggaagttttctataagaaaaatttagtttgaaattagtaaatttccataaatttcaaacagcttaattgttcttagaaaaatccacaactgcagttttagggtcaaaatttattagttgaaatactgtttgagttagagaatcaaacaagtatttatttctcagattacttggatgattgcctttgtaggctaaaaaaagccactcatttaaaatcaaattgactaccaaactaattggaacattgttccttaataactattttaaaacacatttatattaatgacatgtctatgaatagtaactttcactcctactggcaaaaactatggtttagttaaaccagtactgtatactaactgtgtgtgtgtgtgtattaatgtataattttgcattctttaaaaaatatgttgatgcttgaattttgcttttgggtaaattttaagaatgtcatattgttaaaaacaactcgaagaaagtgcttatatcttcctactggaattgctcttaattcttctagattttttttagcgctaaccataagaagtgtgttctcaatggccatgattgatcggctgctcacacattccacattttttctgcttcatgcatcatcatcagccatctccaacactccagtcctgaatctgtcctactttctgttacctgatttttgctggtgattcatgagccagaatagaaaaagaaaaaaaaaaaactccaccttggcttttcacagtatagtatcccctggaaactctgtgagaaatctagttttggtcatcagactcatgcaaatgtaatattgattgacaatgatgtatatagatctacatagataacctgccttataaaaaccacaaaaatgttctattaatggcagaatgcatactgattataaactacttcagaatgatgtggaaacacttacgtaaatgcattttgttggacttctaattctctcttgtcactattattttcagctgaagctactttggagtgcactgtttctagtgcactaaaaagaaaaattattaattttccaagccaatatggtgacaaaggcttaaggtttctcattaacactgtcataaaaattgtgaatgtcacactaaattttctatcatcgaatgagtttaaagatgaggagctagaaatccttaaaaaattattctgaagaatgaaaaacaagctttaatcactgtaaaagaaacagtaagaagttaaccagcaaaaggctccactgaactatttttgtgataacatctttcagattcagaagcaaccaggccttaaagagccaaagaaagaaagcctaatggccctaaaatctcaaaagagggagctgaaagttcatgatactgtctcagtgcttctattactagacatcaaagttattcccacaggtttcaggaaggtataaatgccagtgaaggagcaagtagacttcacagagtctaagccggaaacttcaatctgggattcacctgtgagtgaaaactctttgctaatgaattattccgaagacaagacactactcagagacacttttccctatcagacaagacctccaggttcactagcagggtcaaagtaataggaatgctctggtctaaaggtgctttgcctaccttaatggactccaggcactcacctgggtatacagcttgaacccataaagagatcacaatggcatgatgaataaggtagagtgctctagagaccaggtgaacaatcactccacaagccatctaaattgtgacctatatgcagactgcagcccatttacaaatgggtcatcctagtcaattcagtgctggagaaggagtgatgccaatataaaaataaacaatctacatactgagttcaagcccattgtattcagaggtaatacacgaagtggttatttctattttatataaattcaagcaacttggctttgttaatgacattttaaaactctatcaacatctaaatatcaacttcactttttccaaaaactttttctgtgcttcaatgtcccttttgctttctgcctatgaaaatacgttcgtattcacaatataaaaccagaagagtttaaagtaaaatgatgtttacaaggtttgcaaagaagagaatttatgtggaatgaacaatatacaaagcaatatacttgaactgtgtttgcatggaaaatactttttttcattttctatatgctgttcaaacaactgagctattcattaaaatgatgtaataattatattagtcatttagcattgcatagataaaaccatgtaagttcaatatccattaaagttagaagattgaccacattcagctttgtaactgggggattttgcaggtacataaaaatgttaaaaggaattttaaatgaatgaaaacattccagttgaaaatggtaagaatgtgcattcagaattaaatgcactcttttccatacagtgactaaggaatacactaatgcaattgtaagtttagctactgaagcacctcttctggttcgaggacattttcccaaatctcaccacctaaaaaccccaaatttgtttcttcttctgactgaggtagttaatattttccagagaaacaccactcacatgtggtaaatagaggtaactaaaccactagagtaatgcttatggttttggaacccctacattttgaaagacttgatattttgaagttaacgtttgggctttgaaaagtgaaaagtcatatttttatagttcaagaacatccctctctgccaccaaattcacacgagaaacataaaacttattttcctccatgttcaattttaagaattttgcccatcgaatactcatgcttcaaggaaacacactctctcatcaaaatctttcttactaaacaagcacctctgtcagaagtgtcttaatttcttatcacagaattttatccacacaaggagcaataaataattcatgtcactgcctctttgttgtgtgtccctgaactgcacagagctggaaggctgacagctgtgtcaggacaagcaccaaagatctgacatgacaagtgactaacaagtttctttcagttcacagtgaaagaagacaatggcccaaagtgcagaaagaaatcctaaaacaaaataaaactgcttctttctttttagctaagtgtttgctatgagcttatttccaacccacaagccctggtcattttataggactgcccagccccctttattcctcacactggcttggccatttactcctggccacggatcaatatgagcaattcttggagaaatacgatgtctccatgacaaccaagccacaaattctcagtggaaggcagtgagaccagtagtgaactctccagaggtttctaggcctataaggcaagatgtcttaaaatgcaggaagggacagaggaaaaagccagagtaattcattctttattaccagcataatgatgtccgatgtatagaacggtactcactttttgagttaagattctttatcagcacctatattttctaattaatctttctttcttgataaacacgtttgtgtgtatcaatcagatagagaatgttatatttgaatctcgctcccattccattcatattaagggatgatggaaatttattctacttttgaaatgatataaagctgatctattcttatcaaaaacaatggacatttaggtaaaaacctgattcacagatttacctgtctgacaaaatgagtaatagaaaactgtattaagacacttttaaaacctaataaaaatttggcaacattagtcaaaactaaaagtaatggataaataatttttattatagaaatttaacactaccatttatttaccctctcccttttagagtgagactcatctacatttttcttttggctattatggcaaggggtggggttaatttgctcattaaacatttctgtcactgctaaagatgccatttctcagttccatgggatctgaaagcagaagtgtggttgagaacaggcacagggcagcagtccatcttcagaggaatcttggtggagtgaagaggactgatatacaatgccatcgccactgcgcctattggggttccgagatgacttaggggacctgacatagattgcaggctgcacctttcactgaaaattaaatctcagtaactctccttggggaaggatcaggggactgtttgtttgcagctgccccctgtcaacaaaggctacaagatttggaaatctcttaactaagctgacaggccacagagaggatgaatcaaaaatatgatacatggatcagcacacaaagatgtgagagggtagagggtacacaggagccagataaaacaggaatcacaaatattaagtggaggagatatttaactctttcattcatgataataaggtaccttctagcaccttataactttgtatttatccaggaatgttcattcgacttttacaagattttttgattctaattaattagttaaggctaggcgtgtttcaaaatgaaacaaaaatagaaacagaaatccttgtataagtgtttctagctgtatccttctagtacatttctcttttatttctataaaggatatatacaaatatgtaactttgacaaagaaaagcttttattgcatgagagaagggttactattttctagactttattttccctaaacatttgacagtattcattaccatcatgctaaaatcctgtcatcccagttacagtcctgtttgtttctagaaaggtaaatagaattgtaatgatgacagtttctcttttcacccccgtctgtccacttccgctcccctcttgttagtttccattatttgaaatatttaaaatgttgccatttctctatagtttccaatctctggctctattaaccatttagcctaaaattgatgataatgaactaatagtgtcagcttcccttctcagtcataaagcctttgtacttcctccaactgaattcttgatgaaagaggaaaagataacagctccacactgtgacccctggaggtgaccattaatttgacagtgcagctgctaagagaaaacagcattacaatgtcctctcccctcacccccttccaaggaccccaaagctgtgtcaaatttatcattttatacttgactatttttaaatggctttcacctggactctcagactcttccaaggcacatctgtcaggcatgtcctccacgtcttggaagtttgccgagtttgagttgctgtcatgcttgaccgggctgactggagctattaaaagagagagagagagagagagagacagaagagagaggatgaaaaagtagtagcaaacaccattaaaacatttcctttcagttccacagatatttccagggacacactatgtaaacacaaataataaattgaaataaaatgtatcctctaagtatttattggcagacatgtaattagttgaaaaatctatagatgtgactttatcttagaagaaaaataagttcacggcatcagcttaaaagctacaaagtaacaaagtgatctcttcgaagtagaaatcgtatttttaatgcataaatctaaaacaatatagtcaattaacagcaatagaacacagagagaagaacatcaggctagtcaattagaaagaccagctctgtactggtggcaatgtttcctctcactgcactaatcacagctaatgaacattttgtgtgcattttggctctctttcattaaattaaaaactatggtaccaaacaccaaaaaaactagtactataaaaagtaaattttaaaatgtagcatgaatatacactgaaagttataataagaagggctattgtttcaaatggtaggtctccagacaacctatcatgagatattgtagaattatgaccagaaatggaaactagtacagaagtccaaaattttctataaacccatggtaccgactaattctgtttgagaaacagactgaagtttccactttttccacaagttgtaatacttgctctatgttgtctccaggaagtaacatatttccatattacatttgttctagaaaatatttgtcagaaaaagtgggccttgtcttcatgaagaagctcagtgaaaaagcaaaacaagcctgcaatagcataaattaggtcacaattaagccaaatgttctaaatatatggatactgttgagtacaatggaattttatttattacaagttgctgcaataaacacgactactgatttgataacacatgcaatgtatttataaaccataaatgcaataaacaaaatatatatttacaaatcacacataagatatgtttgttggcacaggggagtgggcctagacactgtttctaaacctctgttaccagacaagaaagcaatgcagaggctgagactgtgctacttcacacatttggtacgtgacacaacggtgtcccacccaaggtccagtcagcattagtagtgttcagacctggcacactcctccacttattttaatgaagtgtgcatagcactgatgtttgtaacctgaagaccacacggacaaactttagagaagactagtaacatgattctggtttaaatattccttctagattgtttcaccaactctctcaggacacagatatgacttctctgttctatcaaagtgccagcatagttagaatttactacgtttctaaaaccttttttgggaacaaaatataagaaaagcatgaaattgctattttcaataataaatctgatcttttcattttcatccatatgtttctgtggacttcacatgcaacagtgtctaggccatagaaggtattcttgaaggatctgtgaaatgaatgaatgaacacatgaatgatgcagaggtaccatgctaaatgtccttctgatccaagaggatatgtgctttcaattatcttttcaatggatctgttcaatttccttgttaggccaacttgagaccaaggatgcatgtttgcaaaatggtgatgtgggttagtttgtgacatggaaggagaggatgtgtggcctaagtagttattgatgcagctgagtttaattttcttaattttcttcagtttaggtcatacttacagattatttttgaatccatagattttttgtgaaatgtttaagtggtatagttaaatgtatcagtttcattcagaatactattatgttggtcaagatttcctggcctactttaatgatttttatctctatatatctttcttgataattttctgaaatatttatgttggtatttataaaaggaaataaatcatatagctaaatctattactaaaagccaatgaggtggcacctctattgatttgggcaaatgcattgcacttgccatccaacacactattctttcataatttaaaaaattcctccattcattcatttattcattccttcaaaaaatatttatcaagcaccaaataaatattcagaagatactgttctaaatcagggacctcacagaggaagaggacatggtattagacaaagtacatgtctgcaaccattctttgtggcaataaagtggtcccagaatgaactgacatcccaaacccttcaaaaaggccagaaagttagctgtagttttagctgcatgatcttcattaaactcacactagtaggtaccatgctacaactttgcttccacctctgattttggagggtgtgacttgtgtgggggaggggaaataaagatggttattcttcagatattgaacttggttacagattagtttccaaatttaaaatgatacaagatttgtcatttttactggatagttcctagggcatccaattaaatttactgtagaagaaatagctacattctgccagttgggaatagaaggcactggagaggttaattactgccattctactttttccttgtttgtttgataggctaatccttgcaattgttcttttgggtgtttcctgtgatgtttcatcactgaactctgacatgatgtgtgaccaaggcttctctaatgaatcacttcaataatgatgaatcaacaaatattgctctagtgtttattatgggtagagctctgtgctggactgtgaggggtaaagacatgaaggcacttttaatgtgccctcatacaacttgtgctctaattgaagtgtgatgaaaagtaactagtaggaacaccggagaagacattctaagagggacatggtttttagtagtgcagaggagaattcctctacaatagagtagtctgaaggtaaaatttgaattagacatccttgagtaggaatgtggaaaacccaaagggagctcattcaaggaaaaagaaaagggtgtgaacctaggcatgaccaaagatacacattagcctagtgccacagatatagttgttaaagctgctgcctactttggtatgtatttttaatgaattctctttacatgtctctttgagctttttctaaattgctgctgttagctaattcttctcacctgtgaaagttagctatagacaggtttttccttgctttagatagtcaataatttgatctttactcatggtgggcccatttatcacagtaagttgtccttttactatacatattgacttttatttatcaataccaaagtccatttgtagctcatcactaaagttcttggatattttcagtagtttttgaaggtgcatttcagagcttggcagagagatacttttgacatcaatataatgcaaatggttgctagacttatctttagcttaaaatcaactgtttatttcctctgtaatggattctgaaatagtccacatttgaaggtaaggggcaaaaaaggcaaactcttcttgacagttctgccactgaaagatgtaaggctattccatttactcatcacatgcctcaaaatattgacgactgaagggccagtgttctaaatatctttgcaatatctttggtagctagagaagagaggaatctatgaacttcgtatggatgtgtttcactatggtgcatttaactattagtgtaattcttctagatcctaaagaaatgaattgtttggccaaagagaagatgaaaccaatagtttttaaatcacattcaagaacactgtaagaggaaattcaggagatagtatgaggaagactctatagcaggatttgttgttaaaattagaaaagtggtagcagggccatcggtgataatactcctccacctgctctgttctctattttggtttcagtcattctctaaaaattccgttcttccttttctcctcacttgcagaaagatggtattagctgttaaagggggctaggcctaggcagcgaacaactccccccagaaacatttccacatccccagcaagagagtggccactggaaaaaagtctccatccacgtccacaaacagtggctggatcttccaagctaggcaactgctgttggacagatggagcccattgaaaaaaccctataatttacagtgtgaataaaatctgcagtcctaaataacattttcaatacaataacttatgaatgatttaaaaatagatctcattcgtcatctgtataggctttttggaagtaatgaggatatttataggaaaatcattaattaaaagatagagcagtttgaaatattgggcaactgaatagaataaaccactgcagtaccagaccaaagccaaacaaaaatcttaattacacattaatcaggggcacaaaaataatgtacaggatgcagaggtcaggaaagactaaaagatagctcaggcctgtgaaataagcagtgaaaaagaactcaaagatttgaattcaaagttactagctcaatatggtagccaagagttgaatgccatcctgctttataattcagatctctctccaattttaaagagtcactataaaataaactaaaagatagcattctagaagtatggaagtgagaaaagctacataaaattcaggtagaagaaaatattaatgcaatactggcagatctcaaaagactgcaagatattttaaatcagagggaggcataatctatgaaaagatgttaagtggtaacactaaatttgtaaacaaagatgatgtcatttgaacagactccaaattcagtttacaagtggcatctctctggacagatgtcttatcaggaaaacttatctggctaaagagctgtgtacacatcacccttactttaagagtatctattcagataatcaagtgctaggacttcctgattatatttgaatagcaatagttacatattgcattagactttaggcttactttgtcttcagtgtgaactggaaattggggaagaatcatgtagaaatgcccccaattaaattaggtatctaacgcttctttataactaataactattttacagacaagtttagcaagatgagttaaggttagacttatgtgttttgccatcttcctgcagttgtaatctaatatggaatattattttgtgggtagcattttctagaatgaatcgctttaaagaggatctatttttcaactaataaaaaatgaattttctgaaatgttgtgaagagtaactattatttttgtattattacctagatgtagagaatttaagttattatttcatttaaatacacacagagaggattaaattattgactatttaggcttaggggaaaaatctgtctatagcaaacttccacaggtgagaagtatggctagacccccagccaagtttggggaagataaatgagaaagaggtatcaattgcttacggaatctgtttaaacattgctgtattcctctcaaattgttctgttattcaggactttgagcaatgggctgcctcagtaaggctgataagcaagcagatactgcacttccagcctaatgcaaggcacaataaaaactttttaaaaatcaatgattaatttcacttgcagttttaagggaaaatctcaaggtctagttagggtttacagctcaagcttaatcaaaaatgtccaaaaacttcttattaatgccaaaaggaagtctgcataaagaaggaaaccctgtctgacttatttttggatggaaaataatattccacactgtttagcccatatatatatatatatatatttttttttttttttttaaaagaatataaaaaatttcattaaagaggtgaacttatgagttcccagagagggaatgtgttgtattgttaaaaacaaaaaacaaaacaaaacaaatccttaaacaggtttcaatcttacctctgctcctaatagtgtaaccttgggcatgccgtttcacttccctaaactcaggttctttcctttataaaatgagggagttgaagtacacagcctctttgataccttccagctttgagactcaaatattctgccagctaagaatccaagaccaaccaactactgagtatacaattgaacaggatactaagagggtaaatggccactacactagtgttggaactaatgaggacttctgaggccctttctgaattaaggaagattggcattttcctaaaagagaaagtgttccttcttggtttcagtttctcagcgataaggaggttctcaatgattgctgaacgaatagacaaggttatggagcagtatgtgttcctgtggactcatactctcctcaatccaaagggagaatcagtatactcccaactctttctattccttttatatgtaaggatggggtccatgaagtcattttgtcttactcaaaccaggcatgaaagccaactcaaatcaaattatctaaactctcagaatctgaaacagattataaggatataggatggaaggagtattacaaagagaaaacgtgtaggttgggaagtagaaaaggagagtaacagggaatggtacaactgcattccttcctcctgctacatttcctcgctcccaaccaggtaattctaagagttcccactgggaggtttgcctagatttctttatgttctcctttggaaaaccattttttgtggcaagcagtgttccaaggagacagctggtgagtagatgagcagacacttaaaggaaatttcaataatttccatgactttggtctctgaatattactgagtaaatctcttctttaccaaattgtagataaatatacaaaataagaaacattacttcttattttgtatatttatctacaatttggtaaagaagagaatttctatatacaagaagttaattggtcatatcagtaagctgaattccagtttttataccatacagataatgaagaaaaagagattcagaaacatctgaaaggatctgttcatcactaaaagaagtatggtggtgaatgatttctaagaatgtatagaaactaattcgcactctttatgcaatttagtttctgcaaagtcgtttgttttctttttaaggaccaaatcctatggtaaatacagaaatgtattaattttacttactgttcacaagttcaagaaaatactaagttgaaagcaggaatacattccaaagaagaaaataaatagatacccacatattgataaattgaagaacagtcagtaaagggaaaattctaggaagaatttatagtaaacttcccagcttgtatttaaaaatttagaaggaggccaggaaaacaagagacccttcaatcaaaagagcatcatgctagcatttgagactagagataaacatgatttatatatgaacttaagataaggattcacatcacagggcaatttaaaccaaggaaaagcaccaaaaaacattcccctcttgaatcagtaggagaaaaaactgttaaatggcactagcactggaatttgtaagagcagcaacctttccacagactgaagctaagacaacaccatcagtgtggggagaatagttggcaggcagtctcaaattcccagctgacagccatctctatctcaagggaaagcgtttgtctcagatggttagtcaagtgtcagagctctttcatctcccagataggaaatggaaaataagaaaatcacattatctagactacgtctccattttctagttctttgtcaacattaagaaggatgcaaggaagaacatgtctgagttaccatatttcgtatcattaggctgagttactctgaatgtgacttatttttatttgaatgacatcaaagtggtatgttagctacttaaaaacatattgagattgaacgaaagacatgcttggatgctaacaagtattttacaactatatgataacgcaatcagtagtgagtatcactttctcacacccccacaccctccatatgcatttacacaagacatagaaagcataggtggtctgttggcatcagctggttcttactgtcacacatctcaatgtaggcactcatttaaaagtattagttttattgagagataaataacagaaagatgccttctcaaatcctcaagctgtctcactgcataacactgagtatttggactaatatctccaagagatggttgctgaaaatatggaagtgaccttgataagtagtagagtttcatttgatattacataagctactgacatctataaataaaggataggagaaacacacctaaagaaagccaagttttaaagagcaaacatgcacgtggataaagggaaactagtaaatataatctaatgatacttccagaaagctaggttccatacaaaagagatgttatcatattggagagctaagaaataggaaacaaaaggttaagagatgaatagatatttctagataagacagtttcctagattagtgtaaaaatctctctctcaatatagttttacacattgtttggaaaaatgcatggtaaatctctaagacactaagggttcttgagttgtgaaatgttagaccaattagattagttatagaaaacaatcgtaaggcagaatgaatgagaataaatgttgcatacacatttgagtaaagtttgggaaacatttagaggaaacacaacccaaagtatatgtaatacactaatcgttagagaaatgcaaattaaactacaatgagacatcatctcactctagtcaaaatggcttttagacaaaagacaggcaataacgaatgctgtcaaggatgtggagaaaggagaaccctcatacaccgctggtgggaatgtaaattagtacagctaccatggagaacagtatggaggtttctcaaaaactaaaaatagaactaccatataatccagcagttccactgtggggtacatgtccaaaacaaaggaaatcagtatgtcaaagggatatctgtattcccatgtttattgtagcactattcatgaaagtcaagatgtggaatcaacccaactgttcatcagtggatgaatagataaagaaaatctggtactatacaaaatggaatattattcagtcataaaaagaatgaacttctgtcatttgcaaccatatgaatggaactggagggacattatgttaagtgaaataagtcaggtacagaaaaacaaatatcacatgttctcactaatatatgacagctaagaaaatattgaactcttagagatagagagtagaatgatggtaactaaaagaaggttagtgggaagcgggggataagaagggatggttaatgagtacaaaaatacagtaagatagaaggaataagatctagtgtttggtagactatagttaacaataacttattgtacatttcaaaataacaaaaagagtggaattggaatgttcctaacacaaagaaataataagtgggtgaagtgatggaaacccagttaccctgatttcatcattatacatgtatacgtacgtcaaaatatcacatgtaacccaaaaatatgtataagtagtatgtattcataataattacaaataaaaaatttaaaataaccctaagtatacgtaataagaacatggcactgagctatcatttgttatgactcaaggacattgtgtcaatgtaaaaatgtaggcaaatggctaacagaaggctggtgctttcggaaggagacgagcaacacaatcaaccaaccacaaggaaaccaagtaagcccatgaggactccacacttggaacactgtgtgtgtctccagttactgttgcccatgcagaagacaatggaattgaagaggccatccaaaggtctgggaggaagtaatggggaggacagtttatttatataagagtatctcaagaagagattaagaagacaaagacgctagtctgaaagtaaatctgaagaagagtatatttgtaaaattgctaaaaagttatatatacctatgactgtcattttctcatttcccattccttcaacccattaagatataccctccttctgtttgacattaccagaatcactcctctattttaattatccaataataggtatctttccctccagccattctttaaattaagacaagtcatacccctaaaaccaaggtctgatcatgtatttcctaagtagaaaacccacaaggacctttgttcactcagcaatgaaagattctggagccatggatttcacagccttttgcaatataatctcaactcgcatttagcgatttctcactagatgctacccctctctttatccttccaatctcagcctctgatatcatcactatagttagaggagactgctcactgtcccctggatatgccatttatttactgcatttgtgcctccgcacagatgcccagtttgagatatcccctctaacatcaatcttcaaatctctgctatctcaaatactttttattgaagacttagctgaaatttcacctttctgtgaaatcttcatcaatctgtcagttaacattattttttctcctctttcctgtattccttagcactttatttggcctgtgttatacttataatcccattctttgggtctcatttctgactaccccactggggtagggaagcaagacattttagacacattttgagactttgaggctgatgttatgaggataactttgcctctctacaatggaacctctggtgctgaaatcagaagactgagctagaaaaatcagaggcctgacccagtgtgtcagtttctgtcatctttagcttatctcagacaccaggaaatttatagattatatgtttgctccactaacatgatgagtctaatgctcatgggacagctaacttccaggtagtgatgactgaagaagtctactttatttgcactgaatgtttatgtagcattgggtggatcatattatgcaatatctctaggccaaagcatcattttcccaacactcactttcctaacctttagataactttataaaataatatgagtcatgcgttgcaaaagattacaccttctccctacaacagaaggggaaattcactgatttccactcccttttccttattctcataaatcataaacttaaatttaccctagggattttatttctttgaactcaatgtacaagcataaaacaaattttgttctcacaggacatcccatttttgtttcattagttcaaggaaagggtcactcaatttttaaagcatttggtttgatctttgctatgattcatgctacctaacatccacagacacactctatatactgaaatgtatcttatatataaaatgtgtctccatggaccctataatggtggtactctcacgtaaagtactcaaaagctgtattatggatacatgagtctaggcagggtaaccagaagtagaaaataaattaattttgttgaatatttaaataattgttgttttgcccaagttcctattacacgacagatttctgtttcttcttatgaaaggtaaaatacttccctggggctacgggaggaaatgcttgaaaaaatttcaccaaatataaggcctagattatactagttctattttatacatttttattctatgttcagccatctcactgatatttcattccacagagagggaggtgataaaatatttttttaaggtaataaaggaaaaaggaaataaagaggatttgtcataatttaactagataaaaataattcttgtgatcttaatgtaagaatagactatgatctctaaaagaatactgaattatggaaacatgatttttacataatagaaccatttacacatagaatttaatcctactaaacaataattcttaaggctctattggcttatatacatttttgtctctaaatcctttccagggcaccgttaagttattttaaaatatttcctcattgtattgccatggaagagattctcccttacctcttctcatgaccaaaattctatttcccatgctgggtatcgacagggaaccatgatcatcaacctttgcagagaacttctcttcatgagtttaagatcacagagatttatttgcaaaaacaaatagggagagagattcggcttaaaattttttgccagattatggccattatttagtcttaaaaccctaaaggtcttagataggagggtcaaacctagtacagcactgttggagcctgcaaatggcagctgaacctgggaggaaccagttatttccagggcatttctctcctatttcccacagtaaaaaagttgtccaatttagaggcatttggtatagctagagtaaggaggtaaacaaacatgctttagaattccatttcattgacaaatctgaaacacagatcaaattggccttattccaagactaaacagccccccaaatcatctcattttgtacagcagaatctcagagcttccaacccacctatggcacaagatcctggcctccagtcagccagctagttatccatggaagtggctcaaggctgacactcagattgactggttcacactaatttacttcacacagattccatttatctcctagaagatcccctggcagcagcttataatggcatatcctaggatgcctgcctgcatgcgtgtttaaagcaacagcgcttgatgaatctgagtccagaaaacagttcacagattgaggagtaggtgcaatcagaaaacatcaagaggcacagctgggacttggtggcttgcttgactggtcagagcagctgagcattaagcgtgtctgcttttctgctggctgctcaccatcaccaggacaaatcagagagccaccccctttttcctttaccagtcaccctccaaaggaaaagagaaaagaaagtatgtcaccatcccagtagcgtgtgcagctgtagagaaagctaatttgatcatttacctttacttcttaaatacttcgatattattctcagtagaactacagctggtagttctaaggttaagttgttgaatggttggattggcaagatgtagttagaaaaagtggaagagaacttcaacttattttttttactttcaacaatgagtcccaaagagctgtctgaaacgctatgatcatggggctcatcggtcgacctccaaagaaaggaagggtgcctttctggttactctcctacatctataagagagcttggggaaatatacaaaaaagctggatatttatctaatgagtaaatgggtggatgaatgtatgaacaaacaagtcactgttctccagctgacgttttagaagtgtggtgaaccattgcacagtaacatggtcagcctccaaaggtggagagaattgagatcttttaacggcattgaagctaaaagttttaaacaatgacaattcactgagaaatgtaccaaagcagtgacatagcacatttagtacttataaggttaaacactgggctgcagtagctgcttgaccgtaaaaagtaggattaaggcttttgcatgagccttgacatgatcctgttgtctgtctgctgccttaagctttgaaaaacagctgggatcatcttcttataagctccagctcaaagatgtttaagcagtccccaatccaattaaacagaggtaaatagaaggaagaattgtactgagcaccatcatcaccttttttcttaatgaaaaacagtgtaattgcgggttacacagctccttaatctcacattaaatctaatagattgctgacttatactgagcatgacagtcccagctttctatattggtgtgcttaattttaggtcattatcctttattatgtgacttgtaatccttaaagcccatgattgtgtctggatatttggcaaggattgtatttggtaatacaaggattctgcttctaagagtgatggtttaattgaatgacattgtataattattagatgttcagagaattacatatatttctttccttttttaattggctggtttcttataagtgtttccttcaacaaacattgttcaagattattattgagttttaggggctcttctgaaaaggacagctttcacaaatgaaagacaagtagtttattgatatggaaatgtatctaaatgctattaaaatgcccagttcaaatacaatcctggctcatctacaaactgggaaaccttggtcatgttactttacctttctgtctctgtttcttcatttataaaatagcaatagtgatggtgcctaccaggggcaagaaactgttgttacaattatatgagttaaaacatgtaaagtgctcagcctaatggctcaaatgtagacagtctaagtaaattcagtattattattatttgtatatctgtctttgtctagaaatatgcataaatgtaaataagatgtccagccttaaggtcaagacattttattttattttactagcaatgtagtaatatctaaaatttctctaacctagtaatagaagaaatattttaaatagctatattatcttgatcttcattgaagactgtagaaatctacaagttattgttagtggcccccttttattttaccagtttaaagaggcatgtccatttgtatctattaactaaataaaaacctgtccaaagtcatctgtaattcttttttcttatcaagagtgctgaatatggaaggaagtaaaagtgacttctgacaatgctgaccagataacatagaacctcattggaaagttattctaaatagcttttttaattttttgctgataaattaaataaaaattaaatggaatggaaatgatgatatggtgatatactttacatatatattagccttttagagaactgatttgggtttggaaatttaaattattgtatgtgcacaatcaaatttcagcttatggatatgattagatcataacattttaaatgagcaactataatcttttatatttcaaagtaagaacaggtcttgcaccatcacttgtgcatggttcttgattgctgcttttttcctggtttccattcacacattaagatttaagaaatgctagtattgaaactgaaagtctaatgaagctcagctccgtcaatggcaaacacattagtggaggaggtcatttgacggtgtatacatctaacacacagaaatagtggtttacttgttattaacattcttctttttcatttctagggtagaaagcaccataaaacctcatataaaataacatcaaaaaattctctttttcttgaacaccaggttaacattgggtgatgcggaatgcattattatatccattttagttaattttaaaggtgaaaaaatagacttattttggtttattataaaaagttttttgctgtgtttttatcttgtttgacccaatatttatactgctacccgccctggctcacccacccctagacacacagcagatcacagaatgaatcagatcactgcatggttctgatccttctataaaagcagctgaaataactggatcagagatttcatgactggtctcagtaagtacatttagatataagtagtgccttgcttttggtctttacaacacatactccatgaaactcattaatttgaacttatagataatagcaatattctatatttgagcaaatttcaaaatagtgatagaaaaataagtgggtcaagttactcataagggaaaaaaataaaattgtcaaaagattctgatgacaacactttaccccagaaaataaagtaacatacttaaaaatttaagagaaagaaaaaattgaactaagattttctatccagcaaaattgacttttaactagaaaggctgcaagttaatataagcatgcaataacttaagaaatattgtttaaatatgcctttcctgggtgacctactaaaaatgagctttagataactagaataattgaaaagccatcagcatcagaataagaggtaagcactaaatatacatttacctgtagaactaaaatcaaatgatggttatagaaatatggctgtattctctgacaattcatagaacaactatgaaaaatgcaggtgatcagagggatatggagagtgcataaaaagcaggataagctgagtaattacatagtaatacatatacttagtagtatatgtattacctgagagtaaaagagtatcatttcaaattagatgctggaagagagaaagtaaaaatgttagtagcaaattatttcattattgctaatagttgagggctaactggcaatgagaagaaaggtaatacgtaaaggttttagcataaaggtaaacattaggaaaaaaaaaaactaccaaatactccctcaatacctacatacagaaagtgagagagaaagagagattttgaggaaaataaaatgaaatagatgacatagtaaaagaacatatatagtttcatatatttgtgtctatgtacaaacttaccatctttatcaataaatgttaatggacttaattcacctattagaataaaagagattaagattgactaacaaagtaaaatctaacactatgttgtttttaaaaagatacatcaaaaacaaagagttaagcaagattaaagataaaaggatagacaggatataaataaatttttaaaaagcagtggtcacaatattattgagcatggtggaatgcaaaccaaagagcaataaataaagacacagagaagagtatttcgtaatactaaagactgcaattcacaatggaggtatttcaatgactaatatatgtgtaagtaataacacagctactttaataaagcagaggctaaagagaatggaaactaacgatagataatgttagcacatatctctgaatataagacacataatggggacgaaatattgacaagaatatagaaaacctacagaactaagtcaataaagtagatgtaataatcaaactctaatgccaatagtagacagtacaccttgtacttaagtgcacatgaaacatttaccaaaactggccacatcttattttccggagtgacccctccaacattccaggaatggaactagcacagaaaacttctctgatcacaacgcaataaggctagaaattagatcgttccacctggaaatttcaaaacacattactaaataattcagctcaaaagggaaattcaatacaaaactgtagaacttaaaaaaattgtaataatgaagacataacaatacagcaaaccaaaggaagaaagaaaaaaaaaaaaaacaagaggaaagaaagacaatgaattagaaagcagtaaaaagaagaacaggaggagccaagatggctgaatacgaacagctccggtctacagctcccagcgtgagcgacgcagaagacgggtgatttctgcacttccatctgaggtaccgggttcatctcactagggagtgccagacagtgggcgcaggtcagtgggtgcgcgcaccgtgcgcgagcctaagcagggcgaggcattgcctcacttgggaagcccaacggtcagggagttccctttcctagtcaaagaaaggggtgacggacgcacctggaaaatcgggtcactcccacccgaatattgagcttttcggaccggcttaaaaaacggcgcaccacgagattgtatcccgcacctggctcggagggtcctacgcccacggagtctcgctgattgctagcacagcagtctgagatcaaactgcaaggcggcagccaggctgggggagggacgcccgccattgcccaggcttgattaggtaaacaaagcagccgggaagctagaactgggtggagcccaccacagctcaaggtggcctgcctgcctctgtaggctccacctctgggggcagggcacagacaaacaaaaagacagcagtaacctctgcagacttaaatgtccctatctaacagctttgaagagagcagtggttctcccagtacgcagctggagatctgagaacgggcagactgcctcctcaagtgggtccctgacccctgacccccgagcagcctaactgggaggcaccccccagcaggggcacactgatacctcacaaggcaaggtattccaacagacctgcagctgagggtcctgtctgttagaaggaaaactaacaaacagaaaggacatccacagcaaaaactcatctgtacctcaccatcatcaaagagcaaaagtagataaaaccacaaagatggggaaaaaacagaacagaaaaactggatactctaaaacgcagagcgcctctcctcctccaaaggaacgcagttcctcaccagcaacggaacaaagctggatggagaatgactttgacgagctgagagaagaaggcttcagatgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagaatcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagtcgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcactcaacacaggagcacccagattcgtaaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatgaaactagaactcaggattaagaatctcactcaaaaccgctcaactacatggaaactgaacaacctgctcctgaatgacttctgggtacataagaaaatgaaggtagaaaggaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaccgttcaaaaaattaatgaatccaggagctgttttctgaaaagatcaacaaaattgatagaccgctagcaagactaataaagaaaaaaagagagaagaatctaatagacgcaataaaaaatgataaaggggatgtcaccaccgatcccacagaaatacaaactaccatcagagtactacaaacacctctacaaactacaaacacctctacgcaaataaactagaaaatctagaagaaatggataaattccttgacacatacactctcccaagactgaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccggacagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatttcaaaataataagagctatctatgacaaacccacagccgatatcatactgaatgggcaaaaactggaagcattccctttgaaaagtggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgactgtatatctagaaaaccccattgcctcagcccaaaatctccttaagctgataagcaacttcagcaaagtctcaggatacaaaatcaacatacaaaaatcacaaacattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccataaagctaccaacgactttcttcacagaattggaaaaaactactttaaagttcatgtggaaccaaaaaagagcccgcatcgccacgggaatcctaagccaaaagaacaaagctggaggcatcacactacctgacttcaaactatactacaaggctacagtaaccaaaacagcatggtactggtaccgaaacagagatatagatcaatggaacagaacagagccctcagaaataacgccgcatatctgcaactatctgatctttgacaaacctgagaaaaacaagcaatggggaaaggattccctatttaataaacggtgctgggaaaactggctagccatatgtagaaagctgaaactggatcccttccttacaccttatacaaaaatcaattcaagatggattaaagacttaaacgttagacctaaaaccataaaaaccctagaagcaaacctaggcattaccattcaggacataggcatggggaaggatttcatgtccaaaacaccaaaagcaatggcaacaaaagacaaaattgacaaatgggatctaattaaactaaagagcttctgcaccgcaaaagaaactaccatcagagtgagcaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactacttcaaccattgtgaaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccagatgtccaacagtgatagactggattaagaaaatgtggcacatatacaccatggaatactatgcagccataaataatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagaggggagggatagcattgggagatatacctaatgctagatgacgagttagtgggtgcagcgcaccagcatggcacatgtatacatatgtaactaacctgcacaatgtgcacacataccctaaaacataaagtataataataataaaaaaaagaacaaagaaagaaatgcaaaagatacttttaacaaaataatcaataaaacaaacaaaccactaacaaatctaatcaagaagcaaagggaaaattcacaaatacacaaaatcaaaaatgaaaggggaaggaaaatgactatcagtagagaggaaatttaagaagtcttaagcgattataatgctcagtctatacaaattagtttgaaaatctagattaaacaagtaattctctggaaaacttggtagtgatagaaagagtaagtagacaattatagtagaaatagggaaagaaaagccattagacaaaattaaatgtccatttatgtaaaaatacttaataaaataggattgctggatatttctttgatatgacaaaatacataagccttggctccaaagccaacaacctacttaattcagaaacatcagtgatttcccatcaaaataaggaaaacaacaaggatgcccactgttaccaacaactatttaacattgagttgaacatatttaccaatgcaattaagccaaatggaaacaccaagtcctgggtttaagcgattctcctgcctcagcctcccgagttgccgggattacaggcatgtgccaccacgcctggctaattttgtatttttggtagagacggggcttctccatgttggtcaggctggtctcgaactcccaacctcaggtgatccacccgcctcggcctcccaaagtgctagaattagaagcgtgagccaccgtgcctggcctgttactattataatatcattcattctataaacaatgagtgctactgggtgacagagcatgtgggaggtgctgggtatatagcagtgatcaataatctttgtattcatcaggtctcagtggttgtaagagctaaatatttacacaaaggatgctcaccacagggtaacaggaacagggaacttctgaaatttatttgtaggaagaactacaccagccttttttggttgccacatctggaacaaaaggatttcatccacttgttctgcctttgcttcattcagctttaagttcaggacctcagaagagattaattggttgagctaaagaaacctgcccatcctgtggccatactgtggtaatgatagaggaattgatctggtggtaggcgcttcaagcatgcttagggcatctgaaggaagaggacaaattaattcattgtttctgcaggaatgcacaaaagaaaactagggtgctctcatggtagcagtaaatgctggacagcaaaaaaagaaaagaaaagaaaaaaaagaaatgttgctgatctccaaaggttgatgacgtctttgtaattgaccacttgaatgacttctttgtacttgaccacttggatttgtctgccatataagtctatgctgaatgtgaggccaccttatctggtgaaaaataaccagtataaaatctatcataaagtggtcaccaactctgcttactccctatagtaatttagagctatgctctgatcatcttctacctaaatcatcttttctttcaataaagtagtgtgtggtagcactgaaccatatacctgttttccttctaaatgcacccgtggtaaggtatcttttataggtaagacttcttaggtagaagagaaatagccagtgccaccatgctcctacagaataaacagggcaggcctgatgggagggctcgggctctcagatgcagcagggttagtttctgccatgcactgggattggaattcctgttgtgcatccggatcatgtacagaatttcggctgacttcaaagagagtgattttgagaagagagagttagttgccaaaaggagaaagcaaggcattaatctttgataagctccatttactaatttataaaggcaatgggaattggggtgaggttaaaaagtaaaagctgagggaactatctgtagtgaatgctaatgattttctgaccatgtcatgaactgtgcttttttttttttttggtgggggttgaggtggggaactatagcatgattataaaacgttacatactatttagtagtttataagtgtttgtaagatttttttaaaaactagttctgaccccttaaaatggaagagctatttgctagaaggggcttgtaaatcacagcagttacaggagacatgtttagaattcagagtcaacagagagagattagcatagacagcaatgcaaacagtgtttccatttttttgttcatcttctttatatcaacacagagaagactgggaatgaaaggcaagaagctccagaaagaatctggagaaatttacagaagaaagagaaccaataaccatgccccaggtataaagaacacaaacatctaggtaggaactatttcaaacagttaagtatggatgacgtttatttattcttaaggatttttatttcttttagcatgttattctttcagtcataggcatatttgggggacccagtacgtcacgtactgtccaaggtgctggggagaggaaacaacaataaaagataggcatggtttgtgccctaacagatcttatggtctgacaggcaagagacattgaacaagtaattacagtcgcatgtgatgaatgtcaagctgggctgatacacagttcttttggaacaagcagctaggggacactggaccattttgtttcttgagagaactagagtgtagctgatagactctgctcaaaaattgtctattcaattttcaggtttggatgttgacatatatatactttacacatcttgcatcttttaatcctcaaaacgaccctgccgaatagatgcgtgttttcccatttatcgaccagaaaatttaaactcaaggtagctaaattaacatgcccttttcacacacataataaaagctaaggctgtaaaaatggacctgcttcaaaaacaagctgattttaggatttttttttaaaagatgagtaacagactgacaaagggagatcactaaaggaacatttcaatggttaattacaccaatataaaggtgaagggttatacctaaggtcacgtaggctttggttttggttttatagttaaattaacataaaaatgaagtcttactcttaggctaacttaggctttggttttacaatagatcaaaggtgatctgttgcccagactttggccttatttttgtgcccaactctataatacatatccaaattcaggtgcctaaaccgaaggccccagatctaggtcccagggtttcccagagttattttgcccatctgtgcttatttgctttctctttcattcatgcagatactttcctgagtgaacttttggtgtcccctttcataatataagctccagaaagcggaagttcaattaaaccagaaaaacctgtttaattgaagccaaccattgtttattgaacactgattggtggaaagcactgtggtaagtgttgaggaaacaagcttggtaagacacagtctgtgccttatgtttgcttcccactctcatcagtcttgaccagggattggcaaatgttttcttaaaggttcagatagtaaatattttagacttgtgggccatatagtctctatcaaaactattcaactctgcagctgaagcatgaaagtaaccaaaaacaatacatgaatggatgggtgtggttgtgttccaataaaactttttttaccaaaaacagatagcaggctgaattcagcttatggtttgcagacctctcgtcttgaccatttctggttagtgcatcaagccaccagctgagcttcagtttttatataacagtgatagtcatgatatgaattgggagcttatcagaatctctgagcataagattataacataaacatctctccatccttttatttattatgcattaaacaaaaaactttctctgcctacccctttaaagactcattcaaccaccactctgctccagcagagaaaaagatgtgtgttttggtttcctccacaaggaatgattagggaaatggttagagacttgctgtataacattagagacttgctcagataaataggccttcactttaactgtggtataaatgaagcagccgagagaatgacagcatcattaattcaaggaatatttattgagcacctactatgtgaaaggtcctggaatacaggtattagagaagtggtaaacaaaagacacaggctctccatctcttataaagcttagaatctgactaggagacacacaatctgtacataaacacaaaagatataaatgattattaattaaaaaagaaaatgagtaatatgaaagaaattcacagtttgtcatgagaataaatatggagtgaacctaatgaagcttggaggtcaaggaggatctgtttaaggaaatgacctttaaactaagacctgaaaaatgggcagaaattaggtgaagagtaggcaatgggaaagattacaggttaaatgggtgtcacttgaaaagatttgtgaaggttctgaggcaagaaggagcttggcctggtctggggaatggaggatggccagtgagactggaggtcagaatacggggaggtgactggcaaaaatgaagctggagaggagagaggtcaaaccacaagcctaagagcacttgttaagcattttgtattgtatcctaaatgcaatgagaagatgttgaaataattcacgcagaattggcatgtttagatttacatatgtaaagatcgtactgactgctgtaagaaatatgtcttggaaaggaaatttgatcaaacccactctcagcctttctctttccagcaccttctctgggcaaaacacccttggcaactgcacccagaatcaggagatgcgtaaaggaagaaagtcatatctcccttccgtagatttattacctgtccataaataacctggagacatttatcaccatgaatttggttacttatgcaaacatacaattcttatgctatgtaaaaattaaacacaaaagtcagtcctatgtataaatcacagaatcactataaaaaacaattaccttaagagtcagacataagatggtctagataaagaaagcagggagccagaggtggaaaactcccttgaagaagattctgctaaacccaataaaaggtatcaatgaaagaggtggtaaaattagatgtaggataccaattcagatatggaagacgacttagaatacacagacacacacacacacacacacaaacacacgcacatgtacatgcaatatgctaggcaggaaacttctgatcctgtctggcagttggtctctatttagtataatagtcttttgagatcagagtgggaaagggaggaattgaagtgaccattcagccatctgctgctgagcatattcagggaaaagacagaaaattcgttgtttggaatgccttgcaagtgtcacctgacactgacatttttagactatcctcaactgaattattctatacctatcatgtgtgtgtgtgtgtgtgtgtgtgtttatgtatgtactagtatgtataaatactcaaagacacagagtcaatatcagttaatttcatagtggtgacaaagctatatatccaagttcagagttgtaactttaactgtttagtgtattaatgcctcactgggctcatggatgctacatattctccactacttgtttactagcttgtcaaaattattcaatatatgcagtgtcacaaagcacatggtcacatctcatatgtctgcttcaagggcaggaccaacgtgacctttactttttcttttacacgggataaaatcattctttaggaacaatgtctatttgcacagctacccaatctgctattgaagcagtctcaatcttcttcaatattgcttgttaaatgtttatagttaattttatagtaaagggctagatgtctgaatattttcaaatgcattctctattggagtgggttttaactgttcttctttcactatgttttataagatcgaaaacagacacatagaaaataatgaagtggcttaaaaaattctttcttggataatgaaaaacctgtatcatatagaagaatagaagactgcttccaaacatcctctgacttggaagacagttacacatttgtctgttacgtatttctcatccagaagcaaatattaaccagtcaacatcgaatgccatttgatttcatcccctttggcttggaaaacctatgactacccacactcaggggccatcggcatggaaagtattagttcctgtgcagcccaggagctctataggaagcggtggaatcccaaaggtgggttgaaaggttcaaatcatagccaagaaaaataacttcagtcactgtcaacggtcaatatcatttaaatctctagaaatcttatgaaaaaaagataaaaattaaaaataatggctttctttagggtccttcccacagcaatgattcagaatactacatttttagacaggggaggagaaaatcataatgcccggtagaggggagatgtaattttattatctggcaagatagcggcttcatcattaaaaaattcaaccaactagaatacagcgtcctttgacctagcagataaaaggtcagacagcaattttgaataataaatgagacctgttgacctgatgacccaaatctggcagggtgagtgtttcctctttcacagatgcagacacacacaccaagacagctcagctaatgagctgcctcaacccaggttgtgggtgctgcagtgttttcgtgttatgtagcacggggagaacaaatttctgaagctgttgtgtcatgtaaagtgatatttatagaaatatttctattgtggcttttaaggagactctttcctgagttcccaatgtttctatttagttgttgaattgagtagaaacctaaacattggtcaaggtatttcttccacctctgatttcctttattattttagcactggcaaagaagaaaggaaatgctatatgcatttcacttatattaacagcaaggtgattttatgagaattttctaaaaatgggaatgaacctaaatgtgactctttcacttcattttggtgcaaatagtccttgtatttagataacggatgtagaagtacaaggtattaagctatatggatatttgtgacatagtaattagtttaaatgtttaactttatttgagtaacacagtgatgtaatttgaaaccttaaaaatttccaactaaaatgaaaacagaaatatggctttaaactaaactatccatccctacaattttaatccttaaaattttcattattgcttttggaaaataacagctgttacaaagtaaacttggtaaatgtttacattctttttgataaatatcctataatatgtctaattttgacacttttgcttaataacatgtatagtgcctttgtgtttacttggtattcttttcaataaaagatttcaggagcctggccaaattccagtttagctaattatatttctcttgctaggtccccttttagctttcaactgactatgatagtcttcttcactcttcatgttaaactcttgccaatttttgaattgcagaagagccatttggtaaaataacattgtctctacttgtagtaatatcacacagatgagtaaaaattgttttgaaccaattttttgttatttaccataaattggaaaaaaaaaacttaacaatgaaggatttagagaaaccctcaccatatatttatcacaatttcccattatcttcccaaaatagaaagacaaaatggcagccaaagctggttcagttggtttcaagcctgttcaatttgctgtaactgaataaatgcatatagaagacttttggtgtgcagagccctagtaagcatcattgtgttgtgttgcaaaaattttgctttgtgcatattgaacttttccagaaagtcacaacttttccaaagtaaaggcacttgacctagatttatgggtgaggtcccattctaattagtaacatggaatactactgctacatagatatacatcagctgaactgtgatacaggagaagaaaggaagtgagtttacagggagtgaggaaaaatgacaccttatgtatgtgttttgtggagcacttctttgtcccgtctacacacttcacatttatttttacataacctcactacaaactcacgtagaatatatgtagttttgtgttggtaaatgtttaataaaagcaaacaaacaaaaaccccgatttgtactatttgtcaatttttatggtacaaatactcccaccataactaatttcaagctaccaaaatgatgtcactatgtacaaagctgaggagagatgcatacaattggctgtcaggagctggtgttagctggctccatcacaccactgagtatagaggggctattggtatcttcattttggagtcaaggaaactgatacggagagatttaatgattcatctgagatggagaagcaaagaatagcagggctggtacttagacatcttttattaccaggttctgagtttttctccactttctacaatgtgaagccatttaagataaaaaaaaaaggcaggaagtgtaagtgcgggaagggtaaggaaactgtgcaccaactcaggaagtgcacgtgcacttcacggaggacagaggcagggcggacccacgaaagacttcagagcagaggcagacacaaaggaaagaaacactgggagacaaagatgcagacaaagaagaaagaaatagatctgggggaaaccgggaaatgtagggggagagagataaagagagagagaacatgtgcaagtaagcattttggataaagaatactcaacttttatatcagttttctccttctggctcatttgcctctttcccacttttatctctcgtccttcatgttgtaataaatatatttttttgtttgtggtattctttgtagttttgttaatatagcaaaccagctaatgttttatatttcactcgactctcctactatttcaccctatcacccataattcaattaaattaaaatgaactttgatttatttgttttacattcagaccacttatttgattattttgctgggtcaatggtttgccatttaaaaaaatatatatttctcagccctttactgtagtattaccttgcaaagacaaagggtttcacatccattacctaaaaagtcttatagcactccttcagaagaaagggctattaattttattttacaaaataaagaaagacaaaaggaatgaactaattgtttaacaaatagcaaaatgaactgaggcttgaatctgtgtttctacattattattctctaatatgtagctatattacactgtttcaaaaccaaaatatacagtaaaatctttaaacacattttctttgaaaataaatgtttggatgacaatgtattccatcatttatctatggagaaaacaaataataatgctctattttaattgccagtgtaaaagtttaaggcataataaagaggtaaatatataaatgaggcaatacaatgtccatccttggagaaaatattttaccaacagttaaataatgagattgagtaactgagtatcaggatataaattataatgatgaaaaccatttaaacttatcagcataagaacaaattgttaagttagagtattgttagaactaaaggtttgtgttcctttcttcattttagttttcattctgttgcaaataagtcactttttccctaatctattacttcaaagaattcacataagtgtttctagcagactgcctatagtagggtctggaaatcagcagggtgacattcagcagtgttcctgtacatggatggatggaactgacttatcaactgtcacccatatcacccaaatcatccatgtgaagaaggctgacttggcattgagctggcaattatctggtgaacccagcctagtaaactgcccaaactgataaaagttcaaagaataaatataattgcattgggaaatcatagagaatcctttttgatgattcaaaatgcaatatcttgaatgggttcaatccactatagcatgctcatcaagtcatctaagaaaaaaaatacagactgctattataggctttctacaacatggttcaaaaccttgcataaacctggtctttacagaaatgtaaattatgagtatagcgcatgctgagtacatgtggaaaggttacacactcactaatgttatataatccatgttacatgtataatacatatgtatacatatagtacacatacacatacaataacttgaataattaactcaggttattagagcaatgatagaaaggagtttcactctgaacagataaaaaaggaaagatgaatacaataatttactgaaagaaatttgacttcaacaattaaacaatagtactgccaaggttgacttggccagagtaagaaacttcactttaaaggtaatttgctttattagttctcagtatatcaggctgtccaaaaagcttggaggccaaccagcagtgccatagcagtcagagcaaaatgaacaattacagtgtcattatacttagctttctaaggttaggaagttcttgcctgttttctaagtgaagggagctgtgttgtgttcagcatttattaaatttccctgaactttcagattatcttggagaaaaaaactgactgctgcctttagtatgataatatgaaaatccaaagtgaggagcaccaaatgttgacttattttgtgtgagcttaagggtctctcagacattacaatggctaagaatttcatctcaaacaccacattcaaaaagattatagagtgattgcttggaaggcgatgttcagaagatttctaatgttgtatctggatgtcgcaagaaacaatgccttgatctacgagcaatgtatgccagaaggtaggaatggagaagcaacagcttacatggcaccttttgagttcttgtgtaatgaaatctggctgaggtcaagagagatcagcccgtgagcctggaaaagtgaccaccgaccatcctgaggctcagttaaatgaaggaggtgttcctagataatctccaaggctctcattagccttagaatgatttaatagcatctaaggtttctataataatattacagttcaaaaaatgttttacatatattaatttctcatattattattactaggttttagaaaaaaactaaagctcaaagtggctagccaggatgacacagattgaggaggtgagattcaaatgttagtttccacccaatgtatttggcatgtccgtagaagtgtacattggtatggttattgtagtgaataatgggtagaggtgacctcttccctcgttgatgctgaaacaggggcactggtggaatctggagcagtgggttccctgagtagaggactcagaacaaaggcccaggtcactatctttccacagacattgactgacacagctccacttctactataaatgtgtcctagaatctattgctcattctatagtaggaattcatagactccaatattaattttaacattttatccagttttaatggcaattatccttaataattatccttagttgtcaacattaaaaacattatccatgacatctttaattccggtttgcctcgtcctatcacctggcagatttttggccttgatccagaagactccaaccattcaagccaaacatatttacaactgtggtataagaaagtagccctgatgtttacaaacaaaaacgaattctgaaaaatgtgctctaaagttaatactatgtatcacattagacaattgaaacttcattaaatattactccatagatactatcccccatctttcatctttatggaaatggcttaggggtggagtgaaggagaagcaaagattatttgattatgtcacaaaatgatgatttagcaattcaacatcccattaaagtatgtttaatgggatgctgaattgatttcttaatttataaattcaaaaagttaaagtccactcactaggttgctgtgtaagaaagaaccctgtaatgtattccaaaaccttatgtagatgatttcttgattttatttataacttttttcttccaatggagccaatgactgaggctggcctattctgatgcatagcagtaaatggcacctgccttttgatttcatttgtttgacgggatttttagtgaggcaagaaatgacttcagaataaaagtctcttaatgaaacttaactttttagcctttaaaaatgggacattctatttcttagcttattccaggtgcatacttaaaatgtgcatgatttttattaaaatccacattcttggagagttagaatctcaggcataccttgaagcatctcttcagtttatcaatgtatgattcaaactcaagcttttagttcacagaaatatagcccaaaagcaacgccaacgttaaatggttatttacttataacttgctaatgtacttttctccctgagtattggcatttcttttttttttcattttaggattgggaaacatggattttgctactgccatagtagccttggtttcttttagccatggactagaaagaagaaagagtcctcattcgcaattcacacaaactgtaatgatgatacacatgtggattttttttaaagtacaatgaaagtttaagaaaaaacatgcaggttttctaaaaatgttttgtaaagattaggtgaagatcagtctccccaacagactcttatttttccttacaatatctgtaggaaaaagctcatttgcagacagctgcaatatgagcttcctttccttgccctgtcattgacctccaacctgatctgaaagaaccaccttctttcaaagtgagaagttattcatttaccataatagctctattcggggcctccttaacagaaactagcaattgtgcccaaacaagaaggttttgtgatcctgactaccgttcttacacaggaggacaaaaccaataggaaatttccgttccgacagccacagtaggcggccataaagttggtgtttaaaactatggcttatgtgtggtgatcacaaaaagagaaagaaaaatcattaggagtttgcacttgctctggttatgtactggggtttgccaattatgttctcttaactcgacagcttattcattgagcaagagctgctatattagaggttagctgacagtctgcagtgtgcaacttaaaataaaaccactttatgaagaggagtgagaaatataaatgataagcctattggataatcattagaaataaataaaaagcctttgatacatgcagttagtcacaagcattacaagttgaaatgcagtccagtgttaaagagacagtttagaagcacatggcacatttatcacaactccacagacaagttattgagctgtctgtgaaaaaacagagccaaacaggaaagctttcagcagtcagcagcagttgaggtccttgattgatatagctagatgatgaaaagctgtccgatggctttctgcaaaataaagtgaaggaactcaaggtctttcatggtgctctctgaccagagatgaacagctactttattatggcccagattgaggttgtgccttacttcatattctgctactttctgatgcacacggtaggggtttgacatcttcacattaaaaaacaacaacaaaacaaaacaagttcactataaaggacagaataccgcactggttagaagctcagattctttacttgtccttacgagcaactcttttaactgtagagatgtaaaggatgagaataagtattatcctagagatcccatggcgacccaccccttccttcctgtgcagtttcactccaaagcatcacaaaccaggatattcactgccatgaccccgatacaccaggttattttttttccaagaattaagatgcagtacttatttttattttgtgctctaaaatagagaatggcctttagataagacataaataactttggaagtctagtttaagttttttagttgctttgagcagtttcaatgactggaatttattttgctaaggagtttaacagcaaataatacaatggtatgacccttgtctttagcttgattcttgtcaactaaaattattaaccttaaaataaccacactgcattcttctcattatattcatttgtgtcctcccagccccggccccccaaaaaaaacacagggagagaatgaatgaggagaaaaaagaaagagacttgctctagaatcattttaaaaacattatattcttccacactctctcttcttatctaattcccagacttcactctccctaaagatattattaccacagtcctttgtttgagattagaacttcataaatcttcagttctactcttttattggcattttagagttgtattatttgattttgagtatcataaactgcattgttcagaacacctggaatttttaccttcaataaatgagacaactggtgtagcacattcaaccaaaaggacttcatttgaaattaattctggtaaggatatagctatttctaaaacttaaatgcactactaagacctagtattagttctcctctctctccaaaaatattagaaattttactctatttttaaacttcctgaggaaaaaagcaaacatattgaaagcttttattctgtccagaacccaaattcatatcccaaatataaatatataaatcaaagtaattaaaaaaatcaaaatttaacatagttttactttgcttaaagccgtcagcaaagagggtattcctctacataaaataagtgcatactttgctgcattctggttctatttcctcatacaaataaaggaggaaaatgattaatttctccctagaaactcatatatttccaaaacctcaatttcttgttatccaaagtgcctgttacctggggaattcttagagaatctcaggcctcaccccaaaagagtaagaactagcattttaacaagttccctgggtgattcatatgcctactcaagtttcaaaagccctgctttaatgcagtacttctaaactctgtctgcattttaggttcacctgaggacctcttagaaaatacagatgccagcaccctactatagaccaattaaatcaaaatttttgacagtagggctcaaccactgatattttttaaaagctccccaggtaattcaagtgtgcatccagagatgggaccaccactgtaatcaaagctatgtaacctgttttgtttatctttttatggtagccactagaaagctcaagtagttaacatgaatctttttaggtaatttattgttaattgagttatattaagaacaagaaacaagataacattaatacatttttatctcatgctagtcattgcactaagctctttttaagtaaattttctcatttaatgctcaaagcaatgtcagtcttcctattttacatacaagcaaactgagaccaggaggggttgaaaaaattaaggtgagatagtccttaattagtagtagaacatccagaacttaaaaccagttatttttgactacagagtttacattcttaaatccttgttactactttgcatattcaattcttgcagcttttttccaacctgtggcctagttttctcttaattgccccccaccccaattatttcttaattcctggctttggtttgtactctagaatgaaaagtggacctcaaagtttagtgtaaattagaagcaactgagagtttgttaaaacacaagttgctgattcagtaggtcttggatacaacccctaaatttgtaattccaaagaattcccaggtgatgctgatgctgctggtccagggacaaaaccaagttttaagaatcagtgggctagattagttgtgatggctcttatgatgttacctgccttcattacaaatttcctcaaatcatttatgtaaattgaaaagttatgaataagtaaaaacaggaaagaagagagggatgatgatatataaatgatgttaataagaatggataaaaataaaacttcaagtaagaagtgatttcctatcccctactgcaaacccttcccaagagataaatggacttcagcattcttttctccacaaagttataattagacttggtatatgatggcaggcaatgcaggtattctaaaagtcaaataaacttatattatgacattgtttagaaaataaatgagcaatgatgaacaattttaaggtcttctatgccttgtgttctctaagttacttaaatcataccaagatacatttaattattcgatgaaatgttttgcttgaggttataaactgcagtgtctgaaacaataaaagcgagggaatttttaaaaatttatctcagtgatttatgctcttagtgcaaagctgacaatttaaaatatacacttggtttttcttcatcactttcggaaagaaattttccacgtaacaaaatagtagctagaaaaatggtcctaattatttgtgttggatattggtaagatgtgattgagagaatagtgtttacatgaatcagtttcagcaaagacacatccttagaactttatgatttaaagttaacaagcagactaatttattaaattggaaattaggtatataatataaaattattttaagtctctctacctggactgagtaaaatttaaaagaaactaatttcatctttcacttacgacttcagtgacatgtacttcatttgagctgttaaaataaaggaaagcaagatctgcctgttataaaatagatatttttatttatttattttttaacttttaatttaggattgggggtacatgtgaaggtttggtacataggtaaacacatgtcatgggggtttgttgtacatattatttcatcacccaggtattaagcccatttaaaaatgtttattaatacccccaaactaggtttgaggtgaagctgtttgctaaatgattaatctagtaataggaatgtcagatggaacacaatttttaagatttttttttaatctgaaatactgttcttgcagaatgttggttggatgacataaagagcacaggcttgcctatcacactgattacttgatgtaatagtaagcaagcttaagtgaactgtgtgtcttcaatctttccaatcacttagggatgggcatcggagctcgtcatccatcatccctggtctgaaacatacagtgcatcagcaatcttgggctgacctaaatgatagtaaaagccgctatgctgttcacaataagaaattgttgtccgctgaattacaggtttgtgattagattgctaacatggccaacttgatgtataagtgaagtgtccagggaagatattctttaggatcttctgaagattaatttatacccttgaaatgcagaccaatcacagagtcaaaaaatatgtcaaggtgtttttcttgtaaccaagaaagcccagctgttttaacagtcattaattcatttctggcacctttatctgcaaaagaatttaataaacaaggggtctaatggctatcatcttggcatggctagaattgctcaatctgataattgatttttttggaggcaaatttatatgaggaatagttatatactgttaagaatataaacctgaaatgtcaactgtttctcataatttaaatttttacatttaaacaattttaaatttgctaaaatgcctatctaaaattcctagctgtgtgttatgttctcatatcctaggacagcatctaaagatagaagacaaattacctggtaaacatgccatgtattattattatttttatttcctttcctaagattacaataacttgaatttaaaattaaactttaaagaaactatctccaggtcaactgcatagccctaagagaatattagcacaggaactaggaggcccaccttggacttcaggttctgtgtctaaattttctgtatggccttcgataaaccatttggctgctctaaccattagcatccacatttggtcttataggaatggtattttctgacctatcaaaggtcttattcagtaggatgacatttattgcttccatgcctactgaaaatccttcctttccagtcacgtgggtaagcataaaatgatgaaggtgctagtcctgctgacagcaggcaagaaaataggcaagtacgataataagcttagtgtgcagaaaaaccacccaaaaatgaaaatgctggggccaaaagcccagaatctgagttgacagattcagtgctgagctctgatatatacctttctaatatgtcctccagataattctaatgcagatagtccatgagctacaagaaaatttcctaagtgaaaggaattagagctgggtgctttgaggtatacaggaaaaaaacacttgattcaatcctaaaagcctgggaaaggttttggggaaaggtgctggagaaataaaaatttcatgagcatattctgggtacaataagtgtaagattggggaaagtgttcccagcaagggaacctcatgagaaagggagcccttggggactcgaggcaggtgagtttagaaagtttaagaggcaaaaacaagagatgcagtttaagaagttgaaaggaaactatcacgtaggactttttttcttttcaataaattactttttgaacacatgtgcacagaaaaaaagtgtgtaaaaagaataaacaatgaaaagttttccttctgtcctctccccagccacccatttcttttttggaaggcaaacaccattaacagcttcttgcgtgtctttccagagatgttaaatgcatatgcaacaatgtgccaagacctattctccacactcctgttccagtaaattaaacagtaaggtatactatgcacagttcagcatcttgcttttttgacctaatgtattttggatattgagcacatctcctacttctttgtaaacactgcatggtactctactatgcacacactatgatttattttaccagttacatgctgatggacaattaagttattttcaatctcttgctcttacaagcaaaaatataaagaattagctagtacctaagtcatttcaaacatgtgcacatacgttgaattaaaaaaaaaacagaatttttgagtcaaagggtatgagcatttaatatgttggtagattctgaaaaaatgttctccacagaggctgtaataatttgcaatgtcatttgcaaagcataagcatgactgtttccttcctctcaaaaaagcagttagactttatctttggaacactagagcataaatcaagggttttaagagaaggaacgctctgattagggttacattttagaaagctatattctacagcagtgtggaaaatggatggattagagataacccggtgttgattatgtgggagagcaaggatttttactgagcacgtattacatgtcagattttctgctaagcacttacactgcattatcacatttattacctataaccacactaactgttattactggtttcagacaaagacaaaatgaaacagaggctcatagttaattacttgtccaagtacatgctggtagtagcacatggcaaaaccgggattcaaatccaagcaagtattactattagctcagagcaagtggttttagccactacaataccatttgggatgcagagaagttgatacatttgagatttgtcagaggtagaactgacagaatttggtaactgaatgcatgcagagcataaagaaaaggaacagatcagcattatccgtcgagactgggaatctaagatttacagctggaaagcaaggagtcggggggtgacttttgagtttgaggtgacagtgggagatatctactgcctgggaggtaggagaacagtctagtctggggaatatatgggacttcaccagtgtacagacactacgcttgggaagtcaccagcatggataggctcatctacggagcaacatttaaggaacaggtcaaggatgaggagaacatgaaagaggtgaggaacaaactaagagataagaagacaggaaggaaaacccaaagaaaatgttatctccaaaccatatttttaaaaaatcactttgaactactttacaaataaattattaatacccacttttttatttataaggactctcatatactgtaaaagtaatattcatgaaatagtccccaaacacaggaaagaataggttactggaacatacccaccaacactgtcttgcacaggtgatagtcctggggcaaatagctttctctagcctggctgagagtcttgatacatttctttaaactctaataaccatgcagaaaagtgtcaaattgaggatttaaaggcaaccgttgcagtcccaggagagtgtctgggagtgattcctgtgtacctgacataactcagaagcaggagagctgcactcaatggcagggagaattctcccacaccacctcgtataaatctacagagggctacgcaaaggtttatgtgagctgtgtgtccaacatgtgttgggaaatcagtcttgttatattttccctgtaaatccttccaggagtcctctaggtttaaggaggaccttcacatttggaatcgagaaatgagtatagattttctaaaactgcctagactgtgtaatatgtagttcatacaatagatttgaggggaagaatatgtaggcactgtcagtcaattgatgggttcagactcaagaagctccaacaggcccaccactctccccaactccctcataaggaaacaaaaagcccaaaaaacaaacaaacaaaaaaccctgtttttcaaagggactaagttctttaaatgtggctgaccaatctctgttgcatatccatgcaggatacctgcatatccgagagagatgagactgatcttattttgtttatataaccagttttataaataaaagacaatatcttttatgttagcataccaaattccacttctgaatacaccaaaactaaaaactaagactggaccaaactacagaatctaaacaccttttttatgtgtttaaactgatctttataggaacaaaagccttgaaaattatatacataaaatggtaacgttactaaaatcttctgaaaacaatgaaaaatctagtgtgtaccagatttttaagtcaaattaataactaatttaaaaacagttttaattattaaaccaaattttttattttatcaacagataaaaaacaaataatcatttctaagctttattagaaatgtcttaaattcaatattcctccatttcatcaagttttatctcaaacattaattgcatatcatcctgatcataacaaacagttgccttgaataaagactattgattatctaggatgctccaaatcaagatttgattctaggcattttttgtcttgtttttttttttttatttttttaagtaaattctactaatttctaagtattagtcaatgaatatctgatttttaaaaataggtaaatttaaaaaaattacatcaaatacaaaataattttttaccatttaatatggggatcgtatgtggggatcacatacaagtgcatgcatgatccacagtacaactttactgagcagcttttcaaagtacataagcttttgttttttacagacccttaagaagttcagaatagtgaaatcggtttttatgaagtagaaaatagggattttctaaccaatctaatactcaaaacagtaactctaactttgtgacagacgctatttgaacaacagtgacagggagctcaccacttaatgaggcagcctgttcattcaacaggcttaagggtgtaaacattttccttaactattatacaaaaatctgcttccctgtacatctagcaatgttgttcactctggcttctgtaacgatcccaacttgctccccattgtcactaaggtggtcactattgatgtcttccatgctaagaatttattttttttgaagtaaaacaattccatttcctccagtcactcttccacatcatggtttgaaaagttcctcatcaattcctgctccaaaaggaccactgatcatctctagcaggcctatagaccatttcattcaactataaccatagctctatgtgtagggttatcatttctcatgagttaaaaactcagctgctatcaatgtaaacatacattataagtatatataccttgaacacatcattgatacatacaaatttgtttccttttgaagtttaccacaaagaatggtacgatatatactatatatatgacataaattttaattatgatatatttagcttgtaaaataatgtttaatttaccagtttttcttagagtaattgggagaaatggaagaatgcaaagtatttaggtgtggtagggagtttactgaaaacataatactaatctaaagttttctttcctttcacaggacttatggtctgtttctttctgcacatgagatcattctctttctctgaagaccagtcttctgtgatttgaaatacaggtagccagcctatccctgcctttatgtggtcattcttgtctacatcaagtactatgttgagcctctacactcccagcttccaagacctgggacacactatttcattttatcctaggtctccacccatcacaggtaatattagagatgacaaggattgcataactagcagctcatgtgtatgcactgtaggtacaagttctccaaaatggtgtggacaagactgtgggagaaaaatgcatcagccacacaggcaacctgagaggtgtcatatttttgaagcacgtgtctatcagctaaaatacagtattgaatacagagataagattgaaaccatcatagaatggctacactctgaaccacccattgaagtcaggagaattcaacatataagaagtccttctaatatctatacatcagcttatgaggcatttatttgcattcacaagaccaaatgttgaatgtggtaccagaagatatgaagcacctggatgtctttaaagaggtatagttgctgtacttctaattaagtcttctcagagtactgaggtttgctgtcatgagagtaatgattttctttatcatgcccccctagaatgtcagtatgggagggagaaagtataatttgcattatttcatatgtcattacttttattttgcttatttatctttacataaacaatgaatcataaaaacaatgaactatgaaaacaatgaacatttgacataggtggcctttgtggtcttcagtgaaatgtatgtaacggtgattcacacttaacaactcagtaggagtgaggtcatagtccattaaatgcattcccttttgtccacatccttaccaacacttgttatccttcatctttttataatagccattctaataggtgagaatgtatctcatgcttttgcaggaatacactccccccttttttccagtatatacttttttaaaagctaaattttttattttaagtgacaaataaaaattctatatatttattgggcacaacatgatgtttcgaaatatgtatgcattgtggaatggctagattgagctaaataacatatgtattacctcatataccatttttttttttttgtggtgagaacacttagaatctaacctcttcacaattttcaagaatacaatacattgttcttagctatagtcaccatgctgtacaataggtacctggagaactaaacagatcaaggaaaaaaatgaaaaacgccattcaaaagtgggcaaaggacatgaacagacacttctcaaaagaagacatacaggtggccaataaacatgaaaaaatgctcaacattactaaccatcagagatgcaaatcaaagccacagtgagatactgtctcataccagtcagaatgggtattattaaaatgtcaaaaaataacagatgttgccaggttgtggagaaaaaggaatgcttatacactgttggtgggaatgcaaattagttcactcctgtggaaagcagtttggaggtctctcaaagaactaaaaatagaattatcattcgatccatcaaaccattactggatatttacccaaaggaaaataaactgttgtaccaaaaagacacctgcactcatgtttatcacagcactattcacaatggcaaagacatgggatgatcccaggtgcccatcaatggtgaattggataaagaaaatgtggtacatacatactagggaatactatgcaaccataaaaaagaatgaaatcttgtcctttgcagcgacatggatgcagctggaggctattatccaaagcaattaacacaaacagaaaaccaaataccgaatattctcacttataaatggagccaaatactacaaattaactcaaacagaaagccaaatactgcatgttctcacttgtaagtggaagctagacagtaagtacacagggacacaaaaatggaaacaatagacactggggattccaaaatgggtggtgggggaaagaggggagaaagtgttgaactattgggtactatgtttattacttgtgtgataggatcatgagaagccaaacttagtatcaagcactataaccatgtaaaaaatatgcatatttatctgcagaatttaaaaacaaaaaaacaaacaaaacatactttgaatttatttctcttattgaattgaaattttgtatcctttgaccaatgtctcttcaatgcccaacccctgcctccagctcctgaaactactaccctattctctgcttctgtgagttcaactttttaaaatttcacataaaagtgagatcatgtggtatttgtctttctgtacctgtcctatttcactcaacataatgtcttccaggttcattgatgttgttgcaaatactaggatttccttctttttaaaggccgaacagtatttgattatatatgtcacattttccttatttattcatccattgatggacacttaggttgatcccatatcttggcaattgtgaacaatgctgcaacaaacaggggagtgcagagatctctttgacatgttgatttcatttccttggtactaatcccagcagtgtgattgctgaatcaacagcagttctatttttcatttttttttttttttaagaatcttcatactgctttccataatggttgtactaatatagattctcaccaacagtgtgcaagtgttcccttttgtccacatccttaccaacacttatctttcatctttttataatagccattctaataggtgagaatgatatctcattgtagttttgacttgcaattccctgatgatcagtgatgttgaacattttttcatatacctgttggccatttctgtcttctttagagaaatctgtattcgggtcctgtgtccatttttaaattggattatttgttctcttgttattgagttgtttgaattccttatatattttgaatattaactccttaccacatgtataatttgcaaatattttctaccattctgtaggttgtcttcactctgttgattgttttcttttctgtgaagaagcttttcagtttgatgtaatcccacttgtttatttttgctttttttgactgtgcttttggggttgtattaacaaacaaacaaaacactgtccagaccagtaacatgcagctttccccctgttttcttctagcagttttagagtttcaggtcttgtgtttaagtctttaatccaatttgagttgattttttgtatacggtgtgagatatatatttttttgccctacctatgatattttcccctcacattgaaagcttatgttttcgaagagctcattaaaataagaaaataaaggaaaatatttgggatctagggctaggcaaaagtttgttagaactgactcgaaaagcacaatccatgaaagaaaaaaattgataaattggacttcattcaaatgaaaaaaaatttctttgtgggagataatgggatccttgatgcaagaaattcttaacctttctctgaagaatttcctaaacagacaggagccaacttgactatagatgcctgggaaatggcgagaattgcagcctatggctgactgatacttggatttaaaaagccctgtctttgttgcaatacatgttgtgctccagttactgccctctgggaatgctcccgaaccttacagaaagtcagcattcagtagcaattagagttctcctttctagagaaccacatttttctatcctttcatcacaaatataagttttccatagggattgggttttacattaattggataacaaaatcaagggaagcagtagaatgttgctttattgaataccagcgtccttatagttgggttgggaggaggtagaggtatcagtatttcagtcacaagacttcatttcatggtcatggattccaaacagtgccattcaactctgatagcaaatattgtgttaaaaacaactgtttatttgatttttgtcacattcaaacttctagtgatttaactttgttcctctaagctaagtatctcattttgtccaaatgacctccctaaatgtgcatgtggctgtgtgtctatttccttcattccatgatattatgaataactctaaggtgtgttaacagtcatcatacagaaggaaattccacattaattgttcatatgttgcatcaattcacaatggcatatgcttactcatattatacatgtgcctttcttttccaatatcttaataatcttggagtctaattctgtatgtattcaaaggctaaaatttttctgattcattttggtcattgctattccataaatgtcatttgatgatgtgttttttatgattcttgcttgtaattttaactcctttatccattttaacaccaactgcttcttttctttttttttttttcggagacggagtctcgctctgtcacccaggctggagtgcagtggcacgatctcagcttactgcaacctccacctcccgtgttcaagcgatgctcctgcctcagcctcctgagtagttgggactataggcgtgcaccaccacacctagctaatttttgtatttttagcagagatgggatttcgccatgttggccaggctggtcttgaacttctgacctcaggtgatccactggccttggcctcccaaagtgctgggattacaggcgtgagccacggcgcccagccaacatcaactgtttcatttgcattttttaatttgttaatttcctagttttgcatttgtttttatttctttaattgattcacatatctcaggatattaaacatatcctctggaaagtcagctggaaacttcttagtactttctaacgtttgagtatgttatagaaatacacccagattgaaaatgtgacgatctcttataaaagatttgtccatttctgctgtctttaactgtatctcttgatgtatgacagggaatcttctatttttaaggtggtatttgtttcaattctgtattacaatataatccttccaaagacattttaagtgacaattaaaaatccaaacgtaatttaaaatttagcagtaggcattgctgttaacgctaataatttcagccgaagtgaaaactgattgaagagatgccttctatacatgcctaagttcccacacatagacaatgacagccactgtttgggtgctcaaaactatcttttaacttagattcatgcatttattcaacaaatattatttacagcctaataatgacaggcattgacctaggtattgagaaaattgggtgaatataatagataaaatattcaccatcattgaacttatgttcttcaattataagaggcactcagatttcggaaatgataaaatgtggagaaatatgtaaaatatgtatctcagaacaaagaaagatatgatgtagctttagggttctttcatactttttaaattcagctatttctaatgcaattaattttattcaaacttgtcctaaagagactattttagtatttgcttatgtttcttgaaataatttttttcattatattatttctaatgcaaaggaaatacttcagttttatgtaacaaatgacatcagactttcttttcttcctccattttttccttctataaaataaattaacagaggcttttcataggatagtctatttattttctctgtgctcatgtatgaagaaatatatatgggtggggtgagataggaggagtgtacacaggtatttataatgatggacctggaaagggttaaaacaactcccgtaccaagccctcacttccaagtgaggaaatcctccaacaagcattgccctagaatacatttaaagaggctaatgaaaatcaaacacaacacacacacacacacacacacacacacacacacatttaaaatgtatgtatacacatacatgtatacataatttatatgcatatattatgtgttttgatacatatatatttcaaaaagcaatgtagtaaattagtagcttatttttcatatgagtactaccatatcgtatgttccgaactcaacataagggtcactactgatggcatttgaaaactgtcaagtcagaaaactctcaggtgtaaatgtagacttaatctctgatgttcatgggaagtgattcatggctagtttttacattacaccaaggagatgctttataactggatgctgacactttatatattaggctataatcaatattatttgctacatgctctgtcactgaaataaaaccatgattgttctgcaaataaagttttaattaataacacaaacatccctgtttcaaaatgtggtaaccctgtatatcccataacacaactttactaccaggtataaagatgaactgaaggtttaaaagtctaaaacattgatatctcaatggtataacctgagtctgtgtattgtttttttaggcatacaggtcatatattgtagaagggaaactgaactcagttttctaatctgtaaaatggaaataacagtacctagcctgcatagttattagaaagattagatcatgtgtgtaaagcacacagaatttttgggctcctcctagatttggagaatggtaatctgaggttgagtattgatgtccataattgaattagtgttaacctgtgcattttaacagctgctgtcaatgcccataacacagagacatttaattgctaatccaagtctatgcaatcacttagctcatcactatctaccagggtagaactggcagtcaacaacttctgcaggattgaaaagaagacatcactggagcccactgagaccactggtctccctgcttataggccctttgatctttgattcatctaccaaactgagaaacacccaaattataaatctgaaaactttctagtacctacaatatggcatacaaaaccattcacaaactggccccaccccaactttaagcctgctccatcacctcacttacacgattgtattctaattacacccctaaaatagctcttatgacattgcgttatagttaatcaggtgtctaatccccatctagccctttttagggctgtacctcaaagtatgtgtttgcctaggggcagtttaaccagtgtatgcctcttcatatcttccaagataatcacacttgaaaggagtttcagctgttagcatctttcacagacccctcagactgtcagcagtaagatgaacattctgaaattaagttttaaggatgttcagaaaagagaagtaaggtatagagcctccagttcctccaaaactctccataagcaggtgtgtccaggacagccactcccattgcactaaagcaaatgacacatcttattgtactccttgtgtcttattcctttttgtatgcatggtaacttgtatagtgccctttacttattaggtgaaatttagattaaataattcctttccttctctcttcttcccccacccctaaaaatacacacatacagaatttttcaacttaaagctacctctctgtgacagtaaccaagtgaaaaactcagattcctatgggaacctagggaaaattgaacaagacaggcttggtggatactgagatgacttggagaacacacacttctgcaaaaaaggttattatctcactagctgctatcagctccagcctactgttgttgcatgaaaatggcaatttagtgtggtttctcttcctatctgccatgagaagtcagatatccagaatatttttgggaaatctggtttttatatgttggaaatttggtggttgtttgtttggtttgttctctgtaaagcattgtctaagtcaaacagaatgtacttgtaagggatcagtttgaacctttgctttagagctccaagactgggcagtctctagaaatcactactgtgcattttagcttgaaaagatccattgttcttccaaaagactaggatgctgttaggacacagccaggctgttcatgggtgtgctacctgttcgtatgaaagaaacttggtcagtacctgcctcacaaaattatgactttcattttatcagcaaggaagaacttctgcactgtaaaagcttattaagggaatttgattgcaaattgaatgtggtccagcacctctccaaagctcatttaagatatttgatattttagagaaaaagcctaaatgggcatgttaactatccatttacctgcactattctaggttctatcattgaagtctcagaccatcagaaaataatgtcttggaccccattatctcagtcaatcaaagacaagacttctgagagatgactcaataccatgtcatttgatcttacagaaggctaatataaaaaaaactgtcatgtttaagagcatagtttgaaccttttagaaaactggctggagacacattctaccttgtgtcttagcactgctttataatggatatataaagcagtgtaataaattccaggaaaatagttccaggaaagaatgtttatcctcacggatgcatctatatatgatgccttaatgggaaacagtttcttttccttagttgccaggacaaacttaaaaagctacattaagtgagaataagaatccgaggtttgtttcagagtgtttgaagtccttactaatccttcccctttatttgtttattaaagttaacattggctttaggttttagataactaggaataacccaattataatagtttgtttttattctagtgatatgattctgggtaatcacaatttttaaaatgtatttgctccattttctataatattggtttgctttgttacaaatacaatttttaaaaatgaagagaattctatccatatcatagatttcagtgggtatctgctttcaaaatatcttcaccatcatataccaggactttaaattttaattttagaagtatgttatttgtattttaaatgcatattgcaattcaagaattccctgccatctatttgtttatcatatgtttatcaagtatgtactgggtacccagcactgacctaggcactggagatataatagtgagcaagttagacatatccccctcccttcaggagctcacagtctcattgcagcagaaaagaaaccaggtgatgaaaacacagggtggtcagtggtgtgacagaagtacaggttaggtcacttaacatatactgggcaacagagaggcctttccagaggttgcccatgacatgaagatctcaggcaatagtgggaaaggggaaaaacctttaggcaggaggctgcagactctccacggctgcccttctcattgtatccctggggccttgctcagtgcttggctcatggaaggtactgaaaacatttaaaataaataaataaatgaatgatgggacagcatatgcagaggttgagagccatgggcagtaatcggtcctttggaggaactgaaaagggtatggtttggctgagttgtagagtttgaggtaggtagaaagaggcaaaataagactagagagacatccaaagctcagttgtaaatgagccttatgaatcatctaaataatctgcactttatcctaagagaaaagagaagccatatgtgcttaaataaataaaacttaaaacaaacaaacaaacaaacaaacaaaatccaagtccccttttctctttcagcaacttgacctttggttaactacctggattcccttggtaatttgataaagacagaatgtcaactaagtctcaaggtgacattgctgatagcaaaaatgacccctcattggtaaaatgcatctggactaggagagtctataaatgaaccataaaaacccgatttcatagctttgggcttccctgtgagcagggaagaaatcgttgcaagagatataaggctgttagcaagatgacttccatagatgaactgctggactgttgcatggactcctgatgaggaaggcctgctgctgtggtgagctatggttgctgatctctgccctttagagtagacaagtgccaggtgtggtgtatggtcaccttgtgaaactgcatgtttaggtgagcctaacaagaacccctgacaggcactgcatcattgaagggttttaagtagagagttaacacaaacagacttttatgggatttctttagctattgaaggcaattgccccaggacaggttactgaaataatacattaaccagaattattaatagagttgctggaataaaacggaaacctacaaagaagggaggaaaaagcattctccttttaagttttacctaaacctaaatgttctaagcccatcaagtgggacttacaggaatgcaaactgctttccctatcttttggtgtgtggttcatctgccacttaatggagaaaacattaatctggactggcaaataagaaccaccagagggaatgggcgaaatactaaataaagaccaccaagccattttcagaaagcagcaactattgaaaagagtcaggtgtgaaatactatctcaccccttaactagctgtgtgactttaaacaagtcattaggcttctctgagcctcagttttcttggcaggaagaacaaagggctcagactcaatgacctgcaaatgattctgactcaaagactctatgagtcctgtaatctgagtaccactcatatgccaagtactaggctaagttctaacacccctcctgtcccctataaaaaaaatgttcaaaatcaggtaaatttcaaatgcctgtaatagaaagatcaagggctggggccaacagctggagtaagtctagttcagggttgaagtaaggacttcattatgtctctgcacccaaatgtcagcctgtttaacatgataattgcatctatcactgaaactttatcatatgctttggacccctcacgtggctggtactacggtaggctctgctaggtgattaactatcagaaattacccaagatagctgcccacatgtctggagtacttattgcaacatttgcccaccataaactcttagtgattgcagctgattgacagaattaatagagataataaatattttaggactcccatattcttcaactaccttgaagtaagacataaaaatccagcataatttaagcctaaaatctaaaacgaaataatgcaaagtgaaaataataatttcatttaaaaaagcttgtctccaagaacattaagcactttcatatcttcaggggccactaaaatgtattgattgagaatgcaggagaaaacctctgtttttacaaaaagttttgaagtaggaaattttagtgaaaagaattgcgtgtacttctaggaaatctcatcatgatctcagtgtaatagccatttgcaaaagagccctgaactgagtccatgccagggagcattattggaaaatggcccactgcagctacttcctggaattcctcttcgtgcttcagcagctagcttggtaggcactgggcaccaaacagaggcacagcatcttacagagcatggggaaactcattccaggatgacacagtttgtgatttgtgacttgagccttgaaacaggcagaagacaacagctcacgttacccaaatcatgagataagccttaaaaaaaaagtacaactaaaagtggccatggaaaaaaaagactgaggtaattatggcaagtatttattccaaacagccacaattttatagtgggagttcagggatgtatagaaaaactaatacagcctctgttctcatgagcctgcccagcactttccaacctgcattccatggcattgtagtatttctgagggaattacataattgcctgattcaaattttctttttaaaagatagttataattatttgttttaagcaattgtttagctactgttaaataattgtgattaaaaatgcaaatcttgtgtattaaatttaataaacttggaaaccataaacacattgactgacttatgctctcaaacaacagtttttgtgcagattcaagattaatctctgtgcttatatttatgaatgtatcattgattagagagcgagagtgtgtgtgtgtttaatgttagtacttagcaattttgttcatgtaaaattctgtatgcaagtgctatggaagtactctttctgctttcttctcaatcaaaatattttcactacaatgtaaccaaagcaatatactaaaatgaagtagatcttgagaccaaaagtttatatgactgtcatccatctaccttaatttcaaatctcataattcatcaaaatatttactatgtaaattattggaaaattaaacaattaaggtaagagttttctctgttttgccagttgtttcatttttacaaaatgttcagatgcttatgaaagttttaaaacagcaatttggattctttcttaaacaataaaatgaatctagtcattggtaaaaattagaaagttctgtgctttacataggagatggaagatggaagttactgatgaaccttagcattaattttctgacattttgcaaattttcaattattgctgtgtagaagatcccatatgaagatgaaaaaatcctaactcacttcgcagagcagaaattattttgaaatacatttctgctattatgcaacaacatgtatggagacagcacacagctcttacctctggcaataagaaatggaaaattttggagcttgtgatctaaaattgtactttatattagaaaaattccataaagatttacttgactttttccatgtctagatttgagaaaaggaattaataattttgaattactgctatacattaaaataatagattaaaacatttaaaattttataattatggcttgtgaatttgagaagacgaggattgggcaaggaggacagggaaagtgagactatattcaatgcaactctgaagggaaacctgccaattgtaatatataaaatgacttatgatgccttcaccctcttcatacagttgttataactggagcatctaagtgctttgtaccattagtcactcctgtattgcagtttcattcttacattttgtagtaccttttatacttgtgatttatgcctacagaataactaggaaaaccatatatgttttacatacagattccagaaagagacaactcggctaagtaaagttattttttaaatccagttctgtaatggtgttacaggacacgtggttttccagtaaaacctactcctgtagttccactttccctgcatagacttcttccagggctgtactgctttcttaagctatatcatggtggaatcctatccttcataatgttttggagaaggctgagggtggcgcctgcacaatttgatttggtgtaaaaatacacaccaaatctgatttctgttacattaaggcattctctgacaaaatatacagaacaagaaatgaagtgaattgtgttttagaaaaatcttatgggcttgtttccccgaatacctgaccgctaatttaaaaaaaagaatcaaaaacccactttaattgaatatttaatagatgatttaatggtcaagttaagatacattttaactgctaaatataaaaatgatttgtgtttgcttactggaaatatttgtaatataaactaacatatataataaactaatatttaaagcaaatttaccatgaagaaatgcaatgactattttcaatttataaacatcgtacattcatcaaactatatttttgactaatagttggcttttataatattaatatcataacagtggattgccattaacagtagagatagtttaactcatttttaaaatgggcaatatattttactttaaaatgaaccactggaaatataaaaatgataatattctcctatggaaaggcccaaatgtagctagagtaaaatatatcattttttataaataaatgagtttactgtcttgtaaattccatcctctacataatgcctcatgaaatagggtgatttacagaaaagaacctgggattggcaaataggatggggcatataatccagtctagtgccattctccaacaagttgtatcatcatagtaaagctatgcaagtgtactgtaccttagtgttcctctcaataaagtgggccaagaattacttcatttgatgtatgaaaaaagaaacaaaaaagatatgctaaaattttttcaaaagtaacctgttgtatacgtagaaaaggcatgctaatcatttgaaaataactcatctaatttgttttagtatctaaaaatagtggtaaaatagatattccagggtcctgaaattgctgtttcttcacagtacattctgaataaactttagttcatttggaaaacttgaaatatgaagtccctgaggaaattctgaaaactcctttgcattcctcagcattaaacacaaaccactatggtgtctgatgttaccacctggagacctcttgatatttttaccacagggaaaaaaaagtgtatcaaaacatttctttttcttctagcattataggaatcccagacatagggcaataaatatgttactgatacccacaggtgagcaggcaattctgccctgtgttacaggtactttgtcatcaccttctgaaacactgtttcacagtgcagggtatgttatataaaaaataaatgatgctgccaaatttcagcagttggaaagaaacataagtcaatggcataagggaagtaggtgatgtaatgactctagaattaagtagatggcttgaagagatggatcatgaggtttaacctttgaaattattcattgaatattaatataaacacaaggaaaagcacacttctaagttgctttgttaaaattctattgattaaatcaaatttttttaaatgacagagagataatatatcctattcctggaaaatgtctaagaacaaacacctaataatctggtcttacttaatgtttcagttaaggatgtttgtagagaaggaggttaataatgtctacataattacacaaaaaaggaaagggaaaaattgacaatgaaacccaaacttgtcaataaatggtaaacgattacagatgaataaaaggagatgaaaaatcggaccaaatattaacttatacaaattggaaaagatttaaaaactgattcaaagaggatgggtgattgagataatgaccaaccataaagaaagagaaataacctcaaatgggcatgaagaaccacagcaactcagaaggtgttactaatgagatttgaaatttgatgatcctaatgggcatttggtgttgtttggtctaaaagcaaggaggcaagctttccctcccctatgtaatgtcaacaaaatttcttactccatgtaggacatggagcactaatggttcatctaaacaagctacatttatgaaggcagaaaaaaattataaaacaatttaaaaaattaagaaaaaatactgctctacaaataaaacactaaatagatacttggacaaaatttggacacagggtttctttgcacctcctgcttttgtcagtttctgctttgcactgaaagtgtcttgcatctcttaaaataattttaatggtctctctctttcagaaaaaagctccacagcagaaccttttcattccaggtatctcaccttctgaacccagcttggagtatccccattcccatgtcctgcccacaccaaaatcatcccatctcctgaccatgccatactgccctgccttggtatctgtccccatgttattccctttgcctcaaatgcccttcttgcatcaagccctttccaactagtgtcagttgggtctcaccagaagcagattttagatgaaattagaaatgcaaatgtttattgggaagtaacacctgtgaaagaaaaagggcaaaagcagggttgcgtaaattgtgaactttaatatctcattcacctcccctaaaaatcatttactcttcctctaaaagtgcctacatcccccacttctctcacccctatgaataaggatatataagtttttaaatattattgggtgtattagtctattttcacactgctataaagaaatacccgagactgggtaatttataaaggaaagaggtttaattgactcatagttctgcaaggctggggaggcctcaggaaactcacaaacatggcagaaagtgaaggggaagcaggcaccttctttacaaggcggcaggagagagaagcgcaagcaggggaaatgccagatgcttacaaaaccatcagatctcatgacaactccctcactatcatgagaacagcatggaggaaaccgcccctgtgatccaatcacctccctctcttgacacgtgggaattacagatccctccctcagcacgtggggattacagttagagatgagatttgggtggggacacagagtcaaaccatataattgcgctattgggtactcactttcctgtgatgcccccatgcatataataaattggtatgccttttctcctgttaatttgtctaccgtctgtctatttcagcagactcacttatcaaagctccaaagggtacagagaagtttctcttaccccttcaggctctatcagcctaacagaaactctaaagcaaagaatgcctgtgaaaggaggtcaatatgggccagaaatggtgaggccctggtatcaccatcatgctcagccatcgtcccaagaagagtgtgatctctgctccaacgctgggtcagatattaaaggcactaacaactggaagctgtcagatagccatattcctcacatctgggaaaggagtcctctctttaagagggattttagcagtacgtctcttcatgtctgccacaaaattattctccaacacacatgtgaatgtctattcctatgtgaagcctctaaaattcattcccaggcagttggtggctctctatgcctttacagtaatgtgaatgttaatttctcataccacactgtgtcctcactatttttacaaccttttggaaagtagaaaccacatcatattcttctcagatttcaagtacatagcttgggaaacagagcacctaataaaatatattcaaaagaggtagagtgatttgatggctggacttaccagctggacaacagaccagactggttattgcctattctggtccagagatactaagagatatacctcatgtatgtgaaagtgaaagggtattaagagttctcaaaaactgatttcaatgtactttaaatactaatggactattggactttaaggataacatgtatcaacaattagcatgttgtaagccaaagttttgaaattatgttcccaatcataaatctaatcaccatcataagtagattacatgaacctatctgtgtatctctttccaaccattattctcacttctagttttctctttcaatttacagattgggtaacagtccatctaattttaaaattctaagatgtactgtgtttattctgtactgtaaaataatttaatttcagttgtaaattttagagttttctttgatgacctttttaggcaaggcttagtagttcagtaacatatactcttcatttaatcagccagcaatatttactctctgctaagcccaaagctaagctgtgaggacataaagatgaaagtgaatgaataggataagaagccccttttctaatggtggagacagaatggctgatgatttactacatggactgggaagtgctataatacctaaagggtacacaagggaaaaagcaaacatgggagagaaagaaaaggaacttcttgagttagtgtgactttctcttttggtttcatctccttctgaacttttttaaaggggagcgggacagaaacaaagtccttaagaatgtctagaatccctttctctaaggcagttctcggtagggttggtactgccccctagggggaggctttggaaactgcccaagtgagggactgggtttctcaatgattgtagagacactttattggcatttagcagtcaggcaccagagatgccagatggcctgcaatgcttaggaacgcctttcacagtgaataactgtcctgcttggttttcaaatattccactggtcattcatgaaaagaaaagctttgtatgtaatttcccaagtccagaacataactttgttttacatataactatggaggaatctttcaaggcttttaacatactttgaattttctaagaaggccactaccttgtatattaaggaatggccacattttgctactattgtccagtgtcaagaaaatccattttagatacccacatcactgacagaatcaccacacacacagatatatgcatcaatagcagtggtcttatgtataccacagcatattatataacagtatgttactatatctttcagtgtagtcatgcccaggattttgcacataatactttactataagttacttaccatttatttttcctttaaatgttatataaatgatgtatgtaggtaggttataatgcttatgaatttcattttaagattttcaagggagcattacaaaatattggctaggattgagagcactgagatccactacgattactttttttaaaatttcaagactgacctcattctaatgagaagaaacatgtgaggctggaagtttatatagaccatgttcttaggcatattcagttaccaaagagtgtttttacattgtccctagattggcagggctgcctggctggaggacagatattctgcacaaatatacataaagggcccatgctcatctgtagcaggtaaaagaaagaactaacaactctcctttgaattgtcttcatttcttgtagcttattctcagggggttgaaaatgaagtactctgccttggttttgccttcaaatacttgtcagcattaatttttcctggtggttctctagacagatatattgctcttgaacaaagtagataaatttgaagcaatgcccctggactaacacttcagaagaaaaccatcatccttataatcaccatttccattctctttctagtacagacaattaacatattatttagcatttctttcattctgccttggaccagagttctttgatagatgtctgtcattgtcatttattacacatccactcactcaggcaacaaacatttaatgagcacccatcatacaccatgtggtccatttgctgctaggagcacaagattaataagttccaacttttgccctcaaggagttcacagagttgggaaagaaaggcaaataaataagcaattagagtgccaggtaatatacagtattttagaaggttataaaaggagtgtagaaagtaatataaatgaaaatgtcagcacctaacattgaaccttagacatagtaagtgcttaataagaaatgtttcgagttattcaaattgttccaaggctgaaaattgggcagataaattgaagagttaaaatggaaggataaggctccagctagcaagatgactgacattctgatgggaatgggatattccaagggcactgggacaaatggataatttttccttcagccaccatttctctagcaattgccacatactagacactgtgctatctgctgagaagacaaagctctctaaatcagttgtttttctctaaaggaatttagtccctctatttaccaaaattgtttttagaactatgaatacatatccatattggctgacagaattgcatttgatggaggaactaatgtcacacaaattcccaggctcagaagtagaatgaatcattagtggaggctgacccaagccagccatgttgcaaagagggctctgtgtcagcagcatgggggctactgtaagagaccaggaatgagccagaagtccatagggaggtgatgagtcagaacacaatatgtgaatccaaatactgaggaaacaatgtttgaggcagcggctccttagaaacttctgtggataaactgtaactgaataaggagtgaggtaagtttcaggcaaggctcaggtctctaaaaatatcaaactgaaatcagatcatgacaaagtgagcagtcaagagtgaaataactatcactaacagagtcttctggggggttacaaactagattcattcatatgactatttttaatttcctgtgagcttgctgtgtgtacatctcatggtcctaggatggtgactctcagataacacgaatttcagtttgtattcacgaatttcagtttgtattcaagactttgtctggatgctaaagaatagcaatcggctggtttccctccactgctccttcttttactaattaggaattggctgaatcttcagtacaaactatctcactttccatccattcacccatccactcaataaacacttattaacagcttctaagtaagagatcattttaggtgatgggaggaaaaaagataaatagacctgatccctgtccttgaagggtcagtgtcgggaggtcagtctcagcttcggaaacaatagtgcaaaacacattgacttcagtgacagaatctagatcactttttgtcaataatttaaatgggtatgcagacaatcatagataaagtggtgcctgcacgactgttaccaaagaaatatttaactcaattcctcgatcagaccatctctgggcagagccaggctggcattctgactgctcatgaggaaaaaagatgatgaaatattccagtttttcatatgccaagatgaaaatcatcaatctcaatctccgtgaaagataaaactacttttagaaaagagcagtgaactcttatcagtctttctaaggtgatgcaatctttaagatgatacagagagggcagaaacagtaaagaagtttagaagaatgtatatgggcaaaagggaaatgatgaaatttctctctcaattttataaggagctaaaaataagatgggatatattttaaacctaaatgactacaatgctttttgaaaagtaggtaatgtattctaggtgctaaattatttatttgcttatcatatacaaatttgtctttaacacatgaataccttgatatttaaatgagattgtctattagataattaaaattaatctacacaaatgaagttttaaatttcttccactttttcccctgtacccccaacccttattcctttcaactcgtatgtgtatgccaaatcttgtacatttttagcatttaccagatggctttttcggttcccaaaaggaaccttttaaatttttaagcaataaaacttatatttctgttaattcatattccaaataaaagtcttcaatattaattacatctttattggaataacttacaatgctacaccccagctttgcagagactgcatatccaatatctgttaattgatttcttctagagaatcttttttttctgttgttatgacaaaatgttttgctgtcttgtaatcctcaactgggtaacacatttttctgtaactgtcatacagaaggcacttggtaaatatttgctgaattaagaaatccaaaaggagaattgtaggtaattgggaagcaatgtaatacggtgatgaagatctcagatttcaaagccagcctgcctgagtttgattccccgctctgccacttgttggaaataagacattggacaaattatttaacttctctgaatctgttttctcatcaataaagtggatataacaatattatctgttcctatagcattgctgtgtggattaaataaatattaggtcatatcagtgttaactgtaactatgttaatcattactgttgttattccagaaggctaagggttaggaaaagaaggcatttgcaagatgagattaaaagagaacactagtgttctaaagagaagaaattaaagatgcatgggtttcttgctaatgtccaggtttctcattcatgcatttcttagtcagatgatcttgagaggaagaaaagggcataaatggcttcagtggtcttagtaaacagctacctttccccaccccaactttttgcttggctaaatcctgttcatccttcagctcccagtttaggcaacttttcttggaagaagccttcttgagccccaaagactatgttaggcacctctttgatgtgcttccctagtctctgctctggcatctgacacacttttatggttaatgattctagtttgtatcctcagctaaagaatttcagtttgttagtttgttcttggcgatatccttagctcttgagtcagtgcatagaagcagagaggaagtggtataaagaagtgatgcataaagatgtatttaaagttttggagataggcactgtacaaaatagcatatcaaatcgccaacactccataaccaaaagtcaatcatatctgcctaactgtagcttcctagctcaatccacccaaaagttttaagtgagacattttcttgtagaaagtaacaaagaggagctctgaaatacgcatcaacaatatatgtatgtttgcttataaatgcttgtacacgctattagcatatcaacattatgtccattataaaatacacacaaaaatagaaattccaaaatgaggaaattaacacacgcacacatatatacatacaacacacacaacacacacacacacacacacacacacacacacacacacacacacatatataccttctgatgtagcataagttaagtttggcaatgccatttacatcttgttttctcaagcttgcattattcttattgtctttaaaccacggtttcttgagagagaactgttaagtgtcttgtctattttctggtgattagtttagttaaaaactataaaataaaatctacaggtcacctaaacaggtacacttgaaactgaacacaccaaggatgccttttgtagagtcgatcttccactatatcttcagcacacctggaataccacatgtaacaatgtaccacccaacatatgggccaagtcatgacaccacagtcagtcattatcactgtgctttgcccctaaaccaaaggtaatgtgatcccattacactttgtgccactagtgtgcttaaaagatttcccacaccacactagagagaaagccccagacctcactaccacatacgaggccttctatgatgtgtcctccattacttctctgctccttgatcacacgtaccacacaggcctttcctaagtgacttctgtggccataaagaagaactcacttactcctggagatcttagagtaaatgaaaaaaagatgcacttactacaaataatggcagtcagggaagagtttccctgtagggtagtcacaaagcctttccacaagtagatatccttctggaaaactcagcaggccaagaaagcctgccctgggcccgtacttctgcagggcaggatcaccaaaatgtttctgttgaatggatttttattttcttgatgtacaataaatgcatggttttatttaaacaaaaaacacatttttattatttaattttctagataagtctttgaagatgatgcatgcaataaagattatttgcaatacccatatttgatgcatcgttttcacaaccacatggtttagcatgaaatttaaattcagccaataattccaaggtgacagttttatctacaaagcctccatttctagttcaaccaatttatttaatggaacaatttagagcacttgtttaaactgatccaaataacattcaaaataaagggaaataactttcaaatgcaatttaataatagaaactattgctgtttttaaagcaatgaatctaagcctcaaatgtaagtgttaattgtacaagttcttattaaagagattcaaggaagatagcaaagtaatcattataaaaacgttaacttagataaaatcaccactttcccataaaacacagatacacaaatattaagacctcaaataaaatacatgctgtgaagtgtaataggagaaaacactaaaaaataagacaaaattacaggtttaaatatacattatgccttaactctcactttattggatttccattgctttctagacacatccctacaaatagttccagacacctggtgattttctttattatgagggttgagatggcaataattaaatattctgcatttcctttagtaagagaagcatgatttatgagaaaagaataaaaatctaagaaaatcacttagcaaattatttgatttttagttcaaactgatttagggcaaatttcttccacgttgcaagtatggaaaacgtagcttactggataacagcacagtatttaggagaatatctaggtttgcttccctgtttttagtaattttgtgtctgtaggcaagacacaaaacctctcttaagtcttagtttattcattttgaaaacggggtagtataggaagtatgtttcaaagagtaagatgtataccactggtggcatttaagatagctggtttggcaaggtgggcagattgctggagctcaggagtttgagaccagcctgggtaacatggtgaaaccccatctctacaaaaaatacaaaaattagccaggtgtggtggtacacatctgtagtcccagatacttaggaggcagaggtgggaagatcacctgagccaggaagactgaggctgcagtgagacaagatcacaccattgcactctagcctgggtgacagagtgaggcactgtgtcaaaaagaaaaaaaaaagaaagatagctggtgtggtgataaactcatatttaaaagtgtatttcaacacttttaatgagtatgataaaaaatataaaattagtatgtaaaataaaaaaataactaatttctcaggacaaacctagctagtatgatgggaatctctttcttagagtatagttcttttcagttgtactttgaaatttcacttcaatgaacatgaacattttaaaaatggtaaagtcctttacacagagaactaaatgtcagaagaagggtcttagggttcatgtggattgtgtcagaattaaaggaaatggtgagctaaatttcataagattcttagcaaagcattggaatatattaaaaactcaataattattatttttccttgtgacattgttgccatattgctataatcctaataaatcaaatatactccatttagcataaaagaagtttgagtatctgtgtatagcaaaaccatcatcttttactttccaaatgatttataaataatacgtaccaccaagaaaccaagaaagaaaaaaagaaattaagaaacgaggggagggacaggagctcatagaggacaaataagcagagttgatgaaattaaacaacatatacaatttgccataagaatattttgcaaaatgacatatgttgcaatgattaggctaaggaaatctgcctatgaaatttgaggaattactacacccagtgaatagcacctctataatcatattacattttgtcttaggacattagaaataaagataacagtttaatggttatgtattctaaaaattctatcaaccagcctgggcaacatgttgacatcccatctgtactaaaaataaaaattaaaaaaaaaaaaaaactagcttataatggtggtgcttgcctatagtcccagctactcaagaagctgacgcaggaggatcattttattccaggaggtggaagttgcagtgagctatgatcatgccactgcactccagactagtcgacagagcctgcaccccccacccccccaaaaaaaatcctatcaagtaaggcactacatgccactgtaatgaaagtataaaaacatttcctgtaattttactaagttcttgtgaatagtttttttaaaataagcaatttctcaaaaagaaaaagacaatattaatatgaaatataatactacttggatagttctctcttcgatgtattttatgtgtctcccatttaattgcaattgtagttaatattttcctgcaggtaatatttctgaaaataatatacgcccagcattttgtgaatatgttcttgttcttttaaataaagtattctaaatttcttccaccaacatataaagtaggtgtaatattctggtgttctaattcttatcacagattaaccacaaattttcttttaccataggcaaaaaaaggactattcaataattaatcaaaagagagttaataccacactttaatccaaatgtctttagtcatagtaagactaaattctatactatcaacagttctttctttaaagatgcattctggccatcttgcccaggctggattctaactcctaggctcaaaccatcctcccaactcagcctcccaagtagctgggactgcaggaacctccttatgtctaagaatgtactggggacagaattgggcacaatctggtgaaacctcaaatatgagtaagccaaatgacagaaaaattcatctaaagtttcactttgatagctgaccaataatttcttacccagaaaatggggctctgggccaatgaacaaggtaggctctcaaaattagggagaaaattcagaaatgacatctactgagagttaacaaacaatgaacaagtaacactagctgacttgggagaggtggaagaaacctatcaatgacactatgggcagccctccatatgtgtcaaaaatgcaaatgtagtcactcaaaattaattaaaaagcaatttttctgcttcttgcttaaaatatgtaatacaactataattacgtgatatgatgaaacaggagctttttcacagaggtgaatttaccagatcattaaagctaatttttggaaaataaacatgcatatgacttaaaataaccatctagctttatcaaattattaattgaatttaccataatcagcaactgtcctggcattaaaacatattctacctgttttgatctctggccttcactaaatatgccttttcatttctctctacataacactctccaatcagtaatctcataaaaacaatgagaagaaatcattaagtatttccaagaatgactcctgttttaagatttaacatttcatatgtagtaacattgctcctagtcctgaataaattaaaagaaaaccctttgtgagagataaaagaagtacttaacaatttaaccacctgtaatatgtaaatttataacatgttttcctgacaaaaacacatatttaatcacatgataaattaatgtattcatgaaaagcttacaataaagttgaaaattaaagttgtacttttttttacagtttttaatttttttaagtaacagctaacattacgataaaaatcatagaacattttacaacataaatttagactcacttgttggccctaaaccataaacattatcattaggaagtgacagtgacgaagtttgttataaaatcaaatgatctaaccataaaaatagtttattttttatatgatacttctgttgcccagaaaaggaaaactggtacatgacttttatcaaggtacaaagtaaaagcaaatttacccattatgattagggtattcctgtaatatatatcctattaagctattgctgttacttctgctttcagttttaattgcttaacttcaaaacattgttataaataatacaagctgttcttctagcaaatatttatgattataataggatctagaagtccttcaaacatttgacaattataagaggaaattgatagcagaataggtcagaaacagggcacttggctcagctcttgaagagatgatatactgtgaacttacattttcaatactctctaagtagcgatgctcctcaagttatggtggtgttacttctggataaacctatcctatgaccttttcaacttacagtgggtttagccagatataaccccatcataagtcaaggagactagtgaatgtctatcacttgtgcaccatgatataatcgaaaatcgttcagttgcaccaccataagttggagactatctatagtagaaaagttctgttgaaagagtataccaataaattttgtacttactttgcagaggcaaagtgtttctaacacactgtaactctagttcttctgtccattccagctttggcagcatctgcttcatctcacagttaccattctctgccatggacactggttgactattgacgggtatctttcccaaactcttcatgtgttgttgaacttccgccaagagaacagcttgtattgcttcagttacctgtaaggtatttttttaagtgaattatttttagtattattacaaatgcttgggtatgttgcaaaaaatccaaagcccggaatttaaatttgaataggtttccataaacgataacttttcatacttctagaattagcatccacaacaactgaaatgtgggtagcaacaactggcacccagactttcacactgtttttttgcaatgcaagagattctaaaaggatacttgaggggcattttttaaagtccagaatgccaaacattacactatgggacaaagaggagtttttaattatttttcctattttcatttccaccagaagataaagaaaattcatttgaatttatcctatggctcttaaagacaaggttagatcctcaaaccatgtctagctccaaagcattatttaaataaacactgcatttaaactatgctttacacagaaaattaaagaaatgacttcaataataaatctcactaacttttgtgtatacctatgtggttttacatagattaaagtattgcaaggcacgtcttccaattgctgtgtgtgcccagtcaaggacctatggttcgaagggcggggggaaagggacacttgccacagaacatccaactaaattcttcatttttaaaatgaagaatctgggtcatgacacctcaagcttacacagacttggtggacagaccttctgatccctgattctatgtccttcgaagtacatgtccactcaagattctatatcctctgccctcagtgcaaagctagtgacagtttcctagacctcttcctggtaacagatgaggcaaggtctagcagttaggtacagcccaaggaaggccaggagctgaattagggagagaaaagaatggacactgctgatatagacgaactagggacaccttctcatcactcttcttcagccaacagttaaaccttcatatagctacatcccagtgcctttcatatagctacatcccagtgcctttcatatagccacatcccagtgccatagcatatatattttcccctcagaagtctgtcctctgtcaagctgactcatgttccacaattcaccactggacccctccattactcccagtctacccataagcatgtctagagctagggatatgagacaacaccgagagtggtgacctagagatgctttggccaaaaactgaacgtgtatttatgtaaacaaattacattcagtctcttttgtatgtgatggtagcatgtgagaccttcaggtcccagggacatccaacgagcttattatgatggcagatacttgctgaaatcctggggcagaaaagctggcctctgacttttaaatataggaagcttcctgagaatactggagcagcttcctgattgctgattatctccctgcccttgtccagcccacactcaaatgtttaaggagtgaaaaaaggctaaggaatagtagaatatcactattgcataccatgcatactaacatgaggtactgcctaatcgcaatgcaagtgaatggtgcttactcatgaatatcatgtaatgagatatttaacatcagagtatcaattatgtgccattaatctaagatatacttctgcatatcatgatgctggtgaatagtgcctattaatatctaccatatgagaccagcctggttgacatggtgaaaccccgtctgtacaaaaaatgcaaaaattagcctggcttggtggtgcgcacctgtagtcctggctactcaggaggctgagacaggatgattgcttgaacccaggaggcagaggatgcagtgagcccagattgcacccctgcactccggcctggatgacaaatatggtatatatatatataccacttctgagatacatatatattaagtattatatatgtttcttactaacatatactgctatatatatatcacaatattggtaaaccatgctgatttatgtatctcacatgatgggatatattttattacttattcatgatgaacaattttataacactgaagctatttcattttaaatttgtcatacatgttatttgatatcactggttccatgatgtggatgatgtggtagaaagaactcaggattataagtgaaaacgtttgtatttcctattccaccacgacagttaccacaaatccaacctttgacaagccacaaacttctctgaaacttcatgttctcacttaaaaaacagtctgtgatactgacagaaattaggataagagctttcagtaacagaatagtgcatggaaattgctctttctatactcataaattaaggatattggaggatatcctaagacccacaatgtgtacagactatattatacccctcagaatgggtagtttggccatatgccttcactgggcttatggctggcctctcaccctgggatgcttatcaccccagaggcatgcccacaactgtgatctaaaatgtcatctctcccactgaatataatatcctatacaacttggataatcattccttcttaaaaatatacaggaatttatgtattttaatttaatatttctaattatttgatttacatgtcatgacttcactttaactgttgattttttacatagttgtcaccacaaatgcatattataagaataatgatacgaatatcatcaaaaacaaggagaacagaaataactatagaataaaatagattaaccatgatgagtagggtactcagagccacaacatttaaaagtgaatactgaatggcatccaactggaaagaaactcaaaatatatatttaaactcagtgtgagatgagagaaaggctgtatcttctaaacatgtaataatgttattatagtatctggaatagaatgggcactacataaataccagtggaattgaaatagattctgcagactttcaaaaataaactgtgggaagtataatttattgacagtttataactatcagtacttgagtctctctctataaatgtaatagatagattttacaggtagtcaatagaaatagaatttactccaaaaaaatataaaatgtttatatggcattttatataactttgtaattttaataatgagctagtattgagcattatggctataaagctgtcttcccaatgcatataaagaaatttcttccaaaaggtagatatcaaagaatcatattcttttatgaggcaatgtacacagattaaaaataaagtttacaaactcattgactggaaagagtcagctacaaatctgggacatatgcttattaactaaaggtattactgagtcttaggcaagctaaaaattttagtggcattccataaacaccttggaagagcaaaatactgtaaaatagcatagagcatcatgaagatgcataagaacccctgtgtcctggttgttgttccagtgtctagtttttttgtcataaaacatttttcccaacactctgctcatgctggcctttcctgtctttagggtgtctcctggaaaagcaacatttctagctggaggcctacatttcatgatgtgtacccagtggtgttagattataaaatccaaagaaatttagtgcagtactggaaacatgcaaattagcaatccccaaacttttctgtttcttttctagcatttatttttatgttgagtgtttaatgtgtgaggagcaaaacagacaatctctagacaaacttattcatcagcaaaattaattcattcttcccccaaccttaaaggtaaacattcaacttctagagctaattttgctctgttttacaaaagtattccatttaactagggttaaaatgaaagaaaaattgttaaggacagctagagagaaaggccaggtcacctacaaagggaagcccattagactaacagtgggcctcttagtggaaaccctgcatgccagaagagattgggggacaatattcaaaattcttaaataaaaggaattgcaacccagaatttcatatctagcctaactaagcttcataagtaaaggagaaaaaagatccttctcagacaagcaaatactaaggaaattcattaccaccggacctgtcttagaagagctcctgaagaaagcactaaatatagaaaggagggactgttaccagccattacaaaaacacactgatgtacacagaccagtgacactgtaaggcaaccacataaacacacctgcaaaataaccagctaacatcatgatgacaggatgaaatccacacatatcaatactaaccttaaatgtaaatggactgaatgccgcaattaaatgacacagagtggtaagctagataaagaaccaaaactatcggtatgtcgtcttcaagataacatgtcaactctcaaaataaagggttggaggaaaatctaccaagcaagtggaaaaaaggaaaaagcaggggttgcaatcctagtttctgacaaaacagactttaaaccaacaaaaatcaaaaaagacaaagaaagacattattacataagggtaaagggttcaattcaacaggaagagctaactatcctaaatataaatacaaccaacacaggagcacacaggttcataaagcaagttcttagagacctacaaagagacttagatccccacacaacaatcatgggagactttaacaccccactgacaatattatacaaataactgagacagaacattaacaaagctattcaggacctgaactcagcactggatcaaatggacctgatgtctatagaactctccacccaaaaacaacagattatacatttctctcatcaccacaggacacctattctaaaattgatcataattggaagtaaaacactccttagcaaatgcaaaataactgaaatcataacaaacagtcaccaggaccacagcacaatcaaattagaactcaagactaagaaattcactcaaaaccatacaattacatggaaattgaataacctactcctgaatgacttttgggtaaatgacattaaggcagaaatgaaaaagatctttgaaactaccaagaacaaagatacaatataccagaatctctgggacaaagctaaggtagggttaagagagtaatttatggcactaaatgcccagatcaaaaaactagaaagatctcttgttaacagcctaacttcacaactaaaagaactagagaatcaagagcaaaaaaatcccaaagccagcagaagaccagaaataaccaaaatcagagctgaactaaaggagataactcacaaaaaaatctattcaagagatcaacaaacccaagagctggtttttggaaaataaaataaaataaaatagatcactcactagactaataaagaagaaaagagagaagattcaaataacacaatcagagatgataagggggatattaccactgacccaacagaaaagcaatcctcggagaatattataagctagtaatatatacacgtgacctagaaaatctggaagaaatagataaattcctggacacatgcaccctcaaagactgaaccaggaagaaactgaatccctgaacagactaataatgagttctgaaactgaggcagttaaataaacagcttaccaaccgaaaaaagcccaggaccagacagattcacagatgaattatatgagatatacaaagaagagctattatcattccacctgaaactatttcaaaaaatagaaaaggaaaggattcgtccctaactcattctatgaggccagcatcatcctgatacaaaaacctggcagaaatatgacaaaaaaagaaaatttcctgtcagtattcctgatgaacatcaatgaaaatatcctcaacaaaatactggcaaaccaaatccagcagcatatcagaaagcttacccaccatgatcgagtatgcttgatccctgggatgcaagtttggttcaacatatgcaaatcaataaatatgattcatcacataaacagaactaaagacaaaaaccacatgattatctccatagaagcagaaaaggctctcaataaaattcaacatcccttcatgttaaaaactctcaataaagaagatattgaaggaacatacttcgaaataatgagacatatatgaaaaaaccacagccaacatcatactaaataggcaaaagctagaaccattctcccttgaaaatcagcacaagacaaggatgccctctcttactactcctattcaacacagtattggaatttctggccagggcaattccacaagggaaatcaataaaggtcattcaagtaggaaaagaggaagtcaaactacccttttcgaagatgtcatgatcctctatctagaaaagcccatcatctcagcccaaaaacttcttaagctgttaagcaacttcagcgaagtctcaggatacaaaatcaatgtgcaaaaatcattagcattcctataaacaacagtcaagctgagagctaaatcacaaacgaactcccattcacaattgcaacaaaaagaataaaacacctaggaatacagccaactagaaaggtgaaggatctctacaaggagaacaacaaaccatggctcaaataaatcagagatgacataaacaaatggaaaaacattccatgttcatgaataggaagaatcaacgtcattaaaatggccatactgcctagcaattcacagtttcattgctattcatatcaagctatcaacgtcatttttcacataactagaaaaaactatcttaaaattcatatggaaccaaaaaagagcctgaatggccagggcaatcctaagcaaaaagaacaaagttggaggcatcacgttacctgatttcaaactatactacagggctgcagtaaccaaaacagcaaggtactggtacaagaacagacacatagaccaatggaacagaatagagaacccagaaataagatcacacacctaaaactatctgatctttggtgaacctgacaaaaacaagcaatagggaaaggattccttacttaataaatgttgctgggataactggttagccacatgcagaagattaaaactggaccccttccttacaccatatacaaaaattaactcaagatggattaaagacttgaatgtaaaacacaaaattataaaaaccctggaagataacctaagcaataccattcgggatataggcataggcaaaggtttaatggcaaagatgccaaaagcaactgcaacaaaagcaaacattggcaaatgggatctaattaaactaaagagcttctgcacagcgaaagaaactatcaatagagcaaacaggcaacctgcagaatgggagaaaatttttgcaaaatatgcatcttacgaaagtctaacatccagagtctacaaagaacttaaacaaatttacaagaaaaaaaactctattaaaacatgggcaaaggaaatgaacagacacttttcaaaggaagacatatatgtggccaaaaatcatatgaaagaaagcttaacatcactaatcactggagaaatgcaaatcaaaaccacaacgagataatacctcacactagtcagaatgttgaagtcaaaaaattatagattagaaaatcaaaaataacagatgctggagagactgtggagaaaaggaacgcttatacattgttggtgggaatgtaaattagttcagccattgtggaagacagtgtggtgattcctcaaagacctaaagacagaaataccactcaacccaacaatcccattagtggatatatacccaaaggaatataaatcattctattataaagacacatgaacatgtatgttcattgcagatctattcacaataacaaagacatggaataaacctaaatgtcaatcaatggtagactggataaagaaaatgtggctcatatactccatggaatactatgcagccataaaagagaacaagatcacgtgctttgcactgacatggatggagtcggcggccattatcctccagtaaactgacacaggaacagaaaaccgaatactgcatgttctcacttataagtgggagctaaatgatgggaacacttgaacacgtagaagggaacaacctacactgcaacctactgaagaacagaaggtgggaggagagagaggatcaggaaaaactactaatgagtactaggcttaatgcctgagtgatgaaataatctgtactgcaaacccccatacacaagtttatctatgaaacaaacctgcacttatacccctcaacttaaaataaaagttttaaaaaagtaaaatcaagctaacataattcaactaactgcttaaatgaatggctttataagtaatttgaggatagccgggcatggtggttcacacctgtaatcccaacactttgggaggccaaggcggggggatcatttgaggtcaggagtttgagaccagcctgatctacatggtgagactctgtctctactaaaaatacaaaaattagctgggcatggtggttcatgcctgtaatcccagctacttgggaggatgaggcagaagcgtcgcttgaacctgggagacggaggctgcagtgagccgagatcatgccactgcactccagcctgggtgacagaaaaaaaaaagataataataatttgaggatcggttattgaagcagtagaatggatacttgcaagagtctctattcttcctgaagggccagcaatactcatttccattttacaaatgaggaagacaaataatcaagaagtttaaactatctcacagagtcatgcatcaggccagtagcagagatgagaagagaaccttgaagtctggacttcctgtagagtgggtaaattctctggtagtctttgtccacagccagcatttcacataccgtcacagaatcatagaaccttaaaggtctgttagtccaaacatgcccaaatgacattaaagtttatttgaaggtcaaatgaacaactatcaaagatcttcaagtgagagcaatttaagagaaatgttctgctgaatccttctttttaataattttttccccatttaggaattttttggccactggggaaaaaatctcacttttaatagataaacctttttagggtgactgctaatgtgctgataaagttgcctgtacttgtgtttattccaattattacagaggttgcctgcatagctactcattcactcattaaatatgtattgactgcctactgtcacttctgcttttctgggcattggtaagagaggggcaaatgagacaaacaaggtcactgctctcagcaagcttatataacagcgagaagacaaaataagcaagcaaaacagcaaataatataattttcattaaaagtaatcacagcaaaaaaactaggtaatgtgatgatgactagatgactggggttgggtagaatgtggcagcaatattagttggagttataagagaagacttctttaaggagatcgattttttaagcaaagacctaaatgattaatgaagaaatgagaattctagcccaagagaacagtaagatcctgagttcaaatgagctttacgtcttctggaaataaaaagaaagccagttggggctaaatcaaggtaagataggaggtggcaaatgatgacagatgtggtcaggctggggaaaaaatcacatgcatatttgcaggccatgataacaagtttttatagccattccaactgtgtatatttagtattatagcatcagcccctatagtatattacgagttaactttgtttccctataaccaagaataatcatttgtaattggagttattgctattttaatcttgcaaatatgatatgtaatgtatcaagttcataaaaaagaataaacttctagtaaacattcatcgaatcaacgcacaactatttattgtacaattcacaaaggtactgctaaaattttgagaccaaaagtagccttaaaggagaaagaaggatttaaattggacattgaagaaccagtcctctaagtcaactcacagatgaggtactctcagaattaaaaaaaaaagacttattaaattacaaaactatagtaaccaaaacagcacagtactggctcaaaaggagacatatggaccaatggaagagaacagagaacctagaaacaaatccatacacctactgtgaactcattttcgacaaaagtgccaagaacatacattggggaaaagacagtctcttcaataaatggtgctgggaaatccttatgcagaagaatgaaactagacccctatctcttaccgtatacaaaagtcaaatcaaaatggattgaagacttaaatctaagccattaaactatcaaactactacaagaaaacattgggggagatctccaggacattggtttgggcaaaaatttcctgagtaagcacaggcaaccaatgcaaaaatggacaaatggaatcacatcaaatttaaaagcttctgcatagcaaaggaaacaatcaacaaaaacaagagacgatccacagaatgagagaaaatatttgcaaactacccatctgacaagggattaatacccagagtatacagggagctcaaacaactctataggaaaaatctaacaatccaataaaaaaatggccaaaataattgaatagacatttctcaaaagaagacatacaaagaataaacaggcatatgcaaaggtactcaacatcacttatcatcagagaaatgcaaatcaaagcaacaatgcaatatcatgtcaccccagttaaaatggcttatatccaaaatacaggcaatatcaaaagctggtgaggatgtggagaaaagaaaatccactgttggtggaaatgtaaatgagtacaaccactatggagaacagtttggaggttcctcaaaaaactaaaaatagatctaccatatgatacagcaatcccactgctcagtataaccccaaagaaagcaaaccagtatatcaaagagaaatctgcactcctatgtttgttgcagaactgttcacaacagccaagatttggaagcaacctaagtatttggaagcaattaagtatccatcaacagataaatggataaagaaaacatggtacacatacacaatacagcactattcagttataaaaaaaatgagatcctgtcatttgcaacatcatggataaactggagatcattatgttaagtgaaataagccaggcacagatacactaatattgcatgttttcacttatgtgtggaatctcgcaatcaaaacaggtcaggtgagatggcacacacttgtaatcctagcactttggaaggctgaggtgggaggatcgcttgagcccaggaatttgagaccagcctgggcaacatggcaaaactccatctctttaaaaatacagaaaaaattagccaggtgtggtgtgcatgcctgtagttccagttactcaggaggctgaggtgggaggatcacttgagcctggaagaacgaggctgcagtgagctgttactgtaccactgcactccagactgggtgacagagcgagatcctttctcaaaaataaataaataaataaataaataaatataaaaataaaaacaattgaactcatggacatagagagtagaagaatggttagcagaggctgggaagggtagtgtgggatagaggtaggtggggatgattaataggtgccaaaaaatgttagaaagaatgaataatacctactatttgatagcacaacagggtgattatagtcaataataatttaattttactttttaagataactaaaagtgtataaatggattatttctaacacaaaggacaaatgcttgaggttatggataccccattctctgtgatgtgataattaggcattgcatgcctgtattaaaatatttcatataccccataaatatatatgaccactatgtgcccacaaaaatcaaaaattaaaaaaaaatctaatttcacataatcaaattcccacacataggtactttaatgtatggcatattttgaaatcaaataatggacaatcctgcttcaaactgaagcttcaacaagcaagaaattacctgtgatagcaagaacctccctccctcagccccgggcattcacgctcccctagtgaatggtgtacccttgcttatgttatggtccgtgttttccctcatctctatgtctgttcaaaggccattttatgaggacaagagtaactgcttgtattttcagatagaggggggtatccatgaaccacagcagcaaggaactcttctaataacgtcatgaatgtgaattatatcatacctgcacagactggtctctccaacaggaaattagcttcaaaagtgaaaggtcagcctcaggtacatgggattcattcttacctagaaatatacagaacacacttgtatctttagagtattaaaaatggataatggctcttaagatgggctgcatattagaatcacctgggaagctttgttttttataaacaccaatgcccaggttcaatcttccagagatttttattttacagatcctgtggtagaggtgggacaggcattaatgctttgtaaaagtgccacagatgatttacatatacagccagggttcacatccatttgtgtacatttatacacacacacacacacacacacacaatttatatgtaattctaacaattatactaacacatattcacatcaaatcaaattcatttttacagcttcaacacatttttgttctttttgctgacccaagacagatcaccaaatcttacaattccttccttatacaaattctgaaattctactctgccatgaattagtctctatcacatgtaaaatcaaatcaaagacttcctttgatttgtccttacccagctataccactttgatcaataggtagagcactactgttttaatttaactcattctgttatgtattatttcttctctgtttgccctctccagtgtcctttctatttgccttaatgttcagtgtgaaattttaagaatgagtgagtgcttggtctatgtaaactggttcatagagtgtccagcagtttcctacacaaaaaagtacttaataagtgccttttcattaattgaaaatgtacatataaccataatgaacaatcgatgagttaaggctttctgatggctacagtctattatctaggtgccagatcctgagagatagggaagactggtaagggcttctgcaagcggaaaagttgttactataattgtctacttaaattaatatattgatatatgtttgacattgtggtatcaactatttaaattagcatttgtctgatacacttttcatcaaatccctatttttatattaacatatgaggtatatatatatatatgaatatatatttaccacattagcagtcaaggaaaatgcaataaaggtattgtatacaatgcaatttgagaacataaaagtaatacataagaaacttctgaccaattattgatattactttttcctgatagagcatttaatataaatgtaaaatgaccaagaacactatataaaacatggaagtatggtagaagattataattttgacatgttttccatttcttcatgaacacagcaggtaagagaacattttcttttgatctctgtttttcctccctctcccactttgtggaccttgtgactcaaccatcaaagctaagtattggtctcaactgtaactacttactagcatcatggggtacttcacagcacaatttaatgtgatgttaaaattttaatatgtgatagaaatgagagccaacttatcttggcaatgtcagtgagttaaagaattaattgcaactttagggggaaagataaaagaaagtatcccagccttaccaacattattcagtcaattcctgctgacagaagtgaatactggttcctaacaacgttttagatgagcacctcggagtattatttttattctttaggatttggcttcataaaattaataccatgaagtcaatacttcctttctttaaccttccatcttcctattatttttttgaaaaacatgtttccctactccttagctgaatttcaaatgctataagtgccaacctaaattccagagagatgattctatagtaacagtagctgcttaggctttttgctggggcacccataggaaaagcaggggcctccttgattctggttagcaatcccctgtctttgcagaaacacttatattaaatcttaaattccaatccccttcccagttacgagtgctaaaaaacaaacaaacaaacaacaacaacaacaacaaaacactggataactaaccctaataagagtaactatctaaggagaaaggaggcaacccagactggggctatttagatggaacattatctgtaatcataaatgtgagaagtggcctgacacagtggacaggaaatggggttaggaatcagatttggattggaatgcaggcccctctactgaatagctgtttgcctatgagtcatctaacttccttgagtcccattttttttttttaacggtaaaacagagatgctgcctcctactgtgcagggttgtttttacattaaatgagataatatatgtaaaaccattaacataattcttggaacaaactaagcacaagttaattggaagctaataataaactctcacttgaaaatactcttttcaacagtcgtgtgagggccactgtgtactgtcattcaggtcaccccatcctatggatcatatgctgcacagctttggaggcaacatgtgcattgtatctgggatcacattcccattttacaaatgtagtaattagggcttttaaaaaggaaaagacatgcccaatagaacacaaatagtgaatggcagagctggatcttgaatctcagccatctatcttatttatctccaaaaccactgttctagtcattatttatcctttaatttcatttgtccattaattgaactcatccactaattcaaaagttatttgctaattccttctagatattgttctaggaaccagggacacagcaatgaataaaactgtcacaaaaatataacttctatggagcttacaacttagtagcaggaggcagatgagattttttaaagtaacagatgtcagatagatagtgaagaggcttatggagaacagtacaacagcgaaaggggtagggagtgctgctgcagtgataaagtggcattggagcaagacttgatggatggtagcgggtggagggtgagcaggttgagctatatgaaggtctagggaaagaacaccacaggcaaaggtacagctaatgcaaaggtcctcagacctgcttgtcatgcttgggtaagagtaaaaaggctagggtagctggaatgagttaagcagggggtgagcactaagagagaaggttggatgggggtgtatatgtgatgacataggtagagcagccagatcctatagggctttctgtgctatagtaaggacaatggcttttattctgagcgaaacagaagccaccagaaggttatacatagacgagtgaggttctgacttagttctgaataaatcattctggctgcttgggtgggaacagagtgcaggagtcaagaataggaacagagagatgatcaggagcctgctatggtcatccaggcaagacaggatgaacgctcacaggggtgagggtgagggaaaggaaggttgagggggatggagttgctggtgtagggggtgagaagcagtcagattctgggatacattctgaaggtagaactgacacaattactgacagattggatgtggggtatgagagaaagggaaagtaaaaaagaatcgcaaggttcttcgcttgagcaattggtgattggaaggatagaactgtcatttattgagatgtcccaaacttggaaaagcaggtttgggagatacatttgccatttggcatcaagaggaaatctaaacactgaagttgagaatataaccttctgaaattgcaagaaaattatctaatataataatcatttatttggtaataaagatgatgcaataaactttccaataaaacacaataataaaatacttaacatataagtatttcctttgctgaaaagtttcaaatttttaggcatttcaaagatcatttgaaatctatgttttataaatgttcaaatgttatgtctatgttttaaaattataaaatgttcaatctatgtttttaaatgttttataaatgtcacccaccttattttctaaatgaagaaagtaaggcccagaaaagctaaatgactagcctaaagccacacagctagtgtaatcacaaacataggtaaaatctatgttttatatatgttatttattttgacactgctaaccagttatagaaagactagttatgtcctttcacagaaaaaaaaaatcagatcatatctgtgccagtaactctcttaccatttcgtaagcaactgtagaagcttgacatatttaaaatgtcattcccagcacctctcatcttattatgtatactttccattctgaaagaactgttagaaaaaagattgacagcatattactaaaaagcatgaaaaattatttgaggaaataaatcaaagatatgggtacatgaccactttagcaaatttggaaattgaatacaaattatttttagcaatatctttcacatcaatttctcttgtgaatctgatttcctcactttgctcccacctaaaatcttatttatttatttttttaggctcccacctaaaatcttaatcccaattgacctgcacatcttagtttgccagaattatctgtgaactatgtttacaagacaggctttgctattttaggttacatgattactgactaatgcaacaaatttaaaaaacccaatatgttcacatctgtcaaagaattatcctcaggtatcattggagccttatgaaggcaggttttaccctaggccagtgttctaatcataggaatcttccgaaactgccagggatgttctgataagtaggcaggtgttgccttaaaatatagttaaatcatgtgcccaggtgttaagcacacaaggatttctcaaccttcacaaccacagtaaaatctttgtgaaatggtcacatttgttggaaggatttggtgtgacaaatccaatatacatgattttgatttctcaaaaaataatatctgggctctgacagcagatcaaatcttgagtggctgcagtagagaagcagtctctaatcctgacaccttcattctataatttgtttcaatgaagaattctttaaagagtcaaccaacgtgtgacaacatttgaaaggctatttaatgaaaggcgtaccaaaagtccataagcttccctaaagtgcaccagacatcagacacatcatttccatcctgtaatctgtaccaggaataaacttagaatgaaaacctctggcaaacaactaagtccctcatctgctctgtgggatcatgattagaccaataaatcaaactggttaccagcctaagcttttaagaatttgacaatcacctacaccacccacctcattttgtaaatgaggaaagtaaggcccagaaaagcaaagtgactagcccaaagccacacagctagtgtaatctcaacactcaaaagcaacagttattactaaactgtactatgtataaatgaatcactaaatagcctcttctattttattctattttaatatgccaaaatataaaataaatggtaaaatttgaggtatgaaattttcaaagttttccttctctgacgatataaaaatatatcatcataagcatttacttaaatgtttttgctcatacttgattcacaccatgtataatggatttcaagacgtatatgtgtctatgtatgtatatgtgtatgtatgtatgtatgtatctatctatcaactcattcaacatcccacactatgtctttcctggcacatattatgagaacattgaatatttgttgagttaatgaattttaaatcatatagatttattgccaaattatactctaatcccaaacaattaaaagggagattttcttaaatgttttttaaaccagaaattgttgcatacttaccccccactggaaagaaggaaggaatgttaaagagctaaatatagcaaataatgatatatatttttaatgtcataatctagtatagtcaaaatctctaggtatgtcttacctgccaactctacatgccaattctaaaggcatgttaactaatttattaactaaaaatagtctgctcaacaaataaactatagtatctgactctcgcaaagaatcacaattattttccaatcctcttggaattccaacctgatttggaagagtggctgtgtatttatctgacaagtccaaaactttcctggaaaataaatttactcctgaatagtcttttatcattccactattgcataaatcccaacctggcaacatcagtgagaaattatcttcattcaaagaaattcccaaagaaataggaccctgaagctttaaaatattgaggtgcttaatgcaaagataatctaaatctttatccactccccatggcaaaaggcaagacagaaacaattttgctgtgtctattgtgagactggcatctacttttcttgatggcttaggctgcatttttttggagatcttcattttcttctgccttttaatgccatcattttcttctgagaatttgatggtattatctccttgggccaggctttcagtaataggcttggctagtgcctctgctgaaagaggaccacaggcagttttactttttctcagtgtcagtgtcttcttctccactgtgctcttggctcttctcaggacctcaccaccatagaatgaactggaagagtcaacatcactgagtggagttggtagcaaaagttcaacaaggttttccagatcaaatagaagaatatgaaagccaacgttactccattttgtcttcacaggcaagacattaaaaggtcttgggcaaaatttggcatcagtaacctaagggaacaaaaaatatttgtgtcaaagttcttgcttattattttattaaagattccatgatgttaaagtggcatttttaaaaagtattacattgcagagcagctaaaggcaagtcatttcaatttttttgtcttagctataaaaattcatttctaaattaaatattctatattctaacattctttgaagacttcttttcttttttcctaagttttatttttcctctaaataaatatgaattatgtctctggagtaagatggcactagattaacatcctttaatatagactctcatatctttctactattattgtcataaagacatacaaggacaaggtaggtttgaaaactgaggagaacaaatgtaagaacgcatgcaaaaatttattaagtattttaacaaaaatggtgcttccaaatttgttaaaattggaagtaatttaaatgttaaccaatgtcatattgctctaagaaaaactcaaaaaactcaccttgttgacttgcatttgattttgccccaaaggctggcacagtgggttcccatacttaaattatgttcttgctaatttatgaggcattccttgaatactctattccctcatatcaacccattactctctataatcttccttgctttttttcttctttctagaacttaggatttccttacagaatatgaaaaatttatttctttattgtatgtttcctccactagcattcaagccacacctttgcaggaattttgtatgttagttgcttccagtgcctacaaaacaatgcttctatacagcattatcaagagactcaattaatgtttgttgaattaataattagcaaatttatacaatggaacaccatttaaataatttaaaatggtggtgtaaattatatcgatcggtgaaaaacatgttattaggcagacaaaataattctccttttgtaaaattttacgtacaaatatataggtatttaaaaatttgacacatatctctatctacatttgtatatataaatatacatatatagggaacatgtaaatacaaataaatgaataaagtcacaaaggatatgaaccaaaatgttaacaatagttaacatttaattgggaagaaggaattaattgggaagcagaaattaaaatgatctttatactatggtgtgttgtgtttttggtttggttttctgaaatttttttacagtgatgatatatttaattttcaataataaaaaaggaaagtttaaaaagaaaaccattacaaattataaatggtaaaaaatgaaatggagaacaaattataagagcaaatttgtcaaataagggttaatataattattaataaataatttttgcaaatcaataagaagaggctcttacagatggatgaatgggcaaagataataacaattcacaaaacaaatattcaaaagttacaatatgaaaaatttttactacaagtagtaaccagaaaaatgaaattaaaataataccattcattggcctattaatttcaccattatgttcatcaaagcagccagacataaaagaattagctgtatgtaattccatccccgttattttcaaaagacaggagaaaacaaaacaatagggtttaaggataccttcataaacaataaatctacaaagatagtggctaccttttgaggactgggaggtatagtttctggggtgctcacatgttttatttctggatctatgtggtgattatgaaggtgtgtgctttatgacaattcattgagctgtacatttttgtgctgtgttgtttacttttttctatacgtgttatacatttcatggtaaataaataatgtaaatgaactgtttaaggaatattaacaaagtgcctccatttggactaaaaagtagaatatgccctgattttttttacccctgcatactgtcagaaagtaaccaatatttgaatttcatgcttataatttctttgctttcatttagtgtcttaaccttaaatatgtattcctatttgacctacttaattttgcatgtttttgcatgtttgccaaactccagattacatctcccacttatttagaccatgtttaatttcttttgatagttttataatcactcaaaaatatgtttatattacttgcctatcagttatttagctctgcagtacctataactatgggcctcttaaaatttattacttttattgcctctgttttttcctgctagaattttgtcaattttgatactctttttaaagcatcaacttttgactttggttatcctctcaatggaataatgtttttctcaaaaggtagtcttgtgttagcttgacttattttctcccagtattcgtgaagaagggattattctgcagtctctggcttcctctgatgcagttgagaagtcagctgctagtctgtcacaccatctgtcttttctctctgctgtttgatgagatccttttggctttaatattccactgcctcgctgtgattcttctaggtgtggatgttttcccccagtcctccactgtatctgagcctccccatctttcattaactttgtgaagttgttgggcttatccctttgaatattttctcttaccatcccattatccccttatgggactctgatcaggtatttgccaaaggctgtatccccttacacgtttttcaactcttttgtctttctgtacctcatgtggggcaatcccttcaaaatttttcttttagtttgccagttgtcttctcacctgtgtttaatatgttccttaaattgcccattgagttcctaattttgatttttacatttttcattgccagatcttctatttggttcttctaaaaaaacaaaatggtcatttttatagacagctatttcttactcatattttaaaataattcttttatttttaaacctacttattatactttgcatctgtaattaaagtttctaaaatctttgtggatatggctctgcttttttattttgccaacattttcctgtttccttgtatgctttataattgtgtgtgtgtgtgtgtgtgtgtgtgtgtatgaaatgtgatcagtgagaatcctttgagatatatgtgacagtgcactctttaagagaggattttagtttgtgaataccaggtatccaggggtactaccaaatagggccctctttaaacaaaattttcagcttcaaaagttttcattccttgaaggtggtgtgaattctgactcaagattatggttattaatacttaagcaaaagtactttcccccctccatctagggctgagaccaacaaagacaaatatttttattctcttcttgtgtgaaaaatattgctcatcttggttggctttctcactgaatacgcatctcttagaggacaatgagcttatgctgtggtatcccatccgacttcctatcactgcactggacctggaaattctctcttttaacctttatagtggtttaaactaaagctaaacgtacccgaggattagcaaatgctctttcagccttctccaacctgtctggaattgtgctctcgttttgctttttacctctaagaatttctgtaaatttcttgttaattctaatatgcattattttcaaagataaattttaaaatagcttactctttatttgtagagaaatgaacaggactgatgttcagactattagccaacaaacaggtaaacattggatttgcaaataccattgaaaattgaatattcagttttgataatggggggagtaaatgggcattcttatacactgcaagattagtgtaagttggcacttattttatggaaggcaatttggcaacatgtatcaataatcttaaaatgttacaaactctttaatgcagaaattattttaaaaataattcctaaaggtatgattataaatatgcacaaaatcatataaaaaatggtcattgaggattttgctgtttcaataagctgtaaataacttaaatgtcccatacaatagatttggctgaatatattatggcatatatatatgcaaaatacattatgacatacatacatatgccaaaaattcatatatattgtcaatggaaaatatttaaatttttaaaaatataatcccattttctataaaattgcagatttcttaaaatattttgatcatatttattttttaaatttctagaaaaacttatattttaccataccaaacaaaaagctcttctaaaaatagtaatcaaaatggccaacccagaaataaacctaaatacttacagccaactgatcttcaacaaagcaaacaaaaacataaagtggggaaaggacaccctatgcaacaaatggtgctgggataattggcaagccacatgaaggtgaatgaaactggatcctcatctctcaccttaaacaaaaatcaacccatgatggatcaaggacttcaatctcagacctgaaaatataaaaattctagaagataacattggaaaaactcttctagacatcagcctaggcaaggatttcatgaccaagaacccaaaagcaaatgcaataaaaacaaagattaaacagctgggacttaattaaactaaagagcttttgcatggcaaaaggaacagtcagcagagtaaacagataacccatagagtgggagaaaatctttacaatctatatgtctaacaaaggactgatatccagaatctacaatgaactcaaacaaattagcaagaaaaatacaaacaattccatcaaaaactgggataagaacatgaatagaaaattatcaaaagaagatataaaaattgccaacaaacatataaaaaatgctcaacatcactaatgatcaggataattcaaatcaaaaccacaatgcaataccaccttactcttgcaagaatggccataataaaaaaataatagatgttggcttggatgtggtaaacagggagtgcttctacactgctggtgggaatgtaaactagcacaaccactgtggaaaacggtgtggagaattccttaaagaactaaaagtagaactactatttgatccagcaatcccactactgggtatgcacccagaggaaaataagtcattatatgaaaaaaatacttgcacaactatgtttatagcagtacagttctcaattgcaaaaacgtggaaccaacccaaatgctcatccatcaatgagtggataaagaaactgtgatatatatatatatatatatatatatatgatagagtactactcagctgtaaaaaggaatatgacctggatgagattggagactattattctaagtgaagtatctcaggaatggaaaatcaagcatcatatgttttcacttataaatgagagctaagctgtgagaatgcaaaggcataagaatgacacaataaactttggggacacagggggaaaaggtgggaaggggatgacgaataaaagactacaagtgtgtgcagcgtatagctcttgggtgatgggtgcaacagaatctcacaaatcaccactaaagcatttaatcatgtcatcaaacaccacctgttccccaataacctatggaaataaacattttttaaaaaaagaaactatcatcagcgtgaagagacaacctatagaatgggagaaagtttttgcaatctatgcatctgacaaagccctaatatccagaatctacaaggaacttaaacaaatttacaagaaaaaaacaaacaaccccattaaaatgtgggcaaaagaacaagaacagacatttctcaacagaagacattcgtgtggtcaataaacatatgaaaaaagctcataatcactgatcattagagaaatgcaaatcaaaacagcaatgagataccatctcatgccattcagaatggtgattattaaaaagtcaagaaacaacagataatagcagggcgttagaaaaataggaacagcttttacactattggtggacatgtaaattagttcaaccactgaggaagacactgtagcgattcctcgaagacctagaaccagaaatactattcgacccagcaatcccattactgggtatatacccataggaatataaatcattctattataaagatacatgcaagtgttatgttcattgcagcactagtcacaatagcaaagatatggaatcaacccaaaagcccatcaatgatagactggataaggagaaagtggtacatatataccatggaatactacacagccataaaaaagaatgagatgtgtcttttacagggacaatggatggagctgcaagccattatcctcagcaaaataatgggaaagaaaaaacaaacaccccatgtcctaatttataagtgggagctgaacaacgagaacacatggacacaggaggggaaaacacacacagtgggggcagtctgaggagggagcagggggagggagagcatcaggataaatagttaatgcatgctggccttaatacctaggtgatgggtttctacaggcacagcaaatcaccatggcacacgtttacctatgtaacaaacctgtacatcctgcatatgtatcccagaactaaactaaactaaactaaactaaaataaagggccctaggggaaaaaagaaaatgtcaacaatagatatgactagccaaatatttttaacatgtactaccctccccgcaaaacagctgcattgatcaaattaaacttaaaagcataagaacaaaattcacaagatcaataatcaaaggctaatattttaggcatataaagaactcacataaattaatttgtaaaatactcataccatcacaagagataaacaaagagataaaaatattgtagagagaaatagtttgtaaatcattagtctcaaaaaagtgtaaaatattgtatactatacgggttttgatttcttaattaactaactcttttttttcaacttttattttagattcaggggctacatctgcagatttgtggtttgggatatgattgatcccaacacccaggtactgagcatagtacccaatagttggtttttcaacccacagtcctcttctttccttttccatttagtagtccccagtggctattgttgtcatctttatgttcatgagtactcattgtttagcttccattgataagtgagaacatgcagtatttgactttctgttcctgtgttaattaacttaggataatgacctccagctgcatccatgttgctactaagaacatgatttcattcttttttatggctaaatagcattatattatatatatatatatacacacatacacatacacatacacacacacatatatatcacactttctctatccaatccattgttgatgcgcacctaggttgattccatatctttgctattgtgaatagtgctgcaatgaacatacaagatcacgtgtctttttggtagaactttattttctttcccagtaatgggattgctgggtcaaatggtagttcttttttaaattctttgagaaatctccacactgccttccacagtaggtgaactaatttacattcccaccaagtataagtatacactgtatacattcccacttacaaatatacactgtataagtattccctgttttctgtggcctcaccagcatccattgttttttgatgtttaatcatagccatcctgactggcatgagatggtaactcattgtcgtttagagttgcatttctatgataactagtgatgttgagcatcttttcatatgtttcttggccacttgtatgtcttcttttgagaagtgtatgctcacgacttttcccatttttaatggagttattttttgcttgttcaattaagttccctatagattctggctataagacatttgttgggtgcattgcaaatatgagaagacctctgaagtgatggctagaagaagggtaagaaggtatgcatatagcgtgaactgagaaaatttcagaatggctgaaaggtagaatacgggaaggtagagaatgagctacacagaagagatgagggccaggttacatagatccgtataaactctactgactactaaatgcattctaagaatagttataagtcttcaaggggtatttaagaaaagaagtcatctactcacaaactatagctgtggtttcttctggattactggttaatcaagctggctgaaggcagagttctgccctcctatgcacttccacttcctcaaagctataatctctgtctcagcacctagatctcctcaacttctgggccaatcaaaatcacagcaatgattcgagcaatatttcttgttctcctcttattattttgtggtccacacagccacaataggcctagtgcactgccataagcaaaaatcctaaatttgtgttcctaaatatggtcaccttatcaaagaagcaactgaatattttacattattttaaaatcataaatgttattccaaatttaattaacatacaacagagttggcttccatttgaaaacaagtccattagaatataagtataaattgttgctatgttttaatgtattaaaattattaaacataattccagctagtcatcactgtttgaaactttaggaagtgtatgctaaaagtcttattaacaaagggccttgaaaacataatgactatcattttggatataagtaacacagaaaaatgacagtaaatgcccataatatatattttctgagttttcacattttatagattgggcagacacaatattcagtaatgtttagcaaaggctgtagttaatattaactttatttttatgttacctatatgcaatatatttcacagacaaaaagtctattaaaagtagcatgctaaaagcaaaaatacaaatataattatgttaattttaggatgataaaatatatctaaaacatcattctaacggaagtgtcttggaaacattcattaatctgactgcaatttttaaaagtctagaacaagtaattaaaagcaagaagtatttcatcccatctatgccactgcaaaaatgtgaggagtaaatacaaattttaagtgattggtttacatgttgtttataaaacactatctgattgcctgacagataattccccaacatgtgatttccaggtattgcatcatagacaaggtcctggtattttcctcaaaaatcatcacttttactactactctctgaaatcccaggttgagaaaagagagaaggtattgtttacaattggtaaagcaagagggtggcactaaagaacaatccattccaacctctgaactttggagagtttgggagtaaaataatgctgatacatctacatgtgaatgctataaacagcaggtggggagtaggcaaaggcacacagggttgaattctttgtctggagtacaaagactttgggaaaagatactgagtctgaaagtctgcaagtagaatcccagatggctggcaggccaaaattattcctctactacccacaagagcccagaataattaaaaccaacgccaatgacacgaaatgcaaactgtaagcaatccaaagtacatataaaaaggaaaaacagaaaggaccaactgttcagacaaaaaaaaaaaaatgtaataggtgtgaaagtacaagtctaacacttttatctgaagaacaaagaagtgtactgatttattttctttttccttcagcctactatgttcttcttccttttctccctgattcagaaaaacaaaatgcttaaacaagactggttttactcctggcttttgaaggtagaaacgtactttctagcaacatgttctgataacttctttctcaaaacattttggatcccccactgagtttgttgtgaaaaaatttgacctgcccaagctactgttaccgggggtccttgctcccaaagctcccaagatggtggtgggcagcttccaaaatagcggcaggccacttccaagatggtggcaagcctcgtgttctctgacctggggttctaggccttatggattacaaggaatggaatcttgggccacgcgatgagtgttatagctctatcagaagccgtgggtcacggaagagaaccgtgggacccagtgactagtgttcagctcaattaggatgaaccaggcacttagccaggcaggaaaaatgacaagcctttagcctgattgggagcagcaacgggcaccttgctggatcaggagcacagcggacaccctgccggatccaagggatggaagtcagcggcaggtctgcgaggcggcaaagaacagtggtggacggcgagccaaagctcagctccagccgtaacaaacacggaccagaagagtgcagctgcaagatttaacagagtgaaaacagagttcccatacaaagggagaggacccaaagggggttgcagttgctgggctcaaatgcctgggtttctatcccgatctttgtccttcccgctgtgctctcaggcaacagatgattggctatttcttcacctcctgttgttgcctaattagcattttaatgagctctccttactatctgattggtcgggtgtgagctaagttgcaagctccatgtttaaaggtggaagtggtcaccatcccagctaggcttagggattcttagttggcctaggaaatccagctagtcccatctctcactactacaaccataaaatagattgggtaacactgatgcttaaatctgccctcatcttctcacttttgtcacttcgtacagtaacacttaatataaatatttaaatacaaagttaggaaatataggcagcagctgctaaaacattttagatatttccttatattcctgaatgaagaatttagaaattgtctgatttgactctttctcctcacactaaggaaaaatgagagagagaagggaaatgacttgttctaagttacccatctggcaaatagcccaaccaagattcccaagtctgtttctcctaagatgacattatccacttagattcttcaaagaatgaaataatattttttatttattatttttaaaagatacaagggtcttcattagctaaacattcattttacaatacaccacagtcactgagctgtataaggaaggaaaagtcgtcatcatgtgaaaacattcactaatgaactagtcacatataaaattagtacgtaaacactccttgccttataacataaagacctagccccatctattagacttggactggttatctgatgatgcaattcaattgtagagtagatagcaaatactgttaaagatgcaggattacactaacagtgatagcagaactctgagtcataaccaatgccattgacaaaaaacgatgtagcagagaaaaccagataacttgagaaaactaactcagaagcttcaaatgaaaaatgttttaatgtaaagtgtataagttaggcctgtggaaagcttgattatctttcaaattcttttctagaacaaaactccttaatattcttattgaaattcaaacatgaaataaaggatgacatattgtgaaccatactaaaaacatttaattagaaaaaaaacacacaaaactcacttgattcattatatagtcatttaaaaaattagtgcctaattgcaatcataaatctatgtttttctcaatataaataagctatactattttacatgtttaatttcatttttaagttaaaaataaaatactttttaaaatctccttaatagttctccactcagctaactcatcagattaatctatgctctccaatctctctgaccaccagtataccactttctactttctgccttctactcatagcaactgagatacttactttctggtaattttaattctctttgttctcaaccttcttttcccagttgtgcttatcacattaattacatattttaataagctatgtacaattgaagaattctgtgtatataatttagttcctaagaaaacaaagtttagtaatctgaaagaccctatggaatctgcattctagttaatcttcaagtttctaaattacttctacattttaagtaaataaaaactataagtcacagctgaagcattagaagtgtagttaatgcaaagaaaaaaattatgaaatttaaactatgaatctatactcaagggaaagtacctccatcaaaaggtttataacaatggaagtttttcaagtgagagatggcacagatgatattaaaaaaaagttgacacccatgtattgaatactatattactgagaaattatttaatgattagccggcatcataagtttgacaggaaaagatagtgtgatttcttgatgcggaaaattttctgagaaacaagtctacaatgtagataaatttataacctaacttataagaagttaactttaaaacttatgccataaaaaggtagagaatatggtacttagatacaaaaagaaattacagtagatgcttacatctttgctgttaaaaatttcaaataactaaatttgtgttatgacaaattaacaaattctaaatattttgaaaatactagttgatttctagtcaagatggcaaagtttggactttgaagtaaactaaattttttaaattcataccaacaatagattttttttaattaaaaaaaaacttaaaatgtttagctaagctcaaaaacaaaataaacagcttggaagaccacaaacgggaagaaacacaaagtgctaagtgaagttaaagtcacaggcctgcttaccaacaagtctataagcagataataaggctttagagtcaacttctgaggctaaatgtcaggccattggcgggtggacaacctagaaaaatcctaatctaacttttaactcaatcaacccatcagctagttcactgattagacagacatacaccgaatattaatgcagtccaggtaccattctagactaaaggccttgacaaggtatgcagacacctacctaaaaccaacagacaatatcagctgaggagagagacagcgagagagagagagagagagagtgagagagagagagagagacataaaatacagcaaaacaaaaaacccaagagaaaaaatttttctctagaaatgagcttgcaaaccaaacttctataacacagggaaactaatactcagaaagatagctacaaatataaaagctgaaacatatattaactccagataaaatcagtgccacagaagggactgaaaatgtattatttatgactatcaaagagaaatcagaggaatgacattcataaaaatgaccacgaagttatggaagaaaaaaaaagtaaaaataaaatgaataaaagagaaagaaagtttttagaaatattaggaaaagtataataattatattaaaaaatatagcaggggcagaacttctaggttaattaagttaggtccactgaaaatatgctccttcaaaaaggcaaaaagatcttgagaaataaccaaagctttgtgacaaggatcttttcttccctagtaaaatggctggatgtgagtaaaaacagtgagtgtcctagcattttaatttgccttattctcattgcccctctctagctccacagtcttgaaaatcagcagtttggcaatcatggtagctatgaaaaccagcagcctaccagccactggatcaggcatatatgtttggagaccctcaaaaatccgcatccccacaaaattggcaatatttcacctgcctcccagctccctgaggagtcccatttaccaaccttatcattatttgggaaatttacaaatatgtgcaaattaaacaatacactcctaaataattagtggggaaaaatcaaagtaatgaaagaggggtatcatcactgatcttacaaaagtttttaaaaagatctcagagaaatactatgaatctgccagcaaattaggaaatcaagatgaaatggacaaatttttaaaaagacataaacgaccaaaactggcataagaagaaatagaaagtggaacagacctataccaagtaaagaaattgaattagtagttaaacatccttctatatagaaaagaccaggtccagatgactccactgttaatttctaccaaacatttaaagtagagttaataccagttcttgataaatatgtccaaaaaaatagaagtggtgcgagaacacttcccaaatctctctaagaggccagtattaccctgatactgaaaccagacagagatatcacaagataagaaaagtacagaccaataacccttataactatagacacaaaaatcctcaagaaaatattcacaaagcaaatctaccaaaacctaaaaataattttacaccatgaacaactagaatttatcccacatatagagttgacttaatacacaaaaatccattaacataacgtatcatattaatagaataaaaaacaaaacacatgattatcctaatagatgcacaaaaagcatttgaaaaaatcaaacacaatttcataataaaaaacacccaagaaactaggaatagaaaagaacttctgcaatctgatagagggtatctgtggaaaatccacacctaacataatacttatggtgaaaaaccaaatgctttcctcgtaaggtcaggaacaggacaagtatgtcctttcttgttagttctatttaacattgtactagacgtcctggacggggtgattaagaaagaaaaataagtaagaggcatccagattagaaagaaggaagtaaaactgtctatatttgcagattacataatattgtatatagaaaacactaaggtatccacaaaaaaaacctatttgaactaataaatgagtttagcaaggttgtagtacacaatatcaatatagaaaattgatattttttggatctgtgttcctgcccaaatctcatgttgaagtataatccccaatgctggaggtggtgcctggtgagaactgattggatcacgggggcagtttctaatagtttagcaccatccccctctccttggtactacatagtgattgagttctcatgagatctggtcgtataaaaagtgtgtggcattccccctccctcgctccttctccagccacatgtaaagcagtcctgctttccctttgccttctaccataattgtaagtttcctgaggcctattcagaagcagaagccactatgcttcctgtagagcctgcagaactgtaaaccaattaaacctcctttctttataaattacccagtctcaggtgtttctttatagcagtgcaagaactaacacagaaaattgtcactgaggagtggagcattgctgcaaagatacctgaaaatgtgaaagcagctttggaattgggtaatgggcagaggttgaaagagtatggaggcctcagaagaagacaggaagatgagggaaaatttagaatttcccagaaattgttaaatgtttgtgaccaaaatgctgacagtgatatggacggtgaaggccaggctgaggaggtttcaaatggaaatggggaacttattgggaactggagtaaaggtcactttgttatgctttagcaaagagggtggctgtattgtgggtttgctctagggatctgtgggactttgaacttgagagtgatgatttacagtacctggtggaagaaagttctaaggattgaagcactgaagatgtgacttggctgcttctaaaagcctatctcatatgagcaaagagaagtagagaaaagaaatgacctgaaattggaacttatatgtaaaagagaagtagagcatataagtgtggaaaatctgcagcccagccatgtggtagaaatgaaaggcccatttttcaggggaagaattcaagcaggctgcacaaatttgcataagtaaagaggaggcaagtactaataaccaagacaatgaggagaagtcttctaagacattttaggaagcttcatggcaacctctcctcatcacaagcccagatgcctgtaaggactaaatggtttcctgggccaggaccagggcccactgtcctgagtagcctcaggacactgctccttgcatccctgctactccagcaccagttgtggctcaaaggggccaagatatagcttgggccactgcttcagagcgtgcaagtggtaagctttggcagtttccatgtggtaataagcctgaagatgtgcagaatgcaagagttgaggcttaggagcctctgcctagatctcagaggccatatggaaacacctggatgtccaagcagaagtctgccgcaggagtggagccctcatgaagaacctctactagagcactgcagaggggaaatggggggttgaagcccctacatctagtccccacctaaggcactgcttagtggagctatgagaagagggccatcatcctccagtccccagaatggtagattcaccagtagcttgcatcctcagcctggaaaagctgcaggcattcaacagcccatgagagcagctgtgggggctgaaccctgggaagccacaggggtgaagcggcccatggtcttcagagcccaccccttgcaccggtgtgccctggatgtgagacatggagtcaaaggagattattttggagctttaagatttaatgactgccttgctgggtttcagacttgtatgggacccgtagtccctttcttctgaccaatttttccccttaggaatctgagtatttacccaatgtttgtacccccattgtatcttggaagtaactaacatgtttttgatattacaggctcataggtgaaagggaagagccttgtctcagatgaggctttggcctttggacttttgagtttatgatgaaacaagttaagactttgggatactgttgggaaggtgtgattctattttacaatgtgagaaggagatgatatttgggaggggccagaggtggaatgatatggtttgaatatgtgtccctacttaaatctgatgttgaaatgtaatccccaatgctggaggttgggcctagtggaaactgattggatcaagggggtggtttctaatagtttagcaccatgcccccttggtactgtacagtgagtgcattctcatgagatacggttgtttaaaaagtgtgtggcatctccccataactctctcttctgcttcagccatgtaagacgtgcctacgtccccttcaccttctgccatgattaagttttctgaggcctccccagaagcagcagccactatgcttcctgtacagcctgcagaactgtgagccaattaaatcttttctctttataaattatccagtctcagttattcctttacagcagtgaaaaaccaactaatacaaaaattctattgtaattctggcaataaacaatccaaaaataaaattaacaaaacaattcttctctcaatagcaccacaaaaaagaaaatgtaccaagaaatcatgaatatttatgtatctaacagcatagtctctggatataattataaagataaattgacaaaattgtagtcattgtactgattttagcacaagtctatctatcagaaacagatcactcaaggggataaaatattctatattaaaaatatgaaataaaacagaattaataactttggtaaagcatgtatgtgtaaaaatactaaaacaacattacctgcatttatgaactagaaagaatacattattttcaagttgctactgacccttgtgtgtacacaaacacaaacgcccaatatgaacatatgtaccagtgatataaagaatatacattctttatggcatacattgaactttttttaaaggaacataaaaatcctcaataaatttaaaagaaacagtatctgctaaaatcttcattcttatccatactgcaatttaatttagaaatcagtaataaaaagttaagttttgaaaatgataatgtgccctcctgagtaattcatagtttaaaaatacatcacaatgtaagttataaaatatttaaaactgaggtcctccctcttacaattaaaataacctggacataaacaacaaaaatagtcagtctctggaaggtagacagaagcctgcttaactaggaacctcaggacctgaggaacaaacaacactacagtgaattccctgggttttcaccttgcctcccatatatcccagaagaggttatggtgaaaccagtgacctcaaactgcctgaaggcataggcatgaaagatcccaagaaaagcctgtcccctctaacccagtggtgtcaaatcttttggcttccctggatcacattggaagaaaaataattgtcttgggccacacataaaatatactaacactaatgatagttgattagctaaaaaaaaatgcaaaaaacttacaacattttaagaaagtctacaaatttgttttgggccccattcaaagctgtcctgggccgcatgcagcccataggctgcaggttggacaacttgatctaaccaaaggactaggaaaagggggccctagcagaacagaaagtcctttagacaatatttaacctactccagtcagtgccaaaggaaaaactgctcttcccttaccctggtgttagtgaggccaagcaggagctcaacctcttgtctcaccaaggaacaataaagcaaagtaagttgaccttgcactttcacaaccaaggtggtgccagtagggctgaatgggtagggggactgaatggtgggtagctgacttccacccttaacaggcagcaaaggtagtagtgcaagacagtgctatttgcattccacttttcctgtcagggaggtccagagtggaccttctgctctcacacagcagcaatgagccagagcaaggtggtgtaagttgacactctgcttttgcaggtatagaagctctgctttttccttcctcaactgtgtcactaaagtgacttgagaaactgcagagggtgacgatctttcagaaataatgctgactttaacttctttcctccctaccctctgcaaaccagtgagaagcacctagggtagaacagtaagtaggcctcattcaaagagatacacatttatcaccataccatcctccctggtgtagctctgatgccattttaactgaaaaaagacaaacgtaggtagagaacttaacagcttttgaaacacagcttttgcctatatgactattgttttaatttagaaaaactcagcttatggagcaaattgaggtagatcccttcacttatgaaaatgataaattaattcagaattggggccatttttgccttgccatctatagccctacacacatgtggatagaaaagctttgggaattcctattctccttgggtgggagcttaaaatttattttcttaaaaaatcactacaagagtgacttagtggagtttcaaatgctgctgttaagtggaaaccattatcttaaggaaattaaagctgcaacagaaaaccaaataccacatgtcctcacttataagagggagctaaacactgagcactcgtggacataaagatggaaacaacagacactgtggactactgggggggatggagggagatggggaagggttgaaaaactagctgttgggtacaattcttagtacctgggtgacgggatcatttataccccaaaccttagcatcatgcaatatacccaggtagcaaacctgtgcgtgtacccccaaaatctaaaataaaagttgaaaaataaaaacaaaatgctgctgttaataagacatgccattacaccacgggttaaagggactttagtgagacagcctagaaaccaagtaccctttataccattgtttcttaaggaaaataacaatcaaagctccaagcaacccatttgcaagctgggaatacgattcatcctcatgttggggctgcttgctaatttttcttttattgcttcagtgcatccactgatgctgcttggttttatgctatactatttcttattctgtataaaattttaattaaagtctcaaatgcagtggtacatatttcaaattttaatgtctttgtcaataaaggtaaatttttttctatgcccatgtcccaattaagtctgtttcacaatcaagatcgagttccagaaactgagctgaaaatgtctgaatatcctaacctaagatttgaggtttcctttgtcaatcctaacctgatctgctatgctaaaacacaattaattacagtataagtggttgtaaagacaaaataaacttttaaattcaacttttaaataaatctttaaaatgaatacccaaactacaaactaacttcactgaaactttttaaaaattaaattaaattaaatcgggaggaacagattctcccaattagatctgttaccatattttatataggtcatacatcacatatactatcaataatattacaaactatataagaaatgtagctttgagataagatagttttaagtcaactgtctattcttcattagataattatacattgagaatctactatgtaagaactcactatgtctaagactaagtgcaaggcaaatttagtcattaatctttagaaaattccaatggagtacgtcttgtgggttccaagataggaggctatagacttagataattctgtgtacttgtccacaatcacacaggtaacgactggaagaggcaacttttaaacccaggtcattctaattccaagcccatgttttaatgatttatttcttttcttaacaactttatggtcatttgcatagtatataattaatccattgtgtttaattaaatgatttttagtgcatttacagagttgtgcagccctcaccataattaagttctagaacatttctttcaccacaaaaagatcccttgctctcatttcccattgccactcccaccattaacctactttctatggctacagattttccttttttggacatttcattataataaaatcactcaatatgtggacctttttatttggcttctttcacttaacatgtttttgagattcattcatgttgtggcatgtatcaatattacattattttttattgctgcatctctattagctttatactgcacaaataatcttataattgaagagaaataaaaatgtattaacattaggatctgagatcttcttacactagtgaaaaatccttattttgcacaacgtttctctccttccgcatcttcatcatctgagtctggggaccttttatcatttaatgtggctttccccagaacatttttacttgttgtctgcttcaaacctaggctgcacagcaccactggagtaatagagtatattttaaaaagtgctttgagcatgttacttttagattctcaatagctcccaagtgtctgtagaattaagttcaaattcattgagttggcatatccaggcttccagtcaagttcttttttcctttcctgtctaactttgcatccctcttccttcatgtggtcacatttctctgactgatgccctgcatgtttaactcatttccaagtgtgtgcttttccctgtgcctgttacccaaatggcaatccttcccctcttctcagcttctatcccaaatcctacctcctttaatgcttcattcttgtcttccccagccccatattctctctcccttcaactctttagcaatgactttctgtatcatatttttagccttaggcattcacagaaactgttcatgcgtgaaagtgtgagtgagactccttcaatctaggaaatatattttctggtgtgaactatttgagggcaggtttcatgtctgattccttcaatggggggtggggagtggagaggggttacttcccatatcaatattttgcaattagtagtactcaagaaaattcattgaatgaaaaatttgtattcctttacacaaccaggaaaatgaatgcatgaaatagtactgaccaatgaaagcagcatttttttccttttaactgtaaggaatgaggtgaacaaacataaacttcagctttactatcaacacttcaacaacaaaagagctaagaataattcccaagaaatgtgtgtccaacctcttagctataacattagacaaagtcttttttcaagggtgaaatgaaaaatgttcaacaccacaatggggctatctaagggcagctccatcactgccagatattccagtgccttagcaaagtaagagatgctcaggtccaatatccaatctagcagggctttcatttccttccaatcataaaacagagggctaccctggaatagaaaaacgacacaagaaagaacaatgacagatttctactccatggcaacatgccaaaggcttgtttaaacatggtcctggaagtcaggaaaagtgacattttgttattggtactttaacatataaaatatccttctagatttgtaatcaagattttatattttctcctaatcacattcttttttttttttttttttttggtacagactggccttgcaccaaattacagagaaacatactgaaaaatcagaaaatttttctaactttaaaatatcaagaaggtattatttgtgctctgatacgtttattaagccatggttagctgggtgcagtggctcatgcctctaatcccagcactttcggaggacaatgcgagcagatcacctgaggtcaggagttccagacagcctgaccaacatggcaaaaccccgtctctactaaaaatacaaaaattagccaggcatgatggcgggtacctgtaatcccagctacttgggaggcagaggcaggagaattgcttgaacccgggagggttgcagtgagctgagattgagccattgcactccagcctgggcatctcaagaaaaaaagaaaaaaaaagaaccatggtcactgcaacaccaagtttctcactaaggaagtctactccatctcctgacatctttgtttcttgtaatggcaacattctaccagtccaccaatcttatatctagatactaccttttctttcccttctctgaatcccctctctttcttcaatgcctttcctaccacatcctttccttcatagtttgttaaccattaattaatccctctactcatcaaaagtatctcctatgtgctgggtgatgtgctatatgtggacgactcaacagcgagcagaacagacagccgcagtccctggagcagagcttgcagcctaattcatctcacttaaattcttttctgtccaggtgcggttgctcatgcctgtaattccagcattctgggaggctgagtgcaagagttcgagaccagcctgggcaacatagcaagacctcgtctctacagataattaaaaattatataaaataaaattttatataattttatttatttataaaattatatataattttatttatttataaaattatatataattttatttatttataaaattatatataatgttataaattaaaaattatataaaataaaaaaattcttttcttgccttatctcctaactgcagtgtgtgcctggcactgctgtctgattcttctgctattaatagttaatattggccttatgatctttgtgattgccctgcctttgtgtctcttttcatgcggaaagtgccctaacacccatctacagaaattgtagtcctgaagaaagctcatttccctcaagagaccaccttccctaaacctttaataatctgcccttccagttgcaatcttgccttccttggagttcccatgacattctaatatcttagagttcataaaacatgaggtattttatagaagacttcattgagcctaaaaataccagataaaattgaatcatataatcatggagtacaacatattaaatttcataacattctccttctagtaactattcaatgctgaaatataatggttgaagatgttattccaggtcttttaaaaaataataaaaactagcacacttttaaaaattaagtatgcttttgtttatggtaacatgggatatagcctttgggtgtgagtcctgcacatttcagttagcccatctctaacctctgtgtgaccagaggaattcacttaagaaactgtcgcctaagtgaaaaataaatgtcttacaacactagcccatttaagcacctaattacaaggtcagtcaaaagtcaacttgttctataacagattgctttcatcagtggcttcttgtctacccagagcttcagttaggatgcctccactcttgggtcctgatatgcttggatgccatagccctaactttgtactaagtctcctaaaaatcttactgatgtagaatttggggtaatttggaaaaggacataagttatccttacataagccatttctccacagattacaaatgaaaagtagcatttttccattctttttctaaaaatacaatcattgaacactttctggttcttttaaaaattctttaaaatgaaatttcagggtaaaaagctatgttatctttaaagtattggctaaattgtgaggctgctccagcaagtctgtttcaaaacacacttcaacaaatgtggatatatgtaagttattcttttgtcatgctgtcaaaaaatttagtacttcttttaatatttgttaataataggaaatgtgcattgtgggcttttagtgagaaaagcttaaagactagttgtatttttctgtggcttaagtgtcaatctttgcccaatttcttcatttactatttaccttttccttttcaatttgtgagtccctttatatataaagatattaatactttattgaatattacaaagatttttttcaagtctgttataaggttttaagttgacttgtaagtttttgaggtttttacaattttttaagtagtaaaaatattcatttttttcatttttttctgaaattttgcctcttagatcttttgtaacatgattactaaaaatattatcaagtattttcctttagtaatttatccctctacatttaaaatttttattcatctgaagtttatttttgtgaaaggtagagagttgggatataattttatattttatacaaaaatcacactcagttatacaaaagccttttattaactttcctctttgactttaagtgccatctttaacaaagagtaggttatgatatgctcattcctggaccatcttttttttccccatttatctctttctctgttcttgaacttgtaccaagtgctactattttactgtgtgtgtatttgtgtgtgtatgtgtgtatggagataaatatgtagacagagagataatatgtttgacatctgagaaggaagaaggaaggctccagccatcattctgctatcttagctcaattcacatatttgtttttcaagaagaattttataatcaactcattggttcctggaaacccactaaggagattttgaaatggattgttattaaatatatagagttgtgagtatggaaacctttaaaatagtgtgcttgctctctgggactatatcattttgttaaattaaggcatttttgtgtcttttagtaatttttagaatatggtttcatatggctcttgcatatttcttatgaaatctattcctatttattttctttttaatgacttatgaatggaattttaattccattgtacattctaattggtgtttttttatataagcacttaagttttgtttttagccaacgaccatgctgaacattattttttgttttattaggttttctgatctattaatattttatatgcagagtgtccactattactctatttgaataaaggtaatgcttttctttccttccatcttttttttctgtttcttatattttggcatttgcttaagctgtcagaaaaaaatgttaaataatagcagaaattgtagattactgtaattttacttggtatgattactgttgctattttaaaaactcatttgattcatatattttcttgatgttgaataagttaaatggtttttctaggtccatttatgtgagtaaccacccttctttaatccctgtaattcgaagttgatatatgcagtagtattaagtaaatgaaagaagagtgacattataatagcataaactagtaataattgtatattagcatatagtcccaaattgcttccccatcaaagataaaactaaaatagtatgtatcagaagcttagttaaaaatctaaccagggtagatctttatgtactgatactgaaagatgtctgccaaatatttttgacttgacaaagcaacttgcagaatagctctatagtatctcatttctatgtaaaaacaatatatacatgcacacaccaatgtgtacacatatgttttacttcatatctagaaaggggcacatcaacagcatcataataatagagcctaacacaagggctgtgttttgaagggtgagagaggtttctttattatccataaatgtcaggttcctctctgtactgtcaagcattcacttcctaaaattcagccttaatccattagtgatacatgaaaactgatactgctatacagtattttggaaagtcttaaattacaacataaaccatacctgaaaactcaagttactctatatattactggcataatatccaggaaaagaaaatgctttcaaattttgccccttcaaatacatcaagacatgccatctactttaactgattgaatacccataaccacataaaaattgcatgggaagtacaatgtaaatgctattttccttatctacctgcttgtctctgagggctgtttaccattgggatccaacttattctgggaactgtgttacctcccttaaaatacatatttccattagtgatggagagtcctatattggtttacctcttctttgtcctctttcctaaagctagtcattttccttatctataagcttctcctttgccactgccttgtccatttgaagattctaaagtagaaaataccagttaggaaaaaaagcgaaagaattcttcataaatgtaatgataaattaatatgtatccagtgctaaaattatttcatcctatttttaccttagaactatttagcctaaataatagaactgaaaactgatacagatattgacttaagaattccttggtttatgaagatttatgacataaggcataatgactgcctagtctccattccagcagcaaattaattaattagtcagttaattaatgttgtaataactgtttgttgagaatacttttattaaggaagttaaaccatcacccacagtacacagacacgctatgaggatttttttttctgaaatgtctctccttctgtccttgaaaagatggtaaagcttaattctcacctaaaacgttaaagtccctagttgttttgaagtccaaagcaccatggtttctaaaacagatgggagctggcttgagacatgttcctcatcaaactttctttggggcaaccaaatacaatgctaagaacctggccacaataaaagcagctactgaaggagagcctgaatctggtcttttctaactcctcacacacctagggctagtctcagaataatcccagatattgtttgcttaagttaaaaactgaaacgtgcgtgtatgtatctgtgtgtgtgcgtgtgtgtgtagaaagagaaagaaaataacacacttttcaacaacttaccatttccatgatctaacctagagtaccctgtcacaaaaaaaaatgaaagaaaatacattttcatagaatcacaatatcatctaatttaattttacatatgcaaacaaaatgtacaaaagactattttatccatgaaaaatgtgtacagtaacatacatactttttatacactgagccctcagttagaaaatccaaatcaagtttaagtttagtgtttaattgtaaatgccaagctaatattgttatctattgtaattacttcaggaataaatttctattgtgatttgatgaaaacagtgtatccatcagccttgaaatcaagtgatccttgagtaaatttaaatatttgagagggtatccatattttagataagcacaaacaaacgcaaaccaaaaacacaaactacacctcccatatacgaccggaaatgtgaaataagatttattttactgcatctgtgcttgcaattaggaaagtctctgctttagtctatcttttcttggtggtacatagtttttcttaagatgtttaaggaaaaaaatcgagacattgaagagctcgttcatatttccccatgggaattttatcttcattgacagaaaccagtaactattttttaaaggattttttaagccgattaactaaataaaaaatatttacaaagagctgtgctcatactgcaccaaatatatgtcaacatttgtaacaaataatttaattttatagggagccataagcatataggtgtatactagttatgagaagtatgtatcttgcaaagatatgaaaaatctggaaaccattggtggaataataggaacaaaaagaatcccaacaacgtgtaaatcgaacagcaaggtgtaaatgaaagtgccaaccattcattttcagattctctgagacctaggttgctgaagatcgttgttggcagtaaaactgtctccttccaacgggtcgggtggagagcagcatgattggcagggcaaatagaagacaaaggagaaagccttcaatctgcagctgatgcacaggaagaacatggggagctgagcttacaatagagacaacattaccaagctaatggcacgggcaatcatggggccactacgcatcttgggtatcagcagggcatccattttcagctaagtgttagagtacctttttgctttctctcaccactgcaggggtaaaacaacttagtgcgtgaaacccactgactggtaataaattactatattggatactttttgttttctttcagcaatgactttactgtgtattcttgctatcactaccaattaaagtggagcctgctttagcgaactgtatctaactatatatcagccctgatgctccaattgctttggcaagtatcacagggtcaagaggctcctttgacctttatcatctaagtctttctgaccactcactatttgaagcaatctcagctgaacagatggacactttctgtgacattataaagcttagaatataaagataaacgaaattgtgtttcaggcttcaagctggtttatgcctgtaaaatattattagtgtgtttacaaaatctccagatttaaagcgtataatctgactctggctaatggacaaactgctcatttcttttttaattataggttttgtgttttaagtgtgaagaatagcagaattttgtaaagcagttctcagggttatccagttacatttttaatgcatatatcaataaaccgttataaaatgaagggtgtcatttactgtgcaatgaaccttttgcatgttggtttttaaaatgatgtactaagaaagatatgctaaacacagaaaaactaaaactgtaaatgttcgatgaagtaaaaattaagatttttatttgccttaagcatgatttttctcttaaactatatcattttaactgctaggagattctagtatttttgcatatctaaatataaaaggaaaatgattaagcatcagctttatattctttaacccatttgtgttagtatgtcatacatggttatttgaatattttgaaattgctagattaaccttaagtaggacatatatattttttgctagtctcctttaaataaagtgatcatataatttattgttcaaaccaggctactttttagagtgaaatggtgcattattaacaattacctttaaacaagaggcatgagccaaaactgtcccagggaacctggatgtatgatgaccctatcttacaggaataaggtgatgatgtggcttcttaaaaagcatcgatgtttctgtaacacttaaaatgtgactattgttctgtaaatcataaccatatctctgtatgtctattttttaatgactgcaaagaaattaattttgcagtcattttcttttacactctcagatagtttatttctacttctcaaaaaacttctgatgtatacaacaaaggaaaaacaaccaaagtcctaattataaaaatattgctggattgtttgaaatttttatttttatatctcgtgcttataaaacccccgtaactcatattctcttatcatatttcccaaataatctctcagcaatcaactaaatttctgtggtgcagattcagttgcaggtaagtgagaaataatacaaataatggatttagaggtaaacaaactgctcatcatttttgaaaaacgttgtaagaccaaggtaaaggagggagtgagggatagaaaaagaaaagaaataaggtaaacaaaattaccaaaggccagtagactgtttcaggtcaccttgtattgaggactggttaacaaacaagagacaaaagctagggaccaatgtattctccccaacaaaaagaaccacaaccacaagtgtgtctccagcttctggaaagggattgaaaccaagtgccagctttaaactttcatggttttataaataattctgagaaataaatgtacaacaaaatatcctctctaggaactgaaatactgaaatgatagaaaacgtcaaataaaagctctgggacagttaaaaaaaaatggcaaggaaagtaaggtatggccaaataggtgtaataaaaaggaagtctcataaccaaaaataaaaaagggaataattaagggtctttgttgataaattactgaagtcaaaatattcccccaaattgtagggtattgcctgtactagagacaatatacaaaggattatcctttcttggtacaatgcaaaggtaaggacactattagtcctatggcagagactccagtagaaagcttagtaagtctgaccagatctcaagaataaaatgtgaaaaatcagaattatttttgtgcacaaacagattagaaaatcatataactccatgtgaaaaatggaaaagatgtgttcaattgttatgaaatcacaatagtacagaacatgaaatactaactcagacaccaaattctgaattatagaagaaactaaaggtatttatatccattcataaatttttaaaaagtaagataagcaaaggacatttgaaagagattcattacttaaaaatagcctttcctatattatttttgcctttaataaacaatactaatactgtttacaaagaattcaataataaagataatcaaaagaaaattagatcatccataattataacacctaaggagatccttaacttcctgaagcaggaatctaaagagaaaccacacttttccacaaaatttcatataattttatatagagccctacaaattatctgtgcaatcattagtatttttttcctctctcatgctccctctcctcagtcatcggtatttttaccaaatgcttacagttctccaccttttcccagcatacggcttctgcttcattagctctgtctctgtgtaacaatcaagagcagagaccccttctgaccccaggttggtacattgagtgaataagaaataataaacttgagttgttttagccaatgagatttgggacattgtttgttactagaacataatatagcctattctgatctagatgttttccaaattgatatcaatatatacatggacagacaggtggaaacaagagaggcctggtgactgattcaatgtcatatagccactcatttaatcaatgcaactactgaaatgccaaagttgaaattaaaacccagattgactactcctagtccagtgctccttccactacatgaaatgtgatttctcatgcttacgtgcattatactttctctggaaactactagaagacacagaaacaaattccccctaacttccccacctctgacagatggcacgtctgtttgaatagacacgtcatgatccaattttggtctattctgcatcctataaaaattcaatgtcactagtagaataaaagttctcaatatcaaatccaaaaaattcattaataagccaaattttacgtagcaggaaagatacttgtctcatgtgttctttaaatagcaattatttccttccatttgttttcacctctttctctatatgtttttgtcaattaagataacaagtatgtgttactaaattactctgtactcaccctctggagatgaaaactaattaaaagagatgtggtatgtacatgtaattttacttactccaaacacctttgcttcccaaactatgacactgaaatcagcagtatcaagttgatgctttctaaacatcatactaacaagcttataattggccaagaggtcaggaaaggtataggtctgaaggaaaaacaacttagccagaactggctcaccattaagtagaccaaaggacaaattttttttaaaatagtgtttctcctcttttgagtgatttgtatgtgtattcacataacgaataaccaaccacaaacacttattttgggtatatatttgtgtggccaccagatatttcagtcaattcaattcaacacatacttattaaattgaaatcaatacccagagagtatgctcactaaaaaaaaagtatataaaatttatgaaatgtctcagaacatgagttctttcaaacaaccataccacaataacttctcacatgtctagcaactgattgacaagatcaagcttgtagactaccttaaaaaagtaagaagcagaagaaacaagacaaaaatctctgaaaacccaaaagagagcttacaaaccagggctcccaaattgagcaaaaccagttataattttcagcaaatagggagctttacaagaaaatcttttaatgacaataataaaatatagttctttccagtggaaagctaccacactcctcttcttgtggcctattatagtcaattataacacaatctaatcacagcactgccaattgcagaggtcaagaaacaatgacctgtaggccaaatcctgcctaccacttctctttgcaaagaaactattactggaacacagaaacactcatttactgatgcgttggctatggttggttttgcattaccaacgcagagttgagtaggtgtaccagagactgtatggcccacaaaaccaaaaaatatttgataactgatcctttagagaaaaacattgccaacccctggcttattctaaattaatgggaattttaattgtatgcaaaatattttttctgggcaaaaatgcaatataaatataaagaaagcaattttatgtgttaaatccccttaattcagttgttacactttaaaagaggaccctatcttaagtctgtattggttgtttttgttactcatgagattttccaccacaaatataaattgctcccaaaagtccaagtccaagaattcttacaactctatagcaaaaaaccctaataataaaaaaaccaagccaagggtttgaatagacatttctccaaaaaagatatacaaatggtcaagaaatatatgcaaaatgctcaatatcattaattatcaaagaaatgcaaatcaaaaccacaatgagataccacccaatacctttcaggatggctattattaaatgaaaacaaaaacaaaacaaacaaaagtcaggtgtttgtgaggatgtagagaaattggaatcctagcacactgtgggtagaaatgcaatggtgtagctgctatgaaaaacagcatggaggttcctcaaaaaattaaaaatagaactaccatatggtccagcaatcgacttctgggtatttatccaaaagaattaaaatcaggatcctgaagaagtattagcatgtctatgtttattgcagcatcacaataaccaagatgtggaaataatctaaaagttcattagcagatgaatggatagagaaattttgatatatacatacaatggaataacatttagcctttcaagaaaggaaatttctgcaatatgtgataacatgatgaaccttgcagacatatgctaagtgaaataagcagtcacagaaagacaaatattgcctgattacaccaatatgcaatatctgaaatagtcaaattcatagaatcgaagagtggaattgtgcttgctaggggcttaagttattaatcaatgggcataaagtttcagcccagtaaaattagtaagctatagagatctgctgtacaacactgtacctagagtcagcaataacgtactatacacttaaaaatttgttaagagggcagatgtcatgttaagtgttcttaccaaaataaaataagaagttgaagtccaggttcaaagacttcctcttattttcttcaggggtacaagtcatagttaaccttccactgtgtctcactttatattccatctccagtcatatcaacttctcattaacctcctacttcttccccatcttcatattctgggcttttggacctgctgttccttatggcaaaatcttattcatccatcaagatttagtcctaatatgacttcctgcataccacagacagggttagcctcaccatctaaagcggttcctcccactggcactttgggatataggtcaactagagcacatatgtcacaccatggtttttgccaacttgatgttaaaacaaacaacaaaacaaaacaaaacaaacaccagctaacaatttctttctcttgcttcaactaagcaatggactcctcttccagacacactctctcctctaattcagtttttttttttttttttttttttacatagcaaacaaaacgaccttttcaaaacataaatcaaatcatgttactccttttgagtaaaatcgtgaaaagactccctttaatacttggaagtcaagcttcttactttggattattacacccaacatattctgtccgtccctcacttttcaatattgactcttaatgctccctcccccatactcctcttgagtcacactggcctttttgacttcattgtctacatcaacctcattcctactttaggccttctgttgtagctgtttgctttccttagaatattctcccctctgaaaggcgggagaatctctggttctttcttgcaattcaaacagtataaatcctacctccttctctgatgttctctgaccacccaggctatcgtaaacccctaagactgtctatcaaactgcccaacattaattccctgcagagcctttatcattatctgacagtcttgttttgttttgtttacgatgtatccactctcactagaaatgtaagtgccatgggcaccatgatcttgtatcaagaagagtgcctggtacatagtagatgttcaatgaatacttgctgaatgaataaagtattctgttttgcattccatgctacaaaacttacataacatgcagacacagtaattctttgttttcaaggagctttaggcctaactgagaaaataagacaaataaatagtggcaaaataattaggcaatctatagtttttgtttgtttgtttgtttgtttgttttgagacagaatcttgctctattgctcaggctggagtgcagtggcgagatctcagctcactgcaacgcctgcctcccaggttcaagcaattctcctgtctcagcctcccgagtagctgggactaaaggtgcgcgacaccatgccggctaattttttgtatttttagtagagatggtgtttcaccatgttggtcaggctggtctcaaactccagacctcaggtgatctgcccacctctgcctcccaaaatgctgggattgcaggagtgagccactgcgcccagtccatagttaatttataaattgtttaatcacttctcggccttctggctaagatcaaatgtagcatctgtttttatcagtttaatataaattgtttaactagcatgttcatggtaaattgtacatgcacatactgtagtctaggtaggatatgactaggtaaagagaacatctctggtacatgagattgggcaggaagaaatgtggagaatagagtcaccagaaccacccatgtggaagagcactagtgtacgagaaattatggaagagccttgtcatgggaatctaaatggggtcttcagagaaaaggaagaagaacaaatcctatgaagctcagtttctcctggggctgctaatccagtatgccaccctaccttcccacaatgagctacctaaaagcatttaatgtcatacatgttgaaacgtaatcagccctctcttctcctctgatgagagggtgagttaagcaattttcaaatgatgtacaaaagcaggaagcaatgtttgctacttgggggatacagaattgtactagtctttgcatctgggaaatgaaacataaatcagccctcttcatatttattacacttaaatttctgaaagttattacaaacctgttgattagattgttgctggcttcaggggttttgtattgaggggagggcttagtaaagtaattatttcagggaagtagaggctcctgatatacaacgcaatcctcaggctatttttgagtgcttattttagacaactttgttattagaaaaagaagtctaagatttaagggcaagtaaatggggtaataatatgcactgtgttggtataataagccattttaaccacattgcctcttaatcttcctttctgagtctttatcagctctgttctatgcccaccttacccaaagtgaatcatttctccctaatatgctgggcatactaagttttatcaccactatttaatacactttttcttataaacttttgtaattgagactggtgtctaaatatcagtggaggctgctgctgtgtttcaacagcctctttgctattattgactattttttgctaggtcactatcctctgtacaaccaagtcacatgtaaacctgatttggacttaaagcaattgggtggcgaaataaatacacttttttttctgtcagtcatttatatttttttctcttacaattcaaaaaaggaagcattctttactttcttaccatctattcttcatgttttagacttcagtagttttcagttcatgagtttattccacaaatatttctgaatgccttccacgtgccagatatgccaggtgatgagaatttcatgataaagttataaaataggtttatcataactgtaactgtcccctttgaacttacactggagtagagggtagagaagatacaaaatgaaataaaaaggatgctgagaaagagagtaacagaaagtgggctgctacctgcataatggtaaactgacatcgaagttagacttgaaggtatagaattgaggtgaaaatattctggcaaaagactaacatcagtggaaatatgagtttctttaatgaggccaaatagttggggattaaatatctgggtcatgggactgaacctgtagttgacgtttttcatcttttttaatgtatgatgtttgatttgggtttttatcacaagaatgaatgcaactcagattaataataatggaatgctcattcttagtttcttttctttctgtcatgcttgtggaagctgaaaataatatttcataaacagttatgtgagttcaatagactggaaattattatggctgaagaatatgtgtaaaccttacgggacatcccctgccccacatgataagtgtcaaaatcaaatttataactccaaagatactcttgctaagaaaataatagagttcctagtttaggagatataatatattttaaaataatagtactaaatagaaatttgaattttatgaacattctgaaatattaaagaggatatttcctaggttttgattatgcttaaatatacccagtctggaaatcaacacaaaattaccagtggatagtaaaaatcaattagagttctttcccaagtatcactcataaactactgacaaaacctgctctaattctcaagtgaagaaacttttaattataatatgatgtatgtgttcatgctgaatgaaattcagtatatcctgaaaacaagaatcaaaagcaaccatactaaatgatttatcaagaagacatcaggtaaccacaagagggctgcaaaagatttaagagatatgatgtatcattcatacataacgagactttcgtagattatattacttagtcccattatacttcatgatttgtctgtgaattaaatacccatttattataccctttatacagatagagaagtaagggcccatatccttagattttattaattagtgaaagataaacagattttgataattatttcctgttacaaaactgaagtctgataaaatataataactcaatgttttaaaatacaagaacttggtcctagaattaatggacgtagaacattagatgaaggcaaaaaaacatcaagttgtggccccatagctgggcctttgcggtaggtgcacaagaacagtgaagcaaaccatcatctgaggtactgtgtgttatatggacacttcctcaccatgcagctcattgaattttctgtaactaatctcagtagctatcttgattaagatagaaggtagaccatttaaatcagatgtatattgagggcataatttgtcatgattaattggattatcataaaaagtgaaaattttgacaaaacacactcagaactgttagttttctgcttctatcttactaattccatccttgttaacaccagaaatttaattactaaaaatatgcctcaagatattttaagctgatcgttagcatacataaatgttaaagtcataaaataaagatacgcttaagagatcttggccaggtgcagtggctcacgcctgtaatcccagcattttgggaggccgaggcaggtggatcacctgaggtcaggagttcaagacaagcttggccaaaatggtgaaaccccatcactactaaaaatacaaaaattagctgagcgtggtggtgcacacctgtaatcccaactacccaggagactgaggcaggagaatcgctggaacctgggacgcagaggctgcaatgagcaaggatcgcaccacttcactccagcctgggtgacagagcaagatgccatctcaaaaaaaaaaaaaaaaaaaaaaaaaaaaaagagatcttaaagacaatttgttaccatctatcaacctgactttataattgatctggtttaataaaagataggtccttggtaattaacaattttggactgacaatcatataataaaaactttgtgaaagttcaagattcaggtatcctcttagatttggggagatgtcaactgtcaaataattttctcatttgagcctcaagataatcacacatgaagagaaaggacccatactattctttccatattttgccatctgattacatgatgaatgtcatgctatggttgttgtaaaacagagattggcctgagagacaagaaaaaggaaaacaaaacatctgctaccagagaatcaatggagaaggccacgttttatataacgacaagagacctctagtgggagctcagaagaaagtaatgaaggtgagcaggactttgcattttgtaagtttttttttttgagatggagtcttgctctgtgggccaggctgtggcacaagcttggctcactgcaacttctgcctcccaggttcaagcaattctcctgcttcagcctcctgagtagctgggattacaggcatatgccaccacgcctgactaatttttgtatttttagtagagacggggtttcaccatgttggtcaggctggtcttgaactcctgaccttgtgatccacccacctcggcctcccaaagtgctgggattacaggcgtgagccatggtgcccagctttgtaagctttcttaatggctttctaaaagtcatcaggttttgggcaatatgcgaagacatagaacaactacaattttcagtcccatttgattgtgcatggagttaaatatgtgcataagaaagcccctgctgctcacagcagcttgttaggatcatttttatatctgacaggaataatcacacttgaaccaaaagattatgcaggatattttaatttaggattaaagctgtttgcagaattatataagctatatagtatgaaaaaaattacaaataaataaacgtcatttggagatgcagagaactggtggtgccttcagggcatcactattaaaacagaattcagaaaaatgggcaagaacgttagctggatgtatttttttaataagttcatgctcttagttccaataaataaagataaagtcttaatacattttgtttttaatagtatggggaaatattccatgaaaataaatgctttcttttttgagaattgcttcctgttagttttttgcatttgctactctcttagggccagtttcaacataagtcattggtacagaagtagtgctcctgttgggattgctttaaatgggtccacatggtactctcagtcaataagtggtattaccagctttcaacaagaaagattttattctcctccatttctttccagttataagcaactaatagtttgagttaacatttgaattctacaaacatcatttttttccagaaaataccatccagtgcattagtcattaaaaaaacagaatagaaacacattttaaagaggtaacatttataatcattttaatcagaaccaacaagtttgctcaataacagagcatccaaatccactggagtgaatttggaccccaataaataataacctctttaagtaggtgggatagggtcatcttttgggtactacaagaagcaggatcttaacaaattgtgagaggctacatgtttttaaaaaggaaaaacaggcctcgcatggtggctcatgcctgtaatcccagcactttgggaggccaaggcgggcagatcacaaggtcaggagatcgagaccatcctggctaacacagtgaaaccccgtctctactaaaaatacaaaaaattagccggttgtggtggcatgcacttgtagtcccagctactcgggagggtgaggcaggagaatcacttgaacctgggaggcacagactgcagtgagccgagatcatgtcattgcactccagcctgggcaaaagagcgagactccatctcaaaaaaaaaaaaaaaaaaaaaaaaaagaaagaaggaaaaaagaaataaggaagaaaaaagtctaaataagctaaatagttttggatgcataatatatgagcatgattacagaattcataggttctaaaatatctataaaattattaatgtaaatgaaggcaaatgtaaagatgtgctttaataaattatgctaacacagtccctagatcaagctaaacacaaaattaaaatgcctaaaatgttaaacttttctccacgttctatgttagaacttcccccttcaaattaactgataactacaaatggagtatttaatccaagaagaaagttataatcttagatttctatgtctcttatagggttaatgaaatattgtagggggagagaaactgaaataaatctaaagctaagtttagtactaaataaatgatataaatatttattcactgaaaaatcttactttagaaataatggaagagagaacattttttgaaaccagctaaacccaaagcagaaccaaccttttctctggtagaaatcacggttgcctatcagcaattataaaaacaataacgccgaccttgaatgagccttaaaggtcttcgctcacaattatattatcagctttatgaattttcagttgctatctcagccataaattcaataaatgcagagttgattagtaataggaagatagctattttaacagctgacttcattgaaaaaggcatttgagaaagtacacattatactggcattttccatgttaaaaaatgcagctttttcaaatcctgctcagtacactttagatgaggacttatgtcctctcaggaacagcaataaaaactaaaaatcaaactcagccaaaactagaaatgatttaaataaattatatctgtagtcctgggaaagcaatagtcagctaaaaggtttttatacctggaaatttttttacatttcaagactttaccttggagcattttttttcctcatcttaaatatataacttcacttcctctctgtatcttgaacataacagctcgcaatggtagagaaacccaatcaaaaaatagccctgtgtgtagttattgtaattaacagattcaatatctattacagccagtcaggtatcatagcaaccttgtagtgctgaaaattgcttagaaaattcttcaaaaccagcaagactctgctttaggaaaacaacactggggacatgactggctgtcaacatctgtgggtgttgctatgggcacagccacaaagaactctgccatctatacaaaaaggtatacacacagagaagaggggagggacacggaagataaactgataaggaaaatcaaaaagaagaaataattgggctggcaatatacaataggcacacaattttgtgtccatgttttacacaaattcttttctattgaagctagagaatccaaattaaacttaactgtaattgtgactaaacatgagccagggtttggaaataatatctgaaaactctccatttgtaccctttatcacaagtcttaatttgaaacttaaagtgaattacagttaaaataatatttaaacttccacttataaacccttaatagtcgtttataaatctacagaagagaaaagaacaggttactatgaacaagaacccaatattgatttttcagcagtgcagtaaggcatctccattctatttggctgctgtcaaagccactctttaacagctggagtcaaattgcactatttacagcaagagcccttgtcaagtggaccataagtatcctaacaatacactattcaaatggcactttgccacacaaattgctgacttgatgaataacctatgtcaatgactaaggccaatataaaagtttcatttttatgagaggttttacattcacacattaagtaagctttctttgaagaactattaggctatatatttcaggcctgtggacgctgaaaataattaaaatctgtttaaatacatcgagggaacttgacaacattaatatggatccggtgttaactacatttgtcacacgagtcagaacagagtccttccgttgctggcactccccaccggcacgtgctgcacaaagccagacttaagctagcctagcaccatgaaataggagcattctccttttgtgcctctgatttacatggccaacgaatgtttagatacaagccaggctttgaagtcctgtgaggaaattcggagttgcttctgggtgcgaggtggacagctggagtcatttaatggtgcattttctacttttcatagtcactcagaccttctaaattagttttgaaacgaagctgtgacatgttcctcatagttttcttcatgattgaggtaatattttaaaaacaaaaaaagtttaaactcatgccacaaaatgagaaaagggaaattcttcataaggcagttataaaaaaaaaaaaggattagatattacagaaatttttatttaacttacattacataaaattatctataaaactcttatggtaaacagttatacactgtcaaaaacttgcatcactttatgtgttcaaaaagcaaatgactttgtagatttctcccctaacgtttatttctttattccatcttcctaggctgggtattatcatttaggtactacagttttaagttgagattcaccaaatcaaaatacttaaaacagaaatcttaatccaatgtttacagaggaaaatgactgttcatcaagtgtttgaaatgtaaaataaaaatctatttattttcttttaaaattataaaaaattgatatagaatattttccacactagaaaaatagttctatgctgcttattttattaaaaagaataaatcaaaaatttactaatcaaaaagggaaaattttcattctatatggatgatttagccctatataatgcaatttattgttttaaaataaatatttgttctttttttatagttatacaagtttaatattaaaataaagatagtttaataaaaaccatggtaacatgtagtattgccatgatgaattattatttaatacttttacaagtatattttcagatgatattttccagtctcacaatttagaaactatactaattctattttggttattttttgtgtcataaaatataaaagaactaactttcattctcataaggtgataggtagtagtgggatcaaattttcaattggtggtctaccaatacaccagctgttttttacaagaggtatgagaataaaactctaataaaaattttcagcaaatggtaccagagacacatcaccataaggtcagctaaaggttaaaaatatatataaccatatgtctagaaagctcaactaaaatgtaaataatgcagtgcagtctttatttataatcaattttatatgcttagataaagatgcacatataagtgcgttatttaaagaaaattccattaaaaaaaattccaactaagttgggagccattacttacaaatttgtttctctacaaagggtggttttccaaacacatatgagttcccggtttctgtcacaggttagacttgatataagctcttttggattacattccacacagtgcagaggttgggataagttgtttcatgtaaaatacagatatggagggaaaagggaggtgttgactattttgccaatttctcctcagacctcatgatctccaagtccagtagactgtctagatcataaattgggaaatgacaaccagtgcatcacctctagtccactgcctgtttttgtaaataatgtttttattggaatacaaccacccttgttgaagaattgtctatggtcgcttctgtgctcctaaagcagagttgagtacccatagcagcaaaattctggcctgcaaagccaaaaatatgtactatctggtcctttctaagcctattttttctgttgctataaaggaatacctgatgctgagtaatatataaggaaaagagttttatttggctcctgattctgctggctggaagacaggacatctggtgaaggcctcagtcttcttccactcatggcagaaggtgaaccagagccatgtgtgcagagatcacatggtgaaaagggaaacaagagagacaggagagggaggagctcttattagcatccaatgctcctggaaactgatagagctcatgtactcccatccttacattaatctattcaggaaggatatgccccatgacctaaagacctctccttaggtcccttcttcaacactgaggaacaaatttcaacgtaaggttggagaggttaaatatccaaatcatagcaggtcctttacaaaaaagaaaaatacttatccctggtctagttcatcattgtctaatacaaatagaatgaaaaccacatctgtaattttaaattgcctagtagatacattaaaaaaaggagaaagaaatgggtgagattaattttaataatatatttcatttaattctacataaccaaaatagaatttaacatgtagtactaaccacatttcaaatactcagtagctacaaatgtttaatggctaccattttagacagtgaagctctagaaaagcaaatcacaaggagctgctgggggacctattctacagaaaatcagttttaaagaaaagacatttccaggatactacaatgggccccaaataataatccactttacccttttattcattttacagacaagaaatgcagaaaaagaatttaaaagcaactaaccaaccaacaaacaaaataggtgtttttaccttaaaatatcatgaagctacaaagatttctgcaatatatagatgattttagggtggttatttattccctactttgatgctaaattccttccattgcaatttaaacaggttctatcttgtcttatccttagataaatctaagaaaagcagttccccatcatgaatatgatattgtattcctttaaatcctttatgactctggccttcctttcctataccagagatattgtttgtctagcagcacaaattcaactcctctagcatttcaaattggaattattttcaaaatgttttgttgtatttgtttttctcttgcaaacttttccccagatctatatgcacttgcttcaaatacaacaataaaaaagaaatacagcattctaataaagtcctaatgttgccaaacacaaaaagctccgctgctagtctcctgtttaaacagttcattctattgttggagaatatttcacctgtgtcttactaaaatccacacacaaaaaaatcctgaaatacaaagtaacctttaacagttttaaatttcacaggcatactgtccctcattttttccacacataaaatgagtatgattcaaacttggtttcttaaaattaatttttttcttaagaaaactcatgaagcattttactgtattagtaacaaggagaatgggaaacttataagcacccataacatttcacacttatcaaatttgtaaattaaagaagactaagataaagcaaccttggcaggtacagtggttcacacctctcacaccagagactcaggaggctgaggcaggaggatcacctaaggcaaggagtttgagaccagcctgggcaacaaaatgagatcttgcctgtaatagaaaaactttttaaatttagccaggtatggtgttgtgcacctgtagtcccaaatacttggaaggctgagctgagagaactgcttgggcccaggagttcaaatctgtagtgggctatgatcgtgccactgcactgtgattgtgctggagtgcagtggcacgatctctaaaaataagaccctgcctctaaaaataaataaataaataaataaataaaacaatctcaacagcctaactctatcaggatgaaatgctaagagaaaaagtgtataatagacattgaagatacccagaacataaattaaaaagatataacttaggagaagcacaaataaatattgttctaattagcactaaattcaataataagagaagtatagtatgtaggacaaagaaggtgatagtcctgtccaattcagtttatgtccgaatgtaaagaatgaaagtttgaaattgtagtcatctaaggcaaggggcaaaagcaagaaaataaagttgaaatcagcctataagtaggaaaacaagactctggcatttcattgcttcttgaagtcaaggaataaacaaaattatataaagaaaatgaaatctatatatattattaccactacctaaagagtagctatgaagctcttcaagagagtgaaataaatatcagtcagtttaccttctgggagttaaattagtaaaaatgacacttgatgaatgagatttgctcctgcagaccctagacatctgaaacgcataggtcaagagacattcccccggttctcagctaatactctgacatataatttccactataagatgctaactctgttatgaatagtgagcaacaaagacacatcaagatggggatgcttggcagctggctcagctcactcactgggctttattcactatagccttatgatacctaagactgtcagtgtggttcaatttcccaccttatgttcagctgttaatgttgaagtttcaatgcatctctataactgtccttagaaaaatgaccttttcaagttaagaataggaaaaataggttttaaaaacctaaagacaatggattaaatgagaaaagaaaaaaagctgtcacctaatcaccggtttcaatatctgaaggaggaaagtacgaacaaaagcaggtgttctaaatggagtcttaagaagagaaatacaaaattcagaaatgtttccatgcattattagctttgaccaagggagatggtactctgctgggctgaaagcattggctacattcaactctcagagctcagtgaatgaatatcctctgggctctgactccatttccatcaaggcaccctgtattacaatttcccctggcctcagatttgctacagtgagaatgtaccaagcaataaccagaatgccaattaaagaattgtcattctagtttatatactcattttttaggtatttagttagtgtgactcagttctcacaaggttgacaaatcctagactcacgtgtgaaatctaaatcagtcctctaaacctaaaaagctaaagattacatgctagcacccctgccccaactctactgctttgaggcatggctttaatggcccattggcctttcttgatgatgacacattattttgcctaactatatacatacacctgagataaaataaggtcttattctaagtccttattaatagtatattactagccttcaaaataccattaaaataacagaaaagatgaacaatatgtaattaaaaatcagcaaaaccttgatttagcaatcccacttccaaaaatatatcctttaaataatctacatgaaaaaagctttaggttcatagatgtgttatttttaaaagtgaaacataaaaaccaagccatatatcaagacatagagaaacaatttataccagcaatgatagacacaccacatagagcataatgcagccattaataataaaagttacatattaataccatgaaaatatgtttatatgaaaaaatacatttgatatgtacatataaacggcatagttacaacagtatgttgaggggataatttggaggtgaaaatacaaaaagatggaaaataatccctttaagaaatcagattaaattactatatcatatttagaagtaaaaaacaataaagctagtccaaatttctgctaagctggttgacttggtttatgagaataaatgccaactccatcactgtgtattcactgaggcttggaatcctagagagttagtgatcctacagatattggttatatcaaaagaattatccatactgtgatctagtttttctgattttttttttgtttattttcaatcagcatttttaagaggtcagatactctcaagtgaaaaataaaaatatatccaaactacagaatataaatgttttcccttccttatgttaaatcacctaggattcaagggttaatataaaattgactcaattttgataagccagaacctattttgtcaaaaatcatgccatagtaagtataatagtcactcaaaaagttatactgattcacccaagattacttggtagatgcagcagtctcttagttcttgttttcatgctgatacttaagtgccatgtatttatgaatgcatataacttcttattcggttgataatgttctttgtgaacaacagcttgatttgaacttaccttacatgaagactccacctgcagaccagggcaaggtaatggcccaagctggtaggggctggaggatctctgttctatacttttgtgcttaagtgtctctgaggcaatgggaagtacagacttcacaagctgtgaatcatcacaacaattaagaataattcgtgctctttctcctgtctcatgtctttccaaagtgcctggaaaacaagattagaggtaaaaatgtcaggaaaatatttaccccaacagaataagacagaacaaacactctttagcagaagaatcacaatcctttaagttatcgtgccttagtatcttgcaactgaaaaatagcctgggagcttttcctaaattattcaaaacacttgctcataaagtctgaacttatggatttgaaaagttcatcttcctctttgcgcttcttcatccactgaaatcaacaggagattcgatagtctttaatagtaaaatctcttacttattatacagttgcaagtgatcaataacacataactatggaatattttagtgctgtcccctagtgttccaactcacaagcaacagagaacccacagtgctttgcctgggtttccaggcttgaaatgtttctattggtaacacataatttaaatgaatggagcaagtaagaacacggatgctttgtgtactgcctccctcaccgaagtgtccccacagggctttgctgttttattgttggtattgttgtgattatatcctttggcttttatttcttatgttattagaaggggaaaaaaatcctttgcctctgtcattcttccagtttcagaatttaggagtgctgtcaagttcaacttaaagttaaaaaaaaagtataaaatagaccaaaagtatcagaaaccaattcacaaataattcaatgcttttataaaatacaatgccatacactcagtgaaatatcaataaatacgaattaatcatgttctgtctcttatgagttcatttgtattattcatactatattaaatatataggttatctcctactgaataaagacaccaaggaatactaatttaataaacaatacctaaatacagacttcatttcatattcttttccaccaatgagaaagaagtagatgtactatttatattgttaagaaaatatcaacttaattacaataagaaaatagaaataataattgtaggccactatgtctttagataaaaacattggtagatacatttgaagattatgactattctatccttcctcatttctctcccactcttctatagccttcttttattacaactaaactaccattagctggcactgtggattctgaatcagtaacagttactgtgctcaaataacaggcaaaacttcagtctcgagtcccttaacaatatacttttattataacatttctacattcataaataaacatccttatcatacaagcttataaacatgttgttcttctaagctttccttttccaccaagattgatctatctggctgggtgtgatggctcatgcctgtaatcccagcacttttggagcctgaggtgggcagactgcctgagtccagtagtttgaaaccagcctgggcaacatggtaaaacgccatctctacaaaaaaacacaaaaattagccaggcatggtggcaagcacctacagtcccagctactaggtagggctaaggcaggaggatctcttgagcccagaaggtcaaggctacagtgagccaggatcacgccactgcactccagcctgggtgacagaacgagaccctgtctcaaaaaagaataaacacaaagttcgtcacaatggtatgcaacagctagatattctgggactttaatttttataaattaggaaaaaaaatattgatatatcttctgaaggatacacctcagggagaaaaaaatgatttatagatcaacaaatgaagctgacagcaacatcaagaaaacccttcctctcaagactgacaataggaaaagcttcacaaaccaaagataagagttattactgcttcctgaaaactactgcattccagaacttggaaccgtgttatgtggtaaaattcactgtctttctgagaagtctctctttgaatacggtatcatcctggatattttcttctcacaggttctctgtggctcctcaaactatgatattgtttacatattttgagaattattgggaaagaacttattgcattttaatacatttgttatgtgccttatgcaaaatgtatacattttatatatgcacgttttattgtatacctaatgtcttacccaaatacaacatttcttgtatttttttagtgatgaaaacagtttatctacaaacttaggtagttgtaatccattttcattcatacacagataattaatctgtctgagcatctactatgctaccatgtaccatccaccatgccagatgatgacaatgtatagtatttaagaatgactcagtccaggtccctgggagcttccttaaaacctaatggtagtgcagaggcaagaaacatctgaaaactgataagctgcaatatttaaagtaacacctaagctatttccacccaaaactaacaatctctcattctaaaaatgttagacactcggttttgtgtacaagggtttctatcatgattagttataaaatagtttaaaaaataatgaatattttgttttgaagaactgattaaggcatacacatgacataaggagtggttagagtcaatcaatttctgtaaaagatatagacagacagataaataaactacatgttcaaagcagtaagttaattttgtaataaattcaggatggcagcttttgaaagaccttggttaaaattctgacagtggatgggtattcccacatgtgctagttatcaatttattacctcttagattcaaattcacccttcactgcttgctttgtgaaaatgaatttgggcttgataaatattttctcattcatcagctggtgaaatgttaacctttgtggacagagcgtgctggaaacacctagtagaagaaagggttaaggccaggtataatagctcatcccatcctaactgtaatcttagcactttgggagggcgagacgggtggatcaggtgagtccaggagttcaagaccagcctgggcaacattggagaaactccatctttacaaaaaaatacaaaaattagccggacatggtggcatgtgcttgtagtcacagctacttggggggctgaggtgggaggatcacttgagccagaaagtcgaggctgcagtgagctgtgatcataccactgtattatagcctcagtgacaaggtgagacctcgtctcaaaaaaaaaaaaaaaaagaggaaggaggaggaggaggaggagcaggaggaggaggagaaggaggaggaggaggagaaggagaaggaggaggagaaggagaaggagaaggagaaaagaagaagggaggaagggaaagaaggggaaggggaggggaaggggaagaagaaagggctttcttttcttggttctcgtgtacttttcttggagtagtattagtgtcttccccagtacagctgtctgtagtacatgacggcggggctagcagcactttgcatccaaccactttctttggcatactctttgggtagttttgtaacagcgcctccagcaagacatctccctatggacagctttctctggcacccgcgagggaatatttctggaaagctccaccagcactacaccatagcagcttctttgccattcagtacatataaccataccctctctagcaaggtcaggaacttagccctagggggtggaggggggtctttcttggtttcttggtcaagctatctcaagttctagggctaggagtcatccttcacatctgctattcctatattctttagagttctcttcttactagtcaatctctcatattcaaattctttatgatagttaacaattctttatactaaattttctgtttaagttactgcatcattttttttcctgattaaaccctgattaatacactatgacaaatcacttatgatgcagaatgtttccttaaatatgtctccaaagctatgaaatttacataacttcagagatatatttaaactattagagaacatctacagcaaaaaaataaccaaaaagggaggtatgactacaaggaagatttccaacaagggatgcctttgcaactctaatatactgccttgggcaagatacagaatagctactgtttccagatattaaagaaatataagaaactgaaggtttacaaaattgcttaattcaacttccaatttcaggagtacttttgctttccaaagtaaacttaatgataattagaattttatttcattatagtacatcaagaataggagttaattcatatttattattcatttgaatcaatctgaacatgacaaggaaaggtgcagagacataggtgagttaagcattactgaaagttacactacatctcctccttcaaagtaggtgtgcaaaaatattctataaaatctattgtaagtaaaatctttattgtataaaatgctttccagtaaatattttgtatttttctattatttatttaatatgaatttttatataatttgttttaatcttaaactatacaatagtgcattagagaccagagctaatcataagaaaagatagcttaaagcaattaacatcttgataagaaatgaaggaaagatcagtttccaaagttgcgtagtttccaaaaagtcagcacacagaaatataagaaacagccaagataatctctgcagatccctagaaccatattgacaggattttcacttgtacacactgctttccctgtcagttcagcataacccacagcatacctaatcaactacatgtaaaaccagagctttctctatgaccccatgcacaaccctgcccatgttctttctatctgtccagggggacaacaaggacacatcatcacagcatggtgtttaggggcagactctggcatcagactgtcctgtagttaaatccttgttttacctttgatagctgtgtggccttggacaagttactttacatctctgtgcctcaatatcttcatctgtacaatggggataataataatccctacatcatggagttacttgaggattaaattgagtagatataacaagtgcttagaggtttcggcacacagtgaatgctgtgctatatgacagccctctttgtcacacgagagaggtcctcactcagctgcttgtgagctgattaacaaacctctttggcccccaagcactagagtctgcctgacacctaggcctgaggtcactgggcatatggccagcttgggcccccagggcttcctacctgagacttgaacctcctcaatcagcctttcctcacaggctacgttacaatcaaactcagagtaggattatatatttgacttattttttaatcctcttcagtacaccagaatggggtctggcataaattaaaggctagataatacttcttaatagattatatgacatcaacaacctgctcatgatttttttttaactggcgctgcacttgggattaaacctaaactccctgaccaagaagtcatagtctcaccctcgctctgctttctcccatgtcagcctccccttattcacaaattagattttctttttcttttgttgaaaacaaacaaattttttcctgctagctctagcacatccttcaggtattagcttaaaatctcacctcctcagagaagccttctaaaatagattcccctatcttgtactgttttctatctcagcttcttcactttatagaacttatcacatttgtaattggtgtcctttatttgcttgcttccccaacagatactaaactctttttggcaagtatgtgttccatgagcttggtacaaagcaggtctttctaaatattcaccgaagaaattgaagaattttatcctttccctgaggcagtgaaaagaggtggctataaagcatcagagcatatgagggtctcagtgtgacaagatttaatgccagaaatatgcactataaacttagaccctagagcccaggagaggccaacactgcgaaaagtgccattcacaagcctgaggcctgtcccagctttcagcaatgttgccaggtcactcctgatggcacaagaacttgtaattggagacagcgagtcagtttctgaatgtgacgtgttgtcttgacctgtgaactagccatttcttgcttcgtggactacagaacagaagatgctagtctaaagatgagatggaaataagaaaatgcacagagagagacagaaatggagaaggaagaaaggggaagagaaaagagaaaaaaaagggaagagggagaggagagatggggagaaggggaaagagggagggagagagcgagagagagagagagcacttacaactttctagttttgtttctagatccttcctaaggaatagtgcccctaaagtgtctgaaatacacacctgaatccttataataaacaccactttctgataaaattaactttacttctactgcttcctacctaataggggccctaataagaatggggcagagatgtttctattacggtaaaggccaagtttaaggatgcccaaatagacagcatgtggagttccaggtagagatcagagcagagacacaaagccttaagcattagcagcacataggtgaggattaaatgccgattaaaaaaaaaaaaaagccactccaagtgaatttggagtgagctgtttcaggagacgagcataaacccctgttagcagtttctgcacaagaaagaaggaagattctgaaactgctgtaaatcagtatgttgctaaaatacagccctcttgtaaacccattaggattgtcaaatttataggcatctacagttttttgttttgttcttaaatagagcaaataatcactttgtgatgtaccggttatgagatctgatcttgcaatatcaggctgtcttaaagcatgacatgtagtgtgaaggatgcagccttcaactgcagtagaagagcaaggcacagagtaaagagcacacttctatacatctgcccaaatgatgaaaaagatctaaacatctacctaaagaaggagaagaaagagccatcacattctacacttcaattcccttccaaacagccagaagttgtttccttgattttattttccttgaaatttgtgcataattttattatttgctgtcttctacttaaatattttattttggctgggagtggtggctcactcctgtaatcccagcactttgggagactgaggcgggctaatcccttgggctcaggagttcaagaccagcttggacaaggtggcgaaaccccatttctacaaaaaatagctgggtatggtggtgtacgcctgtagtccctgctactcaggaggctgaggtgggaggattgcttgagcctgggatgtcaaggctgtagtgagacatgatcatgccaccgcactccagccagcctgggtgacagaataagactgtctcaaaaaaagaaaagaaaagaaaagaaaagaaacttgttttcaactcccattgacatttactttccaaaattaacaaaagtatcctagcctaatatcaatgtatgaatagctttaaattacatacttcctcctacaaattaactcggtccactaagtctatgaaaaaaaagaatagctattatgctcaaagggagagaaataatttaaaaagaaatcatagtcatttgatgaatccatctgcaaatgatcaagaggaaattaagactaaacaacatcacccagatggattaacactttatcatgttgtacagaaacattttctttatgttaaaattatacataaatacatttgagactaattgacttactataactcatggtgtctttccaaagaagaacagtgtagaaacaccatttctatagaaacataaaattctcccagaccatccaaagcacatatattgtaaaccaatgaatctcaaacaaatttgtttcatagaaaaggaaaacattttaaattaaatattctgcttattattggattgtggaaaaagcatatatatttcattgtgaaaaaagcatatagggccgggtgcagtggctcacacctgtaatcccagcactttgggaggccgaggtgggtggatcacctgaggtcaggagttcaagaccagcctgaccaacatggcgaaaccccgtctctactaaaaatacaaaaaattagccaggcgtggtgctgcacacctgtaatcccagctagtcaggaggctgaggcagaagaatcccttgaacccgggaggcggaggtttcagtgacctgagatcgcgccattgcactccagcttgggcaacaagagtgaaactccatctcaagaaaaaaaaaagcatatatattcatcactaatcacataataggataggaattatttagcaaataattgtatttaaatgaacaaagcttaatagcaagaacatgtgagtggacatattatagaattaggtcttttccatattgggtaggcattttctaactgaatccattatgatattgggcaagtgattaagaggacaatatttcaaagtgactctctctgaaacagagtaagttttaaaaaatgacctcactaccaaatttgataatcaaattcataaaagtcaggtttcaacaaaaccactgactgacagttataatcaaattccacaaatcaaaaaatttgaccattgggtctgttatacaatttatcatttattttcagttactcatgaagttcattgccttgctcagaaacacatatggagatcgacctagcaccccctttctattaaaaccatttcacagttactgcatcttactccaggaaatgtataactgatgggggttcccaccacaaacaggggccctggaggtatcaaatttagctaactagaaaataatggaagggtggggaaagggaatgagtcttaaaacattaaattagggataaaggtacttaccttcattcctaaatgtagttgatataataaattcagctaaaaaatggagtgtcaaagacctggcttattttgtactatatagaggccctaatatgataacaaacttagattggcgtcacatcaatcttctgtaccttaagggtatataggatacatttttaaaaagtctctaaccaccatgaccttaaccccagctctgccacagcctccagcacattcacagcaatgctgggatttatcagctgggccacattcaaccctcacgtctaattctgaccacagacctccagaaaaacggaataaagaggtgtggcgggggacaattgaaagaaaaaaaaaggattgaaacacctggaggtttaaagttgctgagatgtgtaaagatagcaaagaatgcattaattttcaacacattttaaactagggttttcttgataaggtatctatttattaacacacgctagcagcgtaacatctactatgactttgggaggccgaagcaggcggatcacgaggtcaggagattgagaccatcctggccaacatggtgaaaccccatctctactaaaatacacaaaattagccgggcatggtggcacatgcctgtagtcccagctacttggcaagctgaggcagaagaatcgcttgaacctggaaggcggaggttgcagtgagctgagattgcaccactgcactccagccttgagacagagtgagactctgtctcaaaaaaaaaaaaaaaaatctactatgactaatttttaatttttaacctcactctaagactaaatacaatttacaaccaatttaagaggtagatattcacagccaagtgtttcttaagtataacgtaaagaatacatttaattaattgtacaattatctattatatacaaaactataaaattatactgctactgagtatttcaaaatttcattcatcacgtcgcattatttaaatttattacaccaggcatgttatttttaaattttaaaatatttcaaaagtagattttgtccctcatgcttttaattgtaggttaagttacttattgggtataatatccttgaagagatttgagtctgttcatttatatgcttctggtgtcaattaatttaatcagatcaatatcttgctgagttgatctggaatttttcctgggaagaggaagagtattgggaaaggataaattggggtatggtctcttgaataaagtgctgggtgaggggtgaagtcctatgagagttattttggttatttttttggagaggaaggatatagtagagatgagagtaccaaaacattttaactgccatcagttttcccttgggacatgatggtgatttgccttaggcaaataatgggtgactaatgctccagcaggcatgtcaggatttgttttgaaaccaccaaggctcagggtaccctcactatactcctaggtccccagtgccacttgtaaaattcaataccatattaccacacccagtgacctcaaaaggctctctcatctcttcacacttcctttctatagactcactcaccagtgaggacctccagaaaggtaggactgtcctacctgaccactaatgtaataggaagacttctactaataatccccaatgacagtcatccttatgtgattccctcccctttgaatatgataggatggccctccagtgattattaaagggcaaaaggaactttgcacatgtaattaacgtttctactcagttgtccttataataagcagattattcaaatagaccaggcctaatttgatgagcgctttgaatgcagaaagttctctccagccactcaaacaagaggaagtcgagatttaaaacattggaagtatttgatgtgccattgctagcttggaagtggcaggaggccatgaataaaggtcagggagtggcctttaggagctgaaagcaacacctggccacagccagcaaggccctcagacctacaagtgaaaagaactaaattctgccaaggacctgaattagtttgaaagtgaattggttcccagagcctctagatgagagcccagttggctgacatatttattttgcctcatgagatcctaaatagagaacctggttgagtttgcctggacttctaatttacagaactgtgagacaataaataggtgttgttttgagctgctaagtttgtgttaatttgttatacgcaataggaaattaatataaccaggacttgtggcagtacttttactcagaacaacatatttagatttcaaatattttagtcattctttactattttatacgtgaaattcttgcttttttttttttttttgacagagtctcacttggtcgcccaggctggagtgcagtggcaccatctcggctcactgcaagctctgcctcctgggtccacgccattctcctgcctcagcctcccaagcagctgggactacaggcaccctcccgcacgcccagctaattttttgtatttttagtagagacggggtttcactgtgttagccaggatggtctcaatctcctgacctcatgatccacccgccttggcctcccaaagtgctgggattacagacgtgagccaccgtgcccagccaattcttgcttcttaaacataatatataactaaatgcataaacacataaaaataagtaagtgtgatggctagttagacatttcatacttttttataactccttcccctttcttacaccctaagtactataagccattcagatattctctaaatagctggtgattccacaatcatatgccacatcaaaaaattccttttaaagcattctatttccaaaggaagctgatatgatttggctctgtccccactcaaatctcaaattttagctctcataattcccatgtgtcttgggagggaccccgtgggaggtaattaaatcatggggtcaggtctttcctgtgctgttctcatgatagtgagtagtctggtggttttataaagggaagctcccctgcacacactctctttttcctgctgccatggaggacatgactttgctcccctttttccttccaccatgattgtgaggcctccccagacacgtggaactgtgagtcaagtaaacctcttttctttgtaaattacccagtctcaggtgtgagaacagactaatacagaagcacatgtaagagataaaatattgttttctcatcctcttctttatcatcatcatcatcatcaaaattgccattatctaccactaattgagtatttttaagtgccatttaattcttaaaacaatcccgttaactgcaaagaaatggaagatcaggaagaataagtgacagggtattagtgtttcctgtggttgggagggtgattagggaaagtattttaactaaaaagacaggcaaggccataatgctatgtggtagagttacatttctaccagagattatggggactggcaggtttagggatagatttaaagtagggaatgtttggttggcaatacagagaagagaactgaagaaagaactttattggcaagacaatcagcaaatttttcaaaagttcatataaaagattaggaacatcccaatccatctgcccttaaaacattttattttttaatgtttttgccacctctgaaaatgtataattctatcttttactgaaggcttacgaaataaatgtagcaatagtttatctttcaaataacccaacttcatcactagacattattgatagtattggggctaagaaacaggtactgattaggacttccatggaatggctacacaggttccctatatagccagtagtctttggtgggctcttaactctatagaaccatttccttttccttcttttcccggagcattctaccctatcccttcttactatcatccttatttctgtagtttataatctctgctgccacttcctctaggtgttttgtatacagatgcatatactttatctctactatagagggagtcttacagaacagagactttccggcatcagcctttgtcctacccaattctgaattagagaacaacttgctcttcctcccttttttggtcccctgtctggtaaagaccccagtatgcgtggctgcgtatcctatgccacaaggttctatcccccacctctcataatgtatagatcatggtctaaagcatctgtgttgacttctgggtatataccaaaattgactgaaaacaacgatatgaatagatatttgtatacccatgttcacagcagcattattcacaagagccaaaagatggaagcaacccaagtgtccatcaaataatgaatggatgaataaaatggtgtatacacctaaaatggagtatcagtcagccttaaaaaaggaaattctgacacatgctataaaatggatgaaacttgaagtcctcatgctaagtgaaataagccagtcacaaaagaacaaatattgcatgattccacttatatgatatacccaacccagaacaggtaaattcacagaaacagaaagtagaatagcagttgctagggaatttgggaaaggacaaatggggcattactgttcagtgggtatggagtttcatttaaagaagctgaaaaagttgtggagatggatgatggtgatggttgcacaacaatgtgagcatacttaatgccactgaactgtacccttcaaaaagcttaaaatggtaaattctatgttatgtaaagatcccacatctttgtttatattttaccacaatcatcataataaaaaagcatctgtgttaataagacagcccaaagaagatacaaggaaaagaaaactttgagaataaacccaaagaacaatatacagaaagcatgtagaagtagggcagtctgagaaagagggaccattggccatcaggagaaggcagtgtcatatgaggctgaggatggagagagagagggaggaaagaaggacattgatggcagagtgattgcagacaagtacctgtgacccagagcatggcaactcaacttggcagtgaggtataggaagaagagttccaatggaaaaagtgtagcaaaagccagattaaactgtattaaatcaatgggaggcaaagatatagagtggagatggcattttgtaggaaaccaccagttactttgggaagaatctcagagaaaaataatagaagcccacaattccttatccaaaacatttgagaccataggaatttagaattcatgatttttcagattttggagagataaaataatgcacatatgcatattatataataactggagcaaggtctaacagagcagacagtaatcaaacatgctatatatctgcagcaaaaaaaaaaagaaaaggaagaatacttacacttagtgaaataaataaccttatgcaatttaaattttggttatgttgctttactacaaactattaaaaacttttattttcagagatttttagatttataaattttggctaagagaatgtaggcctatactccaaataactggtagcaaggtggccagaactaaccagaaatattctctgagataagataggttaatagaatgctcagtttcctgcaatatagtatattaactcatgcatttagctcctatttatatctatacaagtatgcttagtcatgcaattccaaccccaagcttggcggattgttttatctatgccctctatgattagatcataatgtactaacaattctgttaaattcaatgtttaaaagaagcacaagtttctttacacaattattgatgggagataactttgctaacagaccaagcttaagaaaactatcatggttgtaagatatggagagaatttctatttttaaatgacagacctctaataaggaacatgtaactgtaattttcaaacttgacttatggttgatacttccagaagtaagaaaaatgtggtgaccaaagaaagttaacctgcggggtaaatcatgggttaaagccaattgtttttattaaatcttcttatcttagttatcttcctagaaccttaaccccataaattttctaaattttttattagcagaaaatacaattcatttactaaatttacaaaaacagcttgttatctgctcaactgatgaactgtaagatggcatcatgtgcctttcagtggagtgttgggtactcagatgctccaagggctgaagcaggtcctttgtctactcagcatatgggtctcagtggaatggaacctgcttcccccaaatgtgaaaaggactggggaaagtggtgggccaatctattgcctgggatgcactgacaaggctgagatcagcaggcaacattatttgcagcacagaagataaaatctgacattccctcagtcgaattctctgctcaccactcccaagccaaggacttgacctttgaatttgttttcatctagttcatccctagaaacacaaaagacctttcccatcaaatcttaacaggtaagcaaatggtaggagttggatattattgatacagtcagatgaatcaagtgcatccagtatcctttatctctcagccaaatcagagaacctactttcccagagaataacaatcattacagtccactgagtcttgcgtttccaattgtttctgtggcagctggctactgggaagttgctagggaattgaaagaaggcagcgtggggagggcagatggctcctttgggtttatttccactaaacgttacagctgtgaaacccactaacgttccaagtgtcatataaaatgcttgaagaaagggcctagttaaggaggagccaaagagcagccatcctgatgtgtttctttttctactgttgtaggtgaagcccccgtaaacattaaatgcagataccagatacataacaaactactcagccagaactcaatccaaaagtgtaatcagaccacaggaatcgctaaaactgattacagccagtattttctttactaaaggaaaacccaggaagatagcaactgccaaaggaaacaataaaggcagcaaagggtgggacttaattgatgaaagtaattttaagagcagacaatatttatttttatcattagaatgagactgtattgattttcctatttgtttctgagcatacaaaatgttctgaagacatcctgcaaataccacaataatatgcctaatatatattaagatgccaggagaaccaaaaaaaggtggagttgaataatatctcaattaaaatgcacacacacacacatccacaaatacctgtgtgtgtgtcacttgaaaaaaaaagtgaatcaaatgatgtagaatttttaaaataagtcatggatacctaaaaacaatatagaaatgtttatataaagtataatcctgtaataaaatgtaggtaattcttccaatgtttataactaataaagattgacaaaaactctaaatttgggggaaaaattacatgtgcctgttttgttgacagcctttcaatgtgatacctgaattttacaatgcacaccagaaaccacttcatgcagaccattttacaatgcacaccagaaaccacttcatgcagaccattttactacttcatccttggaatgtccttactttgaaaagtttgtaaaactataagatcaagttaacaattacataatttcaccaaagtggagatccatgttcaccacatggaactaaagacgacgactgtggtgggcctgtggggtgggaggatgcactcatgtgtctgtttgcatgcacatgcatgtaaagatgtacactgggtcttgtctctacattgaaataaaatatatatatacaacgagacttacatgcctctcttcagtgatgcagtattaattgtttatttaatttggttcaaagtaaggtcaaactctttcttattactgtatttttgctctgatttttttttcccaccatctcttcacggatgcataaaactgaatgttttcagaataatccaggtcacctcttgaatgcttaaaaacttattccaccagataccctaaatcatctctctcaaatttgaagtcccacatatctctagggcaggggcaaaatacggccagactccttgctaaagcataacaagagtcacctttattccagttcccaacatatacttcctgtcttcttctgagccctgtaaacagttccaacctccgcttgttattcagttccaaagttgcttccatattttcaggttatctttatagcagtattccactctacttataccagttctctgtattagtctgttttcacactgctataaagaaataacagagactggacaatctatggaagaaagaggcttaattgactcacatttctttatgactgtggaagcctcaggaaacttacagttatggcaaaaggtgaaggggaaacaagggatgccttacacagtggtaggagagaagtgtaaaggagcaacttccaaatacttttaaaaccattagctcttgtgagaactccctcactatcatgagaacagtatggaggaaattgcccccatgatccaatcaccttccaacaggtccctcccttcccttgacacacagagattacaatttgaggtgagatttgggtggggacacagagccaaaccctatcagggtatacacacatacttagaaggcgtaagttctgatgtttggcatcagaatagggtgactagaattaactgcaatgtattatacatgtcatagtagctagaagagataatctgattgttcccaacacatagaaatgataaatactcaaggtgatggaaaccccaaataccctaacctgatcattacatatactggcatataagaaagtatcacttgtaccccaggaatatgtaaaatcttatgtatccatacaaaattttttaaaataaggatagtatcttctctacataaaatttactttcatttttatactaactgaatcctatgaaacaactgtctttggctactataaattgctctctttcttacattatgtattttacatgtacctatttccccatagaaaatagattttaaaaacacacacacagaatatagtgaatattaagtatattaatttataattacttgggtaagaaccacacaggagagagagaaagaggaagaagagatctaatcaatgatacatctataaatctcatatatatatatggtctgattttttaaaaagtatacggatggcaaatacagacagcctggcaaataaaatagcagattttcacttatacttcccaactgtactgctaccattgagtaattcaaaatctcttagactaacaggagttcttaaccttttttacaccatgaaccccatcaacaatctggggatgtcaacgaaccctttttttccaataataatttaacatttgtaaataaaatgcatataataaaggatatcaattaatttttaaaatcagcaaaatcttaaaatcacaatatgaaaataagtatgagcatatctttgtatacgttaatatataaaagaaagaaaacattgcaggtataatagacgaacctttaacaatgattttctgcaaatgttgagattctactgtttttaagaattgccggaggagccaagatggctgaataggaacagctccggtctacagctcccagggtgagcgacgcagaagacggtgatttctgcatttccatctgagggaccgggttcatctcactagggagtgccagacagtgggcgcaggtcagtgggtgtgcgcaccgtgcatgagccgaagcagggcgaggcactgcctcactcgggaagcacaaggggtcagggagttccctttctgagtcaaagaaaggggtgacagacggcacctggaaaaacggctccctcccacccgaatactgcgcttttccgacgggcttaaaaagcggcgcaccacgagattatatcctgcacctggctcggagggtcctacgcccatggagtctcgctgattgctagcacagcagtctgagatcaaactgcaaggcggcagccaggctgggggaggggcgcccgccattgcccaggcttgattaggtaaacaaagcagccgggaagctagaactgggtggagcccaccacagctcaaggaggcctgcctgcctctgtaggctccacctctgggggcagggcacagacaaacaaaaaagacagcagtaacctctgcagacttaaatgtccctgtctgacagctttgaagagagcagtgattctcccagtacgcagctggagatctgagaagggccagactgcctcctcaagtgggtgcctgacccctgaccccgagcagcctaactgggaggcacccccctagcaggggcacactgacacctcacaaggcaaggtattccaacagacctgcagctgagggtcctgtctgttagaaggaaaactaataaacggaaaggacatccacaccaaaaacccatctgtacatcaccatcatcaaagaccaaaagtagataaaaccacaaagatggagaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgacgcgatcaactggaagaaagggtatcagtgatggaagatgaaatgaatgaaatgaagcgagaagggaagtttagagaaaaaagaataaaaagaaatgagcaaagcctccaagaaatatgggactatgtgaaaagaccaaatctatgtctgattggtgtacctgaaagtgatggggagaatggaaccaagttggaaaacacgctgcaggatattatccaggagaacttccccaatctagcaaggcaggccaacattcagattcaggaaatacagagaacaccgcaaagatactcctcgagaagaccaactccaagacacataattgtcagattcaccaaagttgaaatgaggaaaaaatgttaagggcagccagagagaaaggtcgggttaccctcaaagggaagcccatcagactaacagcggatctctcaccagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctaaaggaagtgctaaacatggaaaggaacaaccggtaccagccactgcaaaatcatgccaaaatgtaaagaccatcgagacgaggacgaaactgcatcaactaatgagcaaaatcaccagctaacatcataatgacaggatcaaattcacacataacaatattaactttaaatgtaaatggactaaatgctcccattaaaagacacagactggcaaattggataaagagtcaagacccatcagggtgctgtattcagaagacccatctcacgtgcagagacacacataggctcaaaataaaaggatggaggaaaatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcactcaacacaagagcacccagattcataaagcaagtcctgagtgacctacaaagagacttagactcccacacattaataatgggagactttaacaccccactgtcaacgttagacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagagctcaggattaagaatctcactcaaaaccactcaaatacatggaaactgaacaacctgctcctgaatgactactgggtacataacgaaatgaaggcggaaataaacatgttctttgaaaccaacaagaacaaagacacaacataccagaatctctgggacgcattcaaagcactgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaatcaagaaaaaaagagagaagaatcaaatagacgcaataaaaaatgataaaggggatatcaccaccaatcccacagaaatacaaactaccatcagagaatactacaaacacctctattcaaataaactagaaaatctagaagaaatggataaattccttgacacatacactcttccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccggacagagacacaaccaaaaaagagaattttagaccaatatccttgatgaacattgatgcaaaaatcctcaataaaatactggcaaaacaaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagacgcagaaaaggcctttgacaaaattcaacaacccttcatgctaaaaactctcaataaattaggtattgatgggacgtatttcaaaataataagagctatctatgacaaacccacagccgatatcatactgaatgggcaaaaactggaagcattccctttgaaaagtggcacaagacagggatgccctctctcaccactcccattcaacatagtgttggaagttctggccagggcaattaggcaggagaaggaaagaaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttgcaagggaagtcaaggacctcttcaaggagaactacaaaccactgctcgaggaaataaaagaggatacaaacaaatggaagaacattccatgctcatgggtaggaagaatcaatatcgtgaaaatggccatactgccccaaggtaatttacagattcaatgccatccccatcaagctaccaatgcctttcttcacagaattggaaaaaactactttaaagttcatatagaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacagctatctgatctttgacaaacctgagaaaaacaagaaatggggaaaggattccctatttaataaatggtgctgggaaaattggctagccatatgtagaaagctgaaactggatcccttccttacaccttaaacagaaatcaattcaagatggattaaagacttaaacgttaaacctaaaaccataaaaatcctggaagaaaacctaggcattaccattcaggacataggcatgggccaggacttcacgtctaaaacaccaaaagcaatgccaacaaaagccaaaattgacaaatgggatctaattaaactaaagagcttctgcacagcaaaagaaactaccatcagagtgagcaggcaacctacaaaatgggagaaaattttcacaacctactcatctgacaaagggctaatatccagaatctacaacgaactcaaacaaatttacaagaaaaaaacaaacaaccccatcaaaaagtgggcaaaggacatgaacagacacttctcaaaagaagacatttatgcagccaaaaaacacatgaaaaaatgctcatcatctctggccatcagagaaatgcaaatcaaaaccacaatgagataccatctcacaccagttagaatggcaatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgacccagccatcccattactgggtatatacccaaaggactatgaatcatgctgctacaaagacacacgcacacgtatgtttattgcggcattattcacaatagcaaagacttggaaccaacccagatgtccaacagtgatagactggattaagaaaatgttgcacgtatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaattagatcacatggacacaggaaggggagcatcacactctggggactgttgtggggtggggggaggggggagggatagcactgggagatatacctaatgctagatgacaagttagtgggtgcagcgcaccagcatggcacatgtatacatatgtaactaacctgcacaatgtgcacatgtaccctaaaacttaaagtataataataaaagaaaaaaaacttaaaaaaaattgcctttagacttactgtatgttgtttttatttaaattgatgtaacattgacataatatacattaactacacaattcagtggcatttagtgcattgacaatgttgtgtaaccaccaactctctctagtttcaaaacattttcatcttcccaaaagaatcccccataccattaagtaatcattccccattctccaccctcccacaaccacatctcctgacaaccaccgatctgctttctggttttatggatttgccttttttggatatgtcatataaaaaagaatcatacaatatgtgcatttttgtgtatgtctgacttctttcacttagcatgttttcaaggttcattcaagttgtagcatgacaacttgctacattttgagggtggagtaacacttcattgtatgtgtatattatgatttgttagattaacaggagattagtctatggagattcctccattgatggacatttaggttgtttctgtactttggccattatgaataattctactgtaaacatttatgtacaagtttctgtgtgggtatgtttttatttcctttaggtatatacctaggagtggaattgctgggtcatttcataattctatttttaaccttttgaggaaatgtcatacagtttctacagtggtggtaccattttatattcccaccagcaatgtacaagggttcctattttctccatttttgctaatactctttgttttccactttttaaattataagtatcctagtgaatatgaaatggtatttcattataactttgatttgcatttccctgaagaataatgatgttgataacctttatagggtctcattctgtcacccaggctggagcacagtggcacgattacagctcactgcagcctcaacctccccagctcaagtgatcctcccatctcggcctccagaatagctgggactactggcacgtaccactgtgcctggctaattttttaaattttttatagagatgggatcacactatgatgcccagtcttgtctcaaactcctggactcaagtgatcctcctaccttagcctcccaaagtgctgaaattacaggcatgagccaccttgtccagccctatgtcctctgcagaattgagtggctcgtcttttgttgctgtgccataagagttccttatacattctgggtattagaccattaacagatgtacaatttgcaaattacttttcccattctgtagattgtcttttcacattcttgttaatgacctttgatacacaaaagtttttaaattttgtaaacttcatctatttttttctttcgttgctcaggtttcttttttattacagcaaacatgtaaaatgatagacagacagacagacagacagatagatagatagatagatagatagatagatagatagatagatagatagatagatgtttaacaaaaataaagccagtattccacatacagtaacttcatacatcttttctgcaaacactgtgtgttaagtatcttcattattaccatgaggaaactagggctctggtcaatttagggatttgccaaagactgcacatgttaacagtggaaaaatcttctttctttgaacactaagcaatagaattagtttgacagattaaaggtgaataattaatcatgtggcattacttgtgctcatggaagctaaatattttttcattcaataaatatttgttgagttcttcctatgtggcaggtgccatatcagcttctagaaatagaacagtgaaccacacaggcagaattcttgccctcaagatgttttcagattagtgagaaagacagatgttaaccccagaaatgtaattatgagaggtgaagtgcactgtgctatgggaacaagtcataaaactctccccacaggaatacttatcagtacacttggacactttagtatattccatatgccactttcttatatgttgctttatattttttcaaattgtttcaaaggtacaagttttccctgattacactgaaagctctttaaggagggaaaccatatgtgataattctagtgtccttcacagtggtatgcatttcaccagaacaggaaataattattgagcacaattagaatggagagaaggagttaaggagtcaggaataatgaatccttagtacacactagtacagtaattcatgaaggatttataataaataatagttaatgtttattcagccctcgctgccattaagagatggtgttttgaggagttcaaacttgatttatgtaatatagaataaaaagagtggaacaagaattcaaacctaggcaagctgactcccagggctcatgtacataactcctctggacattgtcgcctacttaagagatcaaattttgacaattgtgtaaatatttcatagctaaactgcaaagttcatatacaacagcatgtgcatacacatgcaaacatacgcacatgcacaatattgcatgaatcaaaatcacaaattgcagtggaactgtgataactagggcaaaggagacagaaacaaagattcaaaaaatggtcagtaaactaaaaatatatgtcgagtaataacatcagtaattattataataagaaagaggtctggaaaaggtgacataggaaaaatcccaccctatactttaatgtatcctattttttctttcctaaaaccaatcaacccaagagggttccatctgtaatctaccacaacaaaataacatggcttcgagaaaatgacatactagagagactattacctgcaggatgcggcataccccaaacctacttttaacatacctataatgaaaatcgtatactggttatgctcacaagactgtcaacacaacataactttgacctgatatctacaaagcggtgaccttgaggagaaaaccaagcaatattgtttctgagaatggtatagttggtcactagtgtaatttttaatgttattttatatgtatgggaatagtagatgttgtctaccataaaagaaggtgaccaagtaaaacctgtggactggcaaattacttctccatgtagtaaacttgtataatattttggtgtggcaaagtaggaatttaccacacaattctagtctattgaggcaaatacagctatatttctgaaaaacgtgtcttgcacatattctacatacccctcactgtaaactattaaagcaaactcaaatctatacgacaagattaaacactgaatatttttgaaaaacatgagctattagctgttggttgacaaaactcatttctttatatttttatcttttccttttttcttctaaaaactttttaaaattagttatttcaaagcctatgcactttgaaaacatggaagaacaagtgctccactttgcagtattgtggattgaataattttccagctaactactactatttctaataagaaaaagaaattaaaaggtggaagttttgacttcttactggcaaggcaaaaaaagaaaatttaacacctgtggtgaaaataactctgaaacgtatcttcttccttacttccttaatttcttatgaataggttttgtttcaatgctctgtacaaaaaatgtttgttttaaaacttggagtgtgttttcctacagaaaccacgtcataatcagaggctgggtgctcatgctatgctataatcatgaggctttctgctcagtgttacacagtccacattacctgagcaggaactagaagaaatgaacaaaaacagactcccatggaccctgatttctacctactaattggtcaaagacttcagtcccctaaacccaagccccaagctgcttctgagatgtccttaggtctggaatccaccatggatacaatacttttaaatattcctcctggagcccagcagtacctgggaagaagccagcccagttctccaacaggagtcacgggatgtggactggcagctttccatggtctgtgcagagatctgtaggagcttgctgagtaagggaagcaatttcagcatttttatattttggcaactatcttcctatgagcacaagaaagacagccctgagcagtgatacatagcttttgcttctcctcccttcccatcagctgtcgcttctgctatcagagtgccagccacgaacagcctccccacttgtaatttgctgcggctaatctgtcatctgagaaatcagatgaccagagccgttagaactatgtgtaaatttagagccaaactctgaaagacagccagagaccctctcctttaggagatcttatagcaggcttcctggcagccatctcctttcttttcaaagctgttcttatctaattccctgcttgacagtctcaaaaggctgacctccatctgcaagaggtgtttgcattgcacgataagtgaagaacacaccagaatggaagaaggagacatataatctagtgcctgtgccaacacctactctggggaccttcaaactcacaaaacctctctgtgttctatttcctcactggtaaaatgggtataactatacctgtcctgcttaacagtgaggcaaaatggatcaaacattttctattgctttaagaatgagttattatgaaatcaatgtatttaaaaagaacaatcatcattctcaggggtctgtaaactatagatgcaggccaaatcaggcctgctgcctgttgttgtaagtaaagttttattggaacacagcgtcaccctctcctttatgtagtgtctatggcttcacttatgctacaataggagagttcagtagttgtaacaaagatcatacggaccacaaagcagaaaacatttactatccagccctctacagaaaaaagtgtttctgatccatcttaaggtatttttaaaaagtattatttttaagcaaacaaggtttcattgtcccacacaaaaaagtgcaattacttaatatggcatatttcccaacacagtttgtacacttaacagaagaccttcaacagaaagttacattaataacacacaagaaattcattacacaaattatctgctatgtaaatccactactgtgaaaagagtagtactcagaattattttaaattcaattcttaaaagaataattagctcagagctaagatttatttctggtatgtaatttagggaaaataaaatcagtaatacattattacgcctattgtgtctcacagcaatgagggcgaccaagccgcccagagttgtcagtgccaaatacactgtgggagctcaaatattaatcaaattgacatctgcaatattttcctttcctaatcaggcctaaacatcatgggacatccggcaaatcaataagcaaaactagatgccctcatcactcctaacctggcagcgccacatttttagccagaggacgagggccctcagtgtcacataaacatttctttacctcagttgtttgccactcccaagagtgtgtccacctacgaccccaaaatttaccctgtcatccatctcactatgccacctatcacagaaaggaacacccttatcagtccaagataaaataggcacagtggtacatgactctagaatatgcttacgtattctgccaaagagactcgtaagtaaagtgagaataggctcttataaagtattcgtgaaaaacgcaagaggcctcgcaaactttcctctataatcgaggaagggtggcacagggacttatgctataccccatactccccaagctcccaccaaggcagacttctggcaagttgagaattaattacttttggcttcaagccccttttcctgccttttctttctaggcccctttcctcaaaactcttctcccactaacacctcctattttctctctgtgggctctggagttgctctagtgctgaaagatctgataaatacctttatgtcaatttattcctccttcacgtagttagaggaggcagagtgctggagaaatgaaagtaggaataggtctgtccacacatggaactaagtgtgaaccctgtggagagaatagtaaaactaaaaggccaaggcccaggaaaaattgactggagtaggaaatacacagaccttcacctgaggaggtgaaatatgccctgtgaactccaaaaccctagggaagacttgaagcagaaagctaaggacctgcttacagttgggcagtcaggatctaagagccataactggccaatgttaaggtgaattaattcatactcaatctactgaggtaagggcacttggattaattagttcactcattcatttatcattcgtgtgccaggcacatccatgagcaagtatattccataccttcaaatagctcttttcagcctgttttggctttagttcgtattttccccctagctttatgaaaatataaatggaaacacttcctgatctcagaccattcaacctttgtaagtaaagaataaaacagaaatcaagtgcagtaaacatgatggaagcatcttagccagctgaaatctggcttggaaaagaaaacataattcactaaattgtaaccaaaattaaaattgcacagattaaaggcaaaacacaacaaaggcaatacccaacacgagaataaaggaacagcataaacttattcaaaaggaatgaatgtgatatagaaagttgggccaccagccaccttcacagggtgttgtaaggctcaaatgaggtggtcaatgggattgtgtctaaagaagtgaagaggcacgtcacaaatgtgaaggtctgggtagaatcattaatactatcatcaccaattataagctcatcttaagatgagttgagattgtttttaaactattaatatagacaaccaaaagatgaacaacttatattctctaggttactttggcactaaacctatgcatactgtttgatacggaaattctaaaacaaactttttatagaaaatagtatagataaccaactataggagattcctcaattaaagcctagtatgtccataatgacaactctatcgattattgtccatgtgacaacccactccgtcctttcctacccttctgtgtccttccttttttgtgcacagggaggctgatgcccagaactgaatgcccttcctctctcactttcagtggattaaattaatggaggtgactgcagaagaaaaaagaatttcttccaaccctcccctctctatgtgagtcctccatctctggcaggagctgcttcttttctatgacttcatggggtgaccattcctcctgagcttcaactctcactgggttccaacaacaatgttttctcctctttttgcttcagtcctagaggtggccagagcttcctgatgctgccagtgcctgggtgctggaggccctcaccatccattccttgtctggtccctaatccctgcccacacctctataaatagtcctttcattcaagtttcttcatttgacccatctgggttgacttcagtttcctgccaggactgtgactgaaatacaatatagactaaaatacagtaaatatctatttattgacatagaaaaatgtctgacagaaagtagatcaaaatattaatagcacttattattattatttttttgtttgagacagagactcgctctgtcgcccaggctggaatgtagtggcgcgatctccgctcactgcaagctccgcctcccgggttcacgccattctcctgcctcagcctcccgagtagctgggactacaggtgcccgccaccatgcccggctaatttttttatatttttagtagacaagagcacttattaagtagtaggataggattatttgtttttctttatatttatttttcaaacgttcttcaacatttggttatgtatttgagggtgtataaaaaagaaataacaaaattaaaatacagaatgggaataaatataatctcaagaagtactaatggtttggctttgctttacttcccactctggcaaagaaatacataaataaaaagttacatagcctaagggtatcccgatgggaaaaggggaccataaacactcgtgagtgcccagatatttatttattcttgctggattctatcacctatgaaaaatatgtttagttaccaagtgttcacaactgaaaatgcaattgggcacattaataagcatatgtgatttacaggcttatattttataagcagaagtcaagactttgctgcattcattgataataacaatagtcaactattactaagggctaaccacctgcaggtactgtttataagcattgtaggtattagctcatttaatcctgataggaaggcagtattattaccccatttcatagatgaggagattgacaagcaaagaagcaatgtaatatgatccgaggtcctattaacaggttctggaggcaagcccaggctttagggcctattttatctattataattaactgttgctcaaatcaagaattctaaaactcccctaattttgtgtatattgtgcaaagaacaagcaagaccctcaaactggttcaccacttattagttgtacagtcttgtacatttatgtatcacatctgcaaattcctcatcaataaaatggtgaataatacttctctgacctacctcagaagttgtgagaatctgatgggaaaatgagcaggaaagcccatcaaagctataaaacaatttacaaatgtaaggcagtattaggttgcaccctctaaacactagtacactagtcatcatcacttacacatgacagtaaaatgcaaagaaaatagcaattattttggtgaagtatggctctaaactataatattataaactatccagtctgttaataacacccaacataaaaccaccactgattaatcaataaaaatcatgctacagtttcagtgaaatgtactctcaaacgaactcccctgactcacgttcattaattacctcaccttatttgatatgttccagcattttctggaatgtattactctcaatctttagttatttagtaattgttttttaattttaaaaagttcaaactctacattctctatgatatgatatcaaaagttcaattgagccactcagttttcagtttccctgactcaactttttggagttttataattaattatattccattattactgatcatcaattagctcaaaatgttgctgagatggtgagcatgctgaagaaagcagaatttaatgataatttgagaccagtaggacactaaatttctctcttgttaataattaaagtagataacttatgtttttatttatagcttccagaaatatccggctcattcctgtgcactgccctgtcagctaatcatcagttggtcaggatctgacttaggccgttgtgtttaattttgcacacatgcctttaactgaagccattaaatgcagcccaaacaaaggttaaagcaagtgaggtcatcaccgtgtcttctctgaaactttccatctggtcaaatgcttgtacatcataaatatataaagaatgaaagggataaaatttcaacttacctgtttcaatttcccagatataaactgagtcatctgcacatccaacaattaaaaaattctcaaccgggtgccattttatcatcctcacaggaaaaaggtgcttccgggcatgcaggaggcaactctttccctcaaggtgaaggagagccacggaatggtcaccgcacacacagcaaattatctgctcaccccttagctgtgaaaaaacaacatgcttatgtaagtaaatagtcaaatgctttctttatgagtaagtcagatttttttctcccagtaacataaaaaagttttgttaaagccccatttacaaaaatgatatttctgctttctacagcacctttcatgtaaccctctacagaggagctttaaacacagagtggagtctaagctcaacaacttcacaggaaggtcaaaagatgaatccaggacagatctacttataagataaatgaaggacttgaccatcactcagcaaattcaggcagcgaggcagacatcggaaataatgcagaataaaataaaccccagaactaatttgttgccacaaaaagaagctatttgtagacacaagcttaggcccaagggtatcatgagctgatattttccacttaaagcctcaaaatgtgatttggtgctgttcccagaactatacaggttctaatccaaacaggaaactcagtgtagacacagtctaaaagaggtaagcattagatagctccaactgaatgtacagcctcaaagacataaggaccaaaaataggctcccaggacaacaatccttaagatactttttaagaagtcagcatgtggttaccttgaacaggttacgacaattactatccaaggtggattctaatgatctagccagaaatttggctgttttgtttaaagcatcagtttggagaccttgagacacccattactcatcattaacctctctggaggcggggatgcagggaggattgggatacatgttttctttcctaattctttattaagtgcactccagaaatcgtaaggaaaaaaaaaatcacaaaatggcaggtgtgatagatctggagcctagacttgcagaacggatcatatgtcatttttccctaaccattctatttcctggagaacctgcccatcccacggcttctagaacaggcagcccaacgtgctccaggaaacttacatacatacacacacataccgtgtgaacacaaatcttatggtcaggaatagactatggagaaataatgtttataagccaattaactgacttaaaaaatcattttacctgtgttaccatgtccttttactacagaggaaactcaaaagttggttgttcatgttttttttaagtcaactttacaaaagctgaatttaagttgacatttcatgagaaaattctacctaaagcgatttcattttgcccataacaaggtagatgctcacaaacttattaaagctcattctctgttaaataaatgaataagcaaataaaaacccatttaagaagaaaatgtgctgggcacaatagctgatgcctgtaatcccagcactttgggaggcagaggtgggaagattccttgcacccaggagttggagaccagcctgggcaacaaagcaagatcctgtttctacaaaaacaaaaataaaaaacagtagctggactacatgcctgtagtcccagctacttgggaggctgaggcaggaggatccctggagcccaggaggttgaggctgcagtgagccatgatcacgccactgtactccagcctggatgacaaagtgagaccctgtctctctctctctctctctctctcacacacacacacacacacacacacacacacacacagaagacaaatgtaactatttatcaatattattataaaaagaaattcttgacaaggtcttgctctgttgcccaggctggaatgcagtagcatgatctcagctcattgcaaaatggaagttattgaaggcaaaagttaatttctaatttatagattcctatattgtttgacttgtttttgccttgagtatctacttttttaaaaaaaagataattccattaaaaatgaagatatagaatgagaggaaaaaaatagatgtaagtacttgaagagaattaagtggttgttgtaaagctaagcattgactaaatctttgctttagagccaaattatccgtctaatgtaagttataataatactacaattcatatagaaagattagaaataaatatatatgaatcatccagttgtattataagtacatagaactcatgtttttcttttctttggaaatatgggtcatttttacttgtcttattaagtattctataatttatataattttcaaatttagatgttatattttactcttcgtcttactttaaacttctctggtgacatcaaaagacttgttactggaccagcttccaaaaagaatttatgcaaaatttcttcagtaaagatatcccacaagatcacacatgagtccaggtccccagacaacatccaactttggtctaatttcgaagagagaccatgtggatagagtaatgaagtgacactttggtggtggcctttaagaactttatgagggggagaatctgaaaaacaatgaaacaccaaataatacagatgttatttttgttcagaaaatcgtcccaagattctcttctataaaattttaacataaggaaattacatataattaaagcatgcacttggctaagaaaactagtgaacatccttagatcatcttgaaaaacaagtgcctcaccagaagccagagtatgcttttgatgaagcactacagttagttgttcaaagtctattaattctaggccaggcatggtggctcatgcctgtaatatcagcagtttgggaggccaggatgggcagatcgcttgaggtcaggggttcaagaccagcctggccaacatggtgaaaccccatctctactaaaaatacaaaaattagctaggtgtggtagctcgcacctatagtcccagctacaaagtctattaattcttaaggacattagtaagctaccaattccagcgtcactgaatagtaaacactgctctaaaagagtgaatacttcgtacatttacctccacaaaaataaattcagaatattacttattttcattcatttttttttttttttgagacagggtctcactctgttgaccaggctagagtacagtggtacaatcatggcaccataagacaaaacttctattcctcaagttccctgggctcggatgatccttccacctcagcctccctagtagctgggtccacaggtgagcgccaccatgcccagctaatttttgttttttttgcagggacagggtgtcaccataatgctcacactggtctcaaactcctgggctcaagggatccacttgcctcagccttccaaagtgctgggattacaggcggtagccaccgcgcccagcccgtcattctttaaattagaatgactaagtctagtatacaagaaaataaaagtttcaggaaatatttttgctttgaaagatgttagacattacctaattctacctcttggctttacagataaagcatctgaggctcagagaggttaagtgacttgcatccaagtgtgaaaaagcaaagcaaaatgtttaagagtacagcattgctgttaaattaatctgccttttctccctgggtctatcacttactagatatgtcaccacatctagttgccttttccctcttaaccacagatgttacatctgaaaatttaggataataatattccttacttcggacaagactgttgtgtggaataaataagataatgtctataattttgtagcactctgcttggcacttggtaggcatatgggcatttcaaatcacagctgtatgagagcacaggactactgacacactactgtgctagggggttactcttcccactaaccacactgcttcttccttcatcattagctaaactcccccaaactggaaagaaccataaaccacaaactctctttattcaaaatgaaaataaacatcaaattattattatacttcggaaacttctattccttcaggcatatcctcactttttatctcctaacccacctggatgaatgttcattgaggtgctacaagtcaaatatggctttttcttgctttctggatattagggtaaatcagcctagataaaaactgctaggtctttgctttttcactaacttttaatggcagccatttagctgtataccagtacattacctctctttggttcattgccatttactcctccacttcagtcaatcactgaagcacaagtcagtaacatttagtaagtggccaaagatatatactcacacatctgtacagatatgctcacatatatgtacaataataatcaattctgcattgtccatagtagctaaaaactagaaaacctacatgccaattaataggcaattaaagttcaattattactaattatttaaagtcagctcataaagaatgaactccacaatattttaattagatttgtttaaggacatttgagtaaagcatgtagaatacatttttatttgtgcaatataattaaaagactgtatgttgttatgctgatatgtgcttgtacacacatagaaaatttcaagaagagtataaataaactgttattagcagttgcctttggagaaagaactggaagatcaagtaaggagaaaaaatcatttcttattgtgtagccttctgcttgagttttttttgtttttggttttggttttttttgagatggagtggagtcttgccctgttgcccaggctggagtgcagtggcgtgatctcagctcactgcaagctctgctcccaggttcacgccattctcctgcctcagcctcccaagtagctgggactacaggtgcccgccaccatgcccagcttttttttttttttttgtatttttagtagaaatggggtttcaccgtgttagccaggatggtctcgatctcctgacctcgtgatccgcccgccttggcctcccaaagtgctaggattacagggagtttaaaaaaaaaaaaaaaacctatatgtatgttttactttaacattaaaatatgtacatatttatcagcaaatgccagcaaattatttaggcctctaaatcttgtttagtgcagtctgttgaaattgcagctttagataaatcaaataaatagggtcaaataaaattcaaggaccttttactaaagaaccaccttccagaagtcttgctttggcagcattcaaagcctgggtaatgataattgtcccatcttcacagccacatattagtttatcaagacttggaatatactctgatgaagtgactacagcagttcctgccccatctttaagcccagagaaatagtcaataatactttgtgacatagtatcatgcttatcaaaattatcttgaagagtccaggtggcagttactggtatctctaaaaagaaaacagacataaaaagaaaatttggtttatcagtacatcatagacatggaaaatatcaaggcaccctcccttcaaaaatatgaatacagtgttacagcctatcccagattcatattgccagcattcatctcttgggaagttcaattgatgttaacatgaattatattggttatattagtatataagatccataacctttgtgtgtgtgtgtttttaattaaaaaaaaattttttttttgagaccaagtctcactgtgtcacccaggctggagtgcagtggcatgatctcggctcaccgcaacctccacctcctgggtttaagcaattcacctgcctcagcctcctgagtagctgggattacaggtgcatgctgccatgcctggctaattttttgtattttagtagagacggggtttcaccgtgttgcccaggctggtctcgaagtcctttgctcaggcaatccacccacctcagcttcccaaagtgctaggattacaggcatgagccactgtgccccgcctaagctttgtgtttatacctgctttcatgttgtcatttaatacgtagtagtacacaataaatttttcttgtttgtggtcccatgctgctcaacttagaagaacaatgaattaattacaaattcattctcagaagacatgttactagaaaaggaaactgacttacctctaggagaaccatcaaacttggatacaggaacatcagggatgtgccacaaagtaattcttcctgagacttctccagagaaaagtaccttgtaaaaaggctctttcctttcattcatgtagcccataacaaagggacggctctgttcctaaacaaaaagtgagcttttatgtaggaaatattctaactagagagagatggccactgtttttaaatggagaaacaagacttaataactgaataaatcttttcaatttatttcccactcttttgacattttcaagtaaattaaatgaaataatctgtgatctaggactaaagaggctttataaaacaagaagcaaagtcatagacctcagaaagtcaataaaagtatctaacatttactgaccatgttatatgtgcgtgtgtgtgtgtgtgtgtgtatatatatatatatatatatatatatatatatatatatatatatggctatgtgtacacattactgcaaggggctttctacatattcagttaaataatcctcacaataaccctataaaattggtactatcattgttttcattttacagacaagaaaacttggaatgaagagattgatttgtctaaggcgattagaagaagcaatgggctttgagtccagtcattgtgattcagcaacccatgtcttgatgctaaagatgtccactgagaaggcttaatttctttacagttcctttatagttctaattgtcagttaaaacagcaacaagtaacatttgtatagtaattttgttattaatatgttttctacattttgttgactattttcagattgaacatacttgatttctgatttctcaagtggccacaaaggaaaatgattccataatttataatggtgtgtatatacatatataatgttatacattatataaattatgtataatattgtacattgtatctaaattatatataacttatgatcttgctgaagcagaatatgaatattgggcaccagcgtttttaaagctatgccttcactcatgaatgcatttagagcatccctagtccttctcagggcagtatagctgttcttcgggcaggtttgtatatagagattatgcataagggatcaaaatcatttaagcgattacaaaaacaaaacccaaactctctttggcgcagaaataaaagtcatcctaaaaagaaagccaactgctggtgctagaattaaagaagttcaggaaagtgatgcttcctagtcagaaaatacatgctttaaggtctggatttagacacattagtgaaaaattctattcattagtgattattaaaggccacgatattgctacatttaatcttcacaacaaagctatgtagtaagtaaacattgctattatcctgatatgaaaatagggaaactatcacagaaaataagaaaccaatccaaggtcatccaaccaagacgtataattaattccctatagtcccaagaaataagagcatcacagaaaatggttccaataaagtcagtttctaaatgaatttttttttttgagacagagtctcgctctgttgcccaggctggagtgcaggggcatgatctcggctcactgcaagctctgcctccagggttcacaccattctcctgcctcagcctcccgagtagctgggactacaggcgcccgccaccacgcccggctaattttttgtatttttagtagagatggggtttcaccgtgttagccaggatggtctcaatctcctgacctcctgatccacccacctcggcctcccaaagtgctgggattacaggcatgagccactgcgcccggccaataaatttttttaagactcagagggcactttggtgtcttacagccatgatttttatagctatttgaaatggtgttgataacatttggttaaattggctactcaaactctcccacccttgtatgcacttagaactgattgttccaactccctggttattctgatttgaaaaggaagctccaagaggctgctgggttactcgagttggtggcagcacaactcctcccagctggtgctttgcctctggcagctgaagttccctgttgctctcatcccctctgccttcaccttccacattgctgcttctcacttgctcacactcaccgcttggtccctcgctcctcctcctcccaaacagttccctctagttctgctattcacctgaaaacttcttcatagtcccttaccatgtgaattccgatttttcatcactgtgtccatcataagagtctccaccacccaggaggtaataaaacatagccattagcactgaaatccctggggctaactgcctggatttaaatcctggctttaccacatcctagctctattgaaagagcaagttggttactgtaggcaatttagtgcacctcactgtctcattttccctaactgtgaaataagactaataaaagcacccgctatatgggattggtgtgaggattaatgagtagataaagataaggtgcacaggatggtccctgacatttagtccctattcaattaattttaacaattctggtaattcttttctcagaacaattaagaaactcactccaaaacccattactggatttgggctaaaccacttgaattcaaatcctgggaattcacctctctgaacatcagtttcaacatgggatcttggtggcaactaaagtaaatgaggttgtttgtatgtttgacaataataaggactcaaatgaagtttttgtcatcatcatcaccatcatcatcatcaccattactcttagttcatgcacacacattttttatttgcaattcttaggctgtttctatcccagctattcccacttcagcacagcagtcttactctgtggctgagaccctgggaaaaccagttccttgtctcaatagccaggacccctgcaccacaggcctcagcaattaccagctgtgatttgaagctagggagatcctcatgcagctgctggaaggaaagacgaatcctcattcttaccactgtaactccatcagcagatatgtacatgggcattacaaacaataactgagaacctgttactgtcaaacctggagatttaattctatggtattactccaaaaaatgagttcagacaatagtacctgcttacagagcagtcttttctaagctcactgaatgtatcaaattcatctcttcatcctaccacaatgccttcattacttggtaactgcaagagagactaaggactcttacatttagtgaacactagtgatgtttgaataaggggaagaaagtctgactttatgccctggataaaaggcaagtaaggacaggcagaccagctttttccagtttccaattattctattcatatttcactggcttctaggctttctcgcttttaagatacagaaacatctatggttgtttaaacaagaattactggtaaaagacctataagcttatgtcttcacattttgagaaacaaagcaaggtaacttcccatgagattagttattttttaattgttgtattctttcctcatggttatacataacattgaaattttcaggaacaagaagcccctaaagggcacaactgatcattggctttcagggcaaactgtgctttgtaaaaatgcattcaaagctaaggaggaaagaccagatcctttaaaaaataactgaatatgcttttctgagtaagccccaatactgtttttgtgatcgacagcaaaacaggaacctattactgcccacaaataattttagaaatagtggttgatgcatgccgtaattataaagtttgcttgtgtcccagtggcacttggggttctaatttttggctgacagtttcttaatcaagttttcacaacaaaacctcacagatatgttaaagggacaatcactgaactataggatttccaacagctatgctgcctaattaagcaaaccatcattctgttaaaagtagcatgcttccttggttgacacatcaataattcaaaactcttccactctccatgaaataacgtttatggataattaactgatgacaaagtccaaaggctcagggaaaagaaacactttggataacactactgaaagaaaacaactgcttaaattttcaggcttcctagaatgtcagaggtatgattcagtcaagtaataagctcacatttatattctcaactctctgccaaaagcataattatatttgttttaacaagaaaatttattcgtaagaatagctaaatacatctgaaaatgatatcaatatatgattaaagaaacagaacataaaacatttcataaagtttaaaaattggagtagatacgtaaaaatgttaacaatgttttgtcacaccatttatcacaagggtcagtgaaaaaatgtgtggtgtgtgtgtatgtgtttgtacgtatacacacacacacacacaaatgcagagagagagacagagaatgagaaagtaaatatagcaaaatgttagcaattggtgaatctaagtaaaacgtatatgaataattactacactactcttgaaacttttccaattatttgaaaattttccaatcaaaataggtaaatacatacaacaaagtaaaaaaaaatctcagtgaatatgtactgcggtgaaattaggaattttaatttctcctttctttttaacatttataattttcctataataaatacatattgtttcattataaacttaaaatacagacttaaacatagcagatttttaaagacaaagttttctctttggtagccattgataattaaacttgattttctcattaacaacttgatgggatgcttcaattcaattttttcaagcctgattctgtgacagacaaagcaacacttatccaagaaactgagtgaaacagctttgaggcagtcactcttttcttgcattaccttattttcctgcacagaagtagagcacagtaaatgaggataaatggtctctttaagcactcttccatcagcagggtatatgctttttgaaagcccactgcgtggcaaaaataaaaagcaaagtttagaactttgaggttctttattcgttttttttccccctcccactttcaaaagccggatggtaccgttcaagtttctaaactctagttagaaattgttgggttaataattacaagtgactttttgaaaacccagcaccagctgtacaagttatacatggttaatctcattcctccatcccctgctgttttgtacaaaggctgaagcctaccaagcccagagtaaatcttctagtgccaaagttgttttgttctggtttttgatcatgggcagcatgcagggatttttccataataaacctcccaaagttcattttctacctgaatgttttgtatgccgctcccatctgagcccacctgttcagcagctgatagatgtaactgtgaccatcttctgtccagatgaggattctgtgagcagcaatcacttctccaccagcaaagaactgcccatttctactaacttcagtcagcagaagggaaaaatcacaataatcataaacctaaaatatgaagttgatgcacattatcaaaggcttaaatctagtctgccaataagatgaatataaattatgatagtaataatataacaacatagtaagcgttaataacagaccatactgtactctcatattaagatgatattttaccatgacttattgacttatatttatcttagggtaggtttcaggggatacagttcatctggttatatcattccagagtgtgtacactaaacatagaaaccccaaatcccaaaatttctaagtaattttattctttccataatgagtactccaagttttacatttgaaaatgtattatgcacataaaaaatatatatcacgtaaatcttttgctagaccatatacttttaaatctttgttcaaaaatacattatcaccacacaagtaagactgtatagttttgttaactgagccagttataaaaaactttaaagaaaaataaatgttatgaaatgatggcaacttagcttttctttcttcttggaaatgtcagcgaacatattcacaagaaaataacgtttgtccctcttaaaacaaatgtagtgacaaagtagaaaaagtaaaacatctaaaaatataatcaaactatgtaggtgaaaagtatatttttagttctgaaatgtaaacaccaaattttgaaaacaatttagagctaaatattcattgttattatggtttgttactaaaattaggatatgctactacatatataatatcttgggatacaaaactgttgcatataccatgatattaaatatgtagtagtatatcctaattttattaattagagagttaaaaactgatatgtcaggccgtgtccagtggctcacgcctgtaatcccagcactttgggagtctgaggtgggcagatcacgaggtcaggagtttgagatcggcctgaccaacatggtgaaacccggtctctcctaaaaatacaaaacttagccgggcatggtggcatgcgcctataatcccagctactaggaggctgaggcaggagaactgcttgaacctggggggtggaggttgcagtgagctgagatcgtgccgctgcactccagcctgggaaacagagtgagactgtcaaccaccccaccgccaaaaaaaaaaactgttacgtcagtcataaaagacacatcattccatgttctggtaatactattacagagaatttgtatcatatttaaatcatattcttatttttgtacaaaacaaaaaaaattacacttgtacatcactggtatttattatgttactttataataccttccaacatttagaaaataccaccaatagaagtctctcagtatatgtgcaaaatcgaattgtctggcagttcaaggactcaagaaacttggattctttttcatagacatcttgcttttccttcaaaaggaaagaaaatcttttagtactagttccaggtaattcatacacagccatgagaagacctgcttcccgtacatctcaagtagatcacaccattataaaacgaaaagtatctgagttaccttttgagtgttttgaactaagaagttacttggcaatagaagctgtgtacctgggtgatgaaataatctgtacacccaacccccacaacacttaatttacctgtataacaaacctgcgtatgtactcctgaaagtttaaaaaaaaaaaaattaaaaaatataggatgtatttcttgaaaaaaaaaaaaagctgtgatcaggaaatccacttagattcaagggctcattacatgcaaccattcaacaaacattctttggggaactacggctggatgctgagaatgtcaagatgagaataagctacagactgttagatatggcagaaaggtcaaacaaaaaaatctaaaatgatgactaaaaaaacctacagtattttattttattttattttgttgtattttattttattttattttattttattttattttattttattttattttttccttgagacacagtcttgctgtgtcgccaaggatggagtgcagtggcaggatctcggctcactgcaacccccgcctcccgggttcaaacgattctcctgcctcagcctcctgagtagctaggattacaggtgcactccaccactccctgctaaatttttttttttgtatttttagtagagacgaggtttcaccatgttggacaggctagtcttgaactcctgacctctggtgatccgctcgccttagcctcccaaagtgctgggattacaggcgtgagccactgtgcatggcctagtattttgattgcttaaacagaaaaaaaatgaacaaagtgccaacacacagcacatagaatagtacgttctcaataagtttgtgaaaatgctggatgtgtatttcttaagctcagcataccatcacaattcctaggcttcctcaaccaataaattcctaaaaagaccccagaactccttggggaagcctaaataattttgtcatcaacacacatagtatggctgttcttttgtccatcatctcaacttgtagcctgatgccagtgaatagatgaatatactggactccccagggacatgcccctcaagtttttagggtcatttgcttgccactgttcacatatactcagaaaaaagggggatttcctctgtaacgaacagagagatgttctattttttaaaagattaaaaatgtaatctttctgtgtgtgtgtgtgtgtgtgtgtaaatgaaaacatttgtatatacatggagaaaaggttggaaggatacaagccaagtgtaccaaggctcacccctgggaagatggatgggggaaatatatggaagtagaatttatacacttctatgttatttgaacttttgacaataaacatgtaatagccttaaaatttataaattttaatgaatatgcttgaaattgtaaggaaaaaagagtagggttcccaagccaacctgaatgctgttgatagatgaggaaagatcccatactttgagctcaccagctactgataccaccaagagagaatcttctgtgaaaataataaaagtcacatataagcttaccatggatataattgggtaggtaaaaatcatttcacagtcatttaagaattacgcagggctgtgtagatagaaaattttcagctttggagttactttttaactagaaaaaataaacattttacatcgtgctccaaatctgttttaaaatttcaaagtgattcctaggtataagaagagcaccactagaagcagaaccacattgcaaatcatcataaaatgaaaccttcctatttcggaagtaagtgaggcgccaacttccacttccctttgcagtcactcattacagaaactgaattatcaatactacatctagaagatacagcagggcaaaattccaggagtcctgctaatccacaacaaaacctgcttgtcactcttaaaatgtaacaagcagaacttggttataaaaacacaaattctcctctttccccctcatcttaaccttttgctgactttccaatgttttgaaccactggcatgggtgttcttagtttttcttgatcaggtgtattacagacatatcctcattaacaggtaagcataaagaagcattctttctgaatttctgcccaataatttgacaaataattcaaaagtagatatttttatatgcaatctctctactgtcagataatatccaactattaccttgaattctcatggagtgaacaatgcacatgcagttgatccagtcaggaaactgagatgatctaaaactgtgaacaacagccaaagttttggcatcaattataaggacatcttgatattctccacaacaaagaagccagccttctcctgtcatccggaatgagcagtggtaatactacgtacatggaaagcaaagcaaacatttaattatcactaaaattaacataatttggctacattgaagatttctctagactttagttttagcatatgatcaattaaggtattgaactgaatagcaactaaaatttctcttagttcagttattccaaactcctattggcactttagtctcatttgcatctcatgatttttctagggaaagagagatcgcttggaagaagtaattttattctaaatcatggaaagctcacaattatattatttctggagtgcaacttggaactaaacaacaacaacaggaccaggcacagtggttcatgcctataatcccagtgctttgggaggaggctatggtgggaagaccacttgaggccaggaatttgaggttgccgttagcaccactgtacttcagcctgggtgacagagcaagaccctgtctcttaaagagaaaaaattaatagcaacaacaaaacccaggttccttgccatagcaacaatgctgtatgttaaaaagaaataaagtatttgaagggcatttgaggattattatgccaaataagttttggaaatcttttattaaagatcaagtaatgcattctactttcaaccagctctctctgtgcagggttttatttccaaaaaaaatagaagagagttcatgaatgttacaatgcacatcagcaacactaagagtgtaaaatattttaaaacacggtcagcaccattggaatcatgcaaccacactacatatgcttggaaaccatctactaaaagccaagatttgctttaaagattgggaagtgattataaaagttatatacagagaaattaagaacctatccaccaaaacatagggtttaaaattggaaatgagggagaaaaaaactgtgtgtgctttataagacagcacatcattaaaactgaatttttacacatgtacaagtatgtgtatgttttgtagcactaaggcaatatatggaaattgtctttcaaatctgttagaaagatacaaaaatgaaagaatcagggggaaaatctgcttgaataatactttttgggaaagcaaaatgccaaaacagcagacaattactggtgatatttgaccctcatgacaaaataaaaattcaagcaaagaatattctccaaagatgtttctttagaagtgtatttgcaaatgccctaaacaagttgcagaatctagaaatgccctgaaggaagtgagtgtacttacacagattgcagtgtgcctgtaaggaagtgtagccttctccatgcactgtccattggtgacattccaaacacacatctccctagcagaagataactttgtgttattctctgtcatttccactcaattggctggaataatttttgtgccaccaagtttttctttagcagcctgatcatttatgtggctttttgttacagattttgggcaagaaaatgttgtggtcattagcagggatgacatactgtatctgtatctttttgtttgggtaattacaccctgctgccagcctgcaaaccttactttagagacaacctggcctacaacaaattgtggggatacagctatcacagcctgttagtgacagtacaacaatctttcagtggaaactgtatcctcttgaaaatgctttatttcactgaacttaaactacatattctgaaaatcacaatgcatcaagcgctgcatcttctgaggccaatgtatcatttttgtaaaaacaaacagtgccaccaagaggctacatttggtctatcatcgataacagtttatctctgcttctcctgatttgaaatcctaaaatcatccttgccacttaatatttagaaaaatattattattttgaaaactcttacttcgtttatgtattacaaagacatagttttaaaatacaaagtacacccagcatagggtagtttatatgacttcacaaaaatcagaatggctgtttcagaattgtttggtaatattcttcagtcttgagagttttaacacataagcaaaattttccatgcaagaaaaagaaaagttttataggccttaaaggagatactgccattatactaagaaacaaaatatatagactaataatgtcaacaactgtatgcatttggtgatttgcaggcttttttgtttttctaaccaaccatgggaactcaatcttctacatgagtagttcttaaaatggggcaattttgctaccccttattccccctacattccaaggacacttggtaatatttggagatatttttggttgttggaactaggaacacactagtggcatctagtggggagaggcaagggatgctgccaaatatcctacaatgcatagaacagtaccccacaacaaagaattatctgttcctaaatgccattagtactgaggttgagaaataatattctagaaatacacacaaaatattcatagcattttccctctgtttatatccagcctcattccaaaaagatttcaggtaacctgaaaagacatataattctataaaataggaggaaaaaatctctctgtgtgtgtctgtgtgtatgtactaaaaaataagattgggaggaaggtagatattgaaataatatatctcaaagggaaacaaactaataatgcatctataaaataaagaaacatattgcaaaggtaaagtaattgaaccttaagcagtcaacattataaaattttagctctttaagggatttgagcttattaacaaggtttttgactctagctatgcatcaacaaccacctgatactattccaaatattatctccagagattctaattccatgactctgtgttgggatcctggcatgtgtggttttgaaaagcacctggtcagtcgacttgtttctagcccatttctaaaccagtagctctaaattctagctatacattagacttatttgagaacttttaaaaaatactgatggctgaccatgcagatatcaaatcaggccaattaattcacattttccaggattggaacctggacaccagtaaaagttcctttaaaaatattaatgtatttaaaccatcttggatcccattgctttccctatttgtttgcttatcattttattttctatattaaatctgaaaataaaatgaaaatatatcacaaagcaaaaatttgctctttgcctatcaattttgcttaataaaagaaagcaaatttgtggtgtatgaaatggaacactgacatcttacctggaaccatataagttacataggtaaaaataagacatgaaattgaactattaaaaaacataatcttttcattttctgaagctgtcgcctaagtttgtacatagctaaaatcacattctgttataaaaaaattaaatttaagaatttttaaaaccttaataaattttaagaattttaaaaatcttaagatttttaaaaattttaaaaaccttaagatttttaaaaattttaaaaatcttaagaatttttaaaagcttaaaaattcttaaatttttatttcaatgaaaagaaaacagcagatgaaagtgtctacgacatataacattagaaaattgttatattctcactacaaattccttgaaaaggggaattttttggtcttactcaactttacatccccacctcagcacctcaataaaaatttgttccatggataaatacatcagccaccattcttccatacactttctatcttttggaaatatattattttctcttgacctcattcttatttttcatatttgtgtgcttataacactatagttttgatcaaactttaatgaagtgtctggaaggagaggagataaacatgaatgcttgctttgccatcttgcattggaagtctattacatttttcaaactcttttcccttgtcttttattatactttcattttttctttggcattctcagcctcctcttcttcctctgtctgcttcttaagtgctggttttccctagatatttgtcttatactttcttacatccttatatttcactctcttcctgggtaagttatctactcccctggcttcaggtactgttattatgctattggaagcccagagcggtttacttcagctctatatttctataggcaactagcttttagacatctccacctgtgtgactttcaggagatcacacactttcatgttcaatatgaagcatagcatcttctctctttggttcattatctcaatgaatgatatcgttactaataaatttcccgtaactcttgacccaacattttctctcacgctcccaaatgtgggtacttgctacttcaaatatgggctctgggccagcagtacccgcatagtctaggaatgctttggaaacgcaagttactagaccctagcccagacctactacatctgtattttcggtagtggggcccagaaatctctaattaaacaaactctgcaggtgattctggtgcacgctcaggattgagaagcactcacctagcggcttccaagtcctggtgccctacttctctgggctcatctcttgccagtaactaaacctttattaataagttataaacctttctattggggccaaggctttttgccttaaaattttattaactatacatatataaaaataatatagtcataccaaccttattttgattagtatacatatgataatatgtaattggaatgactattttattcagatttattctactaatttattttgtgctatttgtcccattttttaaaaaaaattgttttctttgaattaaacatttttttaattaaaagttacatactctttcttttattttttatttcttttgtctattgtttctgtagctactaaacaatacttgaaacgtaaacatataaatatagcttaaggtctaaagtcaatcaacatctttacccacctctagaacaccagaatgtgtgggatcttattactacattattatatgctattgttgaccagaatcgcgtgtgtgtgaatgggtgtatataaatatcattatgtcttataaagtttctgcagctttgctgggttttgtccaaaattccttcttccatctcaaatcttccttctgaaatcattgttcttcttactaaagaatatcatttagaaatgtgttattatacttatcgtgagtctgttggtatagtgagtacctttagtttttgtttgtctgaaggtttattattttgccccaatttttcaaaagtgtttttgttggatatacaattccaagctgacagatattttctgtccactttttgaagggatttcactgctgtcattacagttgggaagtcagctctctgcttaattaacactccttggtaaataaactgctttttctcactgtctacctacaggatcttctctttttctttggcattctgttgttttaacatcagatctccagtggtttattttcattatcctagaattttctgtgattgctgaatctgaggatgtatgcctacaaataaaataataatttgagaaaaatattaaacactgagccataaagcaactctgggtcccctctggtcaccataaaggcaaaaatgctaagtccatagccaatatctgggacttctcaaatctaaatatgcattgttgtttggaaaataatggggcaagcctagtaggagtaataatttccagtgaataaagttaagacttgctaagaacacagtagctgaagcataggtactacctgaaaagtatcttatagatacagcataagttttagaaacctcaaaagcacaaagttctagaaaattcaaatcaacttggtgaaggaggacagctaggtagactgaaactagactcccaggctcttcaacaatatttacagggctcatacagcagaattcatctttcatcaaaaatatatccattaacccctagtttctcttttggagttagatcactatgggcaaagatctgaagctgaaactcagtaacttttcagacctttttctcagttagctattatgtatttctcaattttttcatgtagccccagaaaaaaattcaccatccccaaaattctctagattgggaataaatatctcagcatgtgtagcagactttgtggcagccctggtgaatgaaagctacaagcaaaggttaaaaaaggaatgtattaggacatttcactttagacttatccaaagttcaatccctctaaatattacaattaatgatttactataagctatgaaaataggtatctctttgatacctgttcaactagccagcatattaaactattctgtttatacaagctggaccttgattcctcactattcttttggttttcagaattcagaagcgtataatttctctttgtattaaaaacaaaagagaggcttatcttgtttcaactagaaacccaatcccttattcataaatgcatattgaattgatatgacattcctgagtatattttggaaaataactcatcaggagcctagttcatagtatttcttccatcagtggaactttttcctacaggtaagtcctatttcatgagggcaagctttgctcccgtgacactgcacccaaatcactggctatgttccttttccatctctctgccaccattctactgataattgagtcctctcctctgtgagatttatttatttatttatttttattttttatttttatttatttatttattttgagactgtcgcccaggctggagtgcagtggcgccatcttagctcactgcaacctctgcctcctgggttcaagtaattctccctcctcagcctcccgagtagctgggattacaggcatgcatcaccatgcccaggccaatttttctatttttaatagagtcagggtttcgtcacgtcggccaggctggtctcaaactcctgacctcaggtgatccgcctgactcagcctccgaaagtgctgggattacaggcatgagccaccgtgcccggcctgttagttttatagtagcatcagacaagggtacaacatgaagactgtaactattaaattgttttgtaaaactatgaaagcttggatgggtttgcttaagagctcaaagtgtgttactacatgagaaaagacaaacacctagactttttcattgctgattctacaatactaggcattggtcactgaccctcacccagtaagagtgctacaagttctgatacacatgttgagatgcttaacttggtcccaatccagcaacaagagtattgagtgagggttcataatactgattacattccttgggatcatcacacaagttattcaaactttctatatctaaatgttcctatatgtgagaggcacatgttgatcacaaaggtttccttcagccctaaaattgtattccattgtagtttttaaaaagggaaggaaatggagaaggggacaaagtttacataccatacctacccattttcagcagcactaacaatgtagggctgtttagagaagtcccttgctcttgccaaacatgttaccgaagctgaatgaccaaataggagttctttcgctgaaatctgaaaataatgagagtgagcttttaaataattgtaaactgtttgaagaataaaaacaccacaatatagtattcataactctgattaggaaattctgttgtttttgttgtatacaagttttaagaaaactgatatatgtaataacaacatccacagagtaataaacttctaggtagaggaattgtgctgtagacaggttttgtttgttttggtttggtgtccatcatgaaacctccatgactgccagcctgtcttacaacagctaggttgtgaatacaaataagtctgtgttgatgcttcctctgaacaaaatgtcccctcaataatagtagcacattaatgttcagagttcagaattcaaaataacttcacaaaataatacaagagaaaatattaccctttttgaaaccaccataataccctatatggtgataggaatgtaaattggtacagctatttttaaaaacagtatagaggttcctcaataaaaataaaaatagaacttacacatggttcaggattcccacttctaggtatatacccaaagggaatgaaaccagtatctcagagaggtatctgtacccccatgttcattgtagcattattcacagcagccaaaatatggaaacaatctaagtgtccattaacggatgcagagataaataaaatgtgtcacatacagtcttccctcattatccatgggggactggttccaggacacagctgccccacaccccatgccccatcacttaagtacctaaatgccaggatgctcaagtctgcaatataaaagtattggcatatagcctatgaacatctttcatatcctttaaatcagctctagattacttataatacctaatacaatataaatgctatgtaaattgcttttatactatattttttagggaataatgacaagggaaaaagtcagtacacgtttagtacagatgcaatcctcttttctttttccaagttttcaatccacagttggttgaatccatggatgcagaagccatggacatgaagggccgactgtatacacaatggaatagtatacagccaaataaataaaaaagaaataaatcctgccatttgtgacaacatggatggacatagaggatattacgctaaataaaataatccagacacagaaagacaaatactatatgatctcacttctatgcagaacctaaaaggccaaactcatagaaacagaattagtggttgccaatggctgggggtgagggaagaatgaagtaatgttgctcaaagggtacaaacactgaattacacataagttttgggatctaatgtacacatggtgactatagttactactatatggtatacttcaaatttcctgagagagtaggtcttaagagttcttgccacacacacaaaaaatgattatgtgaggtgatagatgtgttaactaatttgattgttgtattagtccattctcacactgctataaagaactacctgagaccaagtaattcatgaagaaaagaggtttaactgactcacagttccacaggcttaacaggaagcatgactgggaagcctcgggaaacttacaatcatggtggaaggtgaaggagaagcaagcacatcttatcatggcagagcaggagacagagagtgacgggggatgtgccacaaacttttaaaccataggatctcgcgagaactcactcactatcacaagaacagcatgagaaaatcacccccatgatccaatcacctcccacggggtccctcccacaacatgtggggattacaattcaacatgagatttgcgtggggacacagagccaaaacatatcatttgcggtaatcatttcacaatgtattcatatatcaaatcatcactctgtacatcttaaacctatataattttactagttaattacagctcattaaagttaatataaaaacgactaaaattccattagtcatagactaaatatcagaccagttaccatggaggaaattttaggcttcaagtttcacttctaaattatctatattacctaaaatttctaaaattaaaacatctttcttatttatataaaaaataagaaaagatcaagaaaataagaaaacaagccacagattgagagaaatattttcaaaagttatacctgataaaggactattatccaaaatacacaaagaactcttaaaattcaacaataagaaagttaaaaacctaattaaaatatagtcaaaagatctgagcagacacctcaccaaagaaaacatacagatggcaagtgaacatataaaaaggtgctccatatcgtatgtcataagagaagtgcaaattaaaaaacaatgagaaaccacagcacacctattaaaatggccaaaatccagaacattggcaacatcaaatgctggccgggatgtggagcaacaggaattctcactcactgctagtgagaatgcaaaataggacagccactttggaaaagagtacagtagtttcatataaaactaaacatattcttaccatacaacacagcaatcatgctcattgatatttaacccaagtaagttgaaaagctgtgtccacacaaaaatctgtacacaaatgtttacagtagctttatccataattgccaaaatgtgatagcaaccaagatatccttcaagtggtgaacagataaattatggtacatatatacaatgaaatattactcagcgctaaaaagaaatcagctatcaagccatgaaaagacacggaaaaaccactgatgtgtattaccatatgaaagaagccaatctgtaaaggttttatgattccaactatacgacattgtggaaaaggcaaaacttagcagacaataaaaacattagtggttgtcaggggtttgtggggagcaggagataaatagatggggcacagagaatttttagggcagtgaaactattctgtatgatgctataataatggatacaccaacctggctaacaggacgaacctcgtatctattaaaaatataaaaattagccaggagtggtagtatgtgccttaatcccagctacttgggaggctgaggcagtagatttgcttgaatctgggaggtggaggttgcagtgagccaagattgcaccactgcactacagcctgggtgacagaatgagagttcatctcaagaaaaaaaaaaagatacgtgtcattatacatttgtcaaatcccataaaacgtacaataccaagagtgaaccaatgcttgatgatatgtaagttaattggttgtaatatatatatatatatgtgtgtgtgtatatatatatgtatgtgtatatatatatatatgtatgtgtgtatatatatatgtatgtgtgtatatatatatatatatatatacacacacacactgctctagtgtgggatgttaatggtgagggagactgtgtgtacacgtgtgttgggaggggggcggggctgatcaggtatttctgaaactccctgtaccttccagtcagttttgctttaaacctaaaactgctttcaaaaatagtctattgaaatactttttaaaaatatcttatttatcttcctgcctcagaaatactaaaattaaccttcctacattacaaacaaaattttaactaaatgattttttaaaatatcgatgctggccaagcatggtggttcatgtttataatcccagcactttggcaggcagaggcaagaggatcacttgaatccagaaattcaagaccagcctgggcaatgtagtgagacctcatctctacaaataattttaaaaaattagctgggcatggtggcgcacatctgtgatcccagctactcaggaggctaaggtggaagaatcgcttgagctctaacagtcaaggctgcagcaagctgagctcatgccactgcactccagactgggtgacagagtgagatcccatctcaagaaaaaacaaacacccaattttaaaaatatgacactaagggctaattcccctatctcatgtgtgaaagaagtaaattcctcattattttgtaaaacaagatgatgaaaattaaattacaaaacagaaaacatgtaagatctcctcagatggagaaagttgtcaataataaaccaaacatcgccccggcacggtcggtggctcatgcctgtaatcccagcactttgggaggctgaggcgggtggatcacttgaggtcagatattcaagaccagcctagccaacatagtgaaaccccatgtctattaaaaatacaaaaattagctgggtgtagtggatctcatcactgcactccagcctgggtgacagagtaagactctgtctaaaaaaaaaaaaaaaaagaccaaaaattgaatttgaatggctagcaaatgtcttgtgggtaataaaaatctattttccaaatgaattaatatctattatgttttttctgaactatacgaacatatgtagatggtaactcagccatattaatgaggacaaattatttcatgacataattgttctctgcctttgtatcatttctatcataatcagaaatatttccttcttaaaagagctgttgtcagactaactttttagtgctacaagaagtgttttgtggttgattagaatcctgcacaattcaagttcgcgctacctttttcctgagaagtccagaaggttccatctcagagaacaacatactatctttccctgtcatcacactcaggggtgcatatccctgtgcatttaatccctttccagtctattagaagccaaattaagcaatcaatgagggaacatcaaggatattccctcctccagagaaaatctaccatggacaaaatatcagaacagaacatcatggcctttcatatgaagtcctcattctattactaaatccccacatatatttgaataagctgtgacagttcactaaaatttcctcatttaccatattgtagaactgctgtgaagaataacaaaattcaaaaattctacaatcacacttagtcactgtcatgatgaaatctgcaagacctttcctgttgtccattagctctacttttatgaagcattggttcctcctgaccaccaccatcacttccaggtacttccaacagcacaatgggagactgaaaagaacacacaacttgatgaatgtattagtctgttttcacaccgctgataaagacataactgagaccgggcaatttacaaaagaaagaagtttaatggacttacagttccacatggctggggaggcctcccaatcatggtggaaggcaaggaggagcaagtcacatcttacctggatggcagcaggcaaagagagatattggcagggaaactcccctttttaaaaccatcagatcttgtgagactaactcactttcacgagaatagcacgggaaagaccaggcttatgattcaattatctacccctgggttcttcccacaacatgtgggaattgtgggagatacaattcaagatgaaacatggatggggacagagccaaaccacatcaatgaacatctaccgtattccagacaaaaacacaatcacagagtagtgtttaaatccccatttcacaggtgaggaaattgaagctcaaagaatataagtcatttgcccagtatcacagtgttggtaaatatcagggctggcacttgactaagatctccattctttgtctccacacattgctcttcttcattttattgtgtttccttctgagtattagacaggcggaagagcagaacatagcaatactaagggaatctatctgacaggatattcaccacacctttctctatgcttttaagaaaacaagcaatcaatgccagaaaacccaagtaaagaatttgctgccacgggatttggagaagctcctcactggtagacttcacaaaattctggggaaactagagggctatgggagtcagacttcgaactcaaaggcagcatgtataatctaggcatgcagtgagaagcccaaggcagggagacacttattctctagctcccctgtgccctgccatcccactgcacatggtcaaggaaagactgaggcacatcttcaaacccctattgaatacttgggcactctgagacgtgcagaacttacaccaccttttttccttccctattcctattctccaatcccctttattccttatgcaaatgaataataccatcattctaccagtcccatccagctcccaaaccctaaatctgggaaagatccttggctgttcctgctcccttaccctacatccaatcagtttctcagttctgtccatcctctcttcttaatgtcttttcagttttcatctcctcttcatcctcactgccattcatttggtttatcctcaaaacctttcttgagtaaattacagtagaagtctgctagccatagtccctgtccctgatgtcagctccccctttctccaatatgcccttcacattgctagcaagtgatcttctaaaacccaaatacaattgaatagtattatgtcatcttctcacataaaatatcctctaaagcccttaaaatcaccactgcttttaattatcatgtgctattagctctatctagtgaaaaaaaaacaaaacaaaacttacaaacccctcagcctgtgggattccatgctggacccatcctgtcctttccagatgagcctgtcacctctaattcaccatgtatgctccaggtctactcaactacttttaccagttcccttaaggcaaaatgctcatgtctttcacacacacttgtcattgcctgtgtttgcaaactcaccttcaactcctgtgcattctttagaactcagctcaagcatcactctcagaaaggctttccattcaaaaacataacaggataccacttaacacccattagaatggctattacaaaaaaaaaaataaagtaactagcactggtgaggatacagggaaattggttgccctgtgtactgcaggtgggaatgcaaagtgtgcagccaccataggagtgcctcaaaaaatttacaatagaattaacactccataaatatgtacaaaattatgtgtcaattaaaaataatttcaaaaatagaattactacatgaaccagcaattccacttctcagtatgtacccaaaagagttgaaagcaaggatacaaactgttatgtgtgcacccatgtgtatagcagcatcattcacaatagccaaaaggtggaagcaacccatgtatgtatccatagatgaacagataaacaaaatgtggtatatatatacagtggaatattattcaaacttaagaagaaaggaaatactgtcatatgctccagcatgaatgaaccttgaagacattatactaaataaaataagccaatcacagacaaatactgtatgattccacttacaggagatatatagaatagtcaaattcatagagatagaaagtatctcagtgctttacaaattcctatttacaagtctgtctcccatactggactccgagaaacttggaggagggatttgtgcctagaacaaaaagtacctgtgtagtttgcctaatgaaagcgtaaataagtgttcctggtttgtttttccattttgcatggtggcaagcgagtgtttaagaccacagaacctgatgtattctcttacctacatacttttggagggggaaagaactttccaaacttagtatgaagagaaaataaatggctccctgttcactttacaacctcccatgcccgacttccttctcttcttcctaccatcctctccctgagatgctgccctacggtgactcagtcaaccatgtagttacatccttttttacagtctcttctgtcctcaaggactcctttttttctacccctacccaaattattcctttatatacacattttttaaacaaaaataaaattaaaccactaagtattaacccattaatctactcacttgaccaccttatggataacaagaggatttgttgagaactgaaaagtgcccttgatttttttcagtctggagttttccctgctaatagttgattagttgcaatgtgggggggcaagattcatgggaaaataagagatgctatttattcagtctggctctatggttagccgtagaaaatgttcaggaaaatctttacatggagtatctcacattcatacgaatcaataacttctttgtgtaattaacttttgcacaatgtcctcacagtgaatttcaaaaacacaaagctgatcccatccccaacttaaatctcctctatagttctcgagaattcaatataaattccttcacttgtcatctcaacttctccacgcctaggcccgtcttcccctctggccttacctctctttgatcctttttcacacctaggttaaggcaacaaacagctcctccctttcctccaagcacaggcagtctccttaatgtagaataactttgcttcttccactctcaccaatctaattcctattcccagcccatatctctatccctggatttctctgtatcagcactctgggcatttggaatggaaaaattatttattgtgaggagctgtcatgtgcactatatgacctttgtagtatctctggctccacccactacatgccaccttgtccttcaattgtgacaaccaaaatgtctgtagatagtaacagatgtctcttcggaggaaaattgctccctgtaagaaccactactctgaatccaagcagaagacttgctcctaagagacccatggcataacttctccactgaatatggagtgcagaccattccctgcttagagtgccttatatcataactgtgccacagtagccagtttttttctgtactgcactgtaacctcctgggcagccagcaccaggtcttatcattcacatttgaatttacaaatgagtacccaccataccacacaacttacagcatgcactcaacaaatgtatgctaaacaaaagttgaataaatattagcaatgcctttataaatatgaagatgctagaattccagatttcttaagcttatagtgacctacatattattacacaactattctagccagaaaataatacacttaaacattaaaaataagtaagatattttagtcacttagaagtttgtgtttaaactataatagaaaattaatgttttaattttcaaagggagccactatttttaaagcacaactgttgcaataatacccatccttccttcaagaacgttcattaacattgagctgagctggtctgcaatgcagttcttggcagtcctgtagtagaactgttcagtgatgggagatgttaattaattacactataaaatagaattacaattaattgttaatttaggttttaaagtgacaaactttaaaggctaaaaatagtctttgatctttaaaaggcttcttaatgagggcagtatactttaactacatcattagtttaattgttcaaattgggtctagagactgctagagttaagcaaatatctattctgatacgttaaatgtttatgacttgagacagggacaattaattgctaatcaatggaccaaatcctaggtgaggtcaggttctgaaatagaaggatgacaatagtaaattggatttagagcattttgatgtgatctgtaaaaatcacaggcaggcagagactaaaagaatagcaagaaggccaaatgagcagaaacacccacataattaagatattactcatttagttaatcgtggctttcaagggtgccctttgtttagattaatgagccataatttttaaaattatacttacatgcctgtagttcagttacttaaacatataattcaggatataaaatagtaaaactcagcatagcttaaaggatgataacacttagctgtagctaagattagcaatattcataatataattttcaaatataatcttgatcaatcatataatactttattttctcaaaattcagaagtaaaatcaatttattactttaataaacatctttttaacaatcatgcaaaccttccactgtcattgcagatagaaaatgcaagttgtccgtattttgtgagtggtgtctgtttcaatatcagtagctttcactaacctttagttcatgtgagagattccagagacagagctgaccctcttgacttccagtcacaatcgttcgctggtcatcagtgatcatgatggcagtgatgctgtggggaggggccttctgtccccagagtgccactgcctgcagggaagtcctcattttgggcgaatcctgacatacaaagaagggaagaagcatacatggtcatctttttgaaatttgaggaaaccgataatattacaagcagatttatgatgaccaaacttcaatgatgtgttctcccagtgctatggaaaagggtgtttccccgtcaattagaagagaaagtagtcatcagaaactgaaattaccatgcacactgctaattcatcaaacaagaatgacttatcttcgaattccttattattgttgaagagaaagaaaggaatggtctattcacttcacacccagctcttcctgtggctacatccaacttgctgcaaagtcctgctgggcctctcaagaagcatagagctgtctacatggtataatttgaagccagctttgcagactctctctccctagaaatgttacctcatctaggtaataaatacctgaaattggtgaatttgctattaaaaaaataaatcttttccataaaaacagtgtttcctagtcttcaagattcatgtatgactgtcatgatttctgccatattctatttttaataataatttttattttacctatttttatgtttggtatcttcctaaacaataatctttatgaaattactacattcatatgttagttacaagggttaaaatgaatacataagtatcaaaaaatgttatctatgaccacccaaagtatcactcagtgatgtgtgcattatattttgtgaaacactgagttaaatattctccccaaattgtcattccttcctgaaacacaaacaattttgggagacaatttagcattatatatttaatcccattaaaaatgtccgaaagagaggagaaaggggccaagcatacttcccacattgctttgagaaagtcaagaaaatgaaaaccttctgtcctgcaggatttctgttgctaaaccaccaaaagtgtaaataccaatataaatttttaaaacttatgatacatgttatttctaatgttcaattatatgtctacacacacacacacacaaatatatacataaacatgggtgtgcactgacactatgaacacaaattttccttgtagttccattgtctggaattcagtatctagttccccattttcacttcttaggtcaatatgttagtctatctagtctataatacacttgcattattctaactgccatgtccaaacaccatgaagccaaagtttctacaggaaatgttctgagcattgcaattctgaataccaggattatacatattaatcatactacaaagctacccagagagttctgatttcaataatactgtaaccagaacatggaccttcttctgcttcaaacacagagaaaaatgcattatacctatttttaagttgttgcttcctgaccaagcttatcaataagtctggaaaatcccaagcagtgaaaaactaagagaaaccagaaaaccagtacaataagtattagaactaaattagtatgtggctttttggctaggagtttgcatattaatccctatgtaaggataggaagcaaaactctcagaagtggccttgctcaatgaaagaggaacagaaaaactaccccaggaagataagaaagagtatttccaaatctcccaagaaaaatctgtcaagcctgaagtacaaatgggttgggactaaaaaaaaaaaataataatattatatataattccggaatgaatttcttcacatggggattctggagttatgtataatacttttataataattatatataaaaaattgtttccaggtcaatgatactattgggaggcttgtcagaaacactacagacctatttgaatatctaaatttttttaaaagaccatgacaagtgttaatggctaggcgcagtgtctcaggcctgtaatcacagcactttgggaggccgaggtaggtggagcacttgaacccagcagttcaggaccagcctgaccaacatggtgaaactccctctctactaaaaatacaaaaattagccaggcatggtggcacacactggtaatcctacctcgggaggctgaggtggggaaatcacttgaacccaggaggtggaggttgcagtgagctgagattgtgccactgcactccagcctgggctacagagcaagacaggggggaaaaaaaagaccatgacaagtattaagaagaatgtacagcaactggaactcatacactgacggggggaacgtacaatggaaaacagtttggcagaaataggtcagtgattgctcagggaaagaaagaacagggaacagtgacattacaatggggagtaagaaaagttttgaaggtggtagataagttcattattttaattatggtaatggtttcatgagggtatacatatgtcaaaacttaatcaaatttatactttaaatgcatttatgtatacacacaaatattatgtgtgtcaattatacttcaataaagttgtttaatgttgtacttaaggcattctgaaagacactctcactatcaagagtgaacgagatttctgtaaaacaattagccccagtagcaaataatcttacaataaaaaattataaaacattcaagataaaccatgagcaaacagaaagattagtaccccaggaactaataataagtgaacaatctaaaacatatttcaaaagaagaacaaatataataaattattataaatcaataaatagacaaaagatgaaattaaaaacccaaagaaaaaacctacaaaaggtagacttttaaaagaaacaaatattacttctagaaataaaacataatcgttaaaatataacaaatctcaaaaggacaaatcagaatagacccaagtgaagggagaataattaacttgaatacaattttcaggaaatttcccagaatacagcaagaagtcattaaaaaaaaatgaaaatgttgagtaaaaagaattcagagacattaagataaatcagagatgttaagagatatagatgctaagtgaaaagacccaatatttatctaatataagctccaaaaatgatagaaccctttcccttctttgctaattcagtcctaaagccatggaatattaatagaacagagcaagagtggagtgttggagttcaaatagtatgaggagggcatcaggataggaagacagtggagtcagaggccagggatggtgagtgaggtgtccaaatgtgggggcagctgcatgtaaggtgcagcctccaaggagggtgaagaggagtaatgtatacagggctgtctggcactgggtattggagcaggaacaagtgagaaaggagctcacataatgaggttcctcaacaaggagtgtcatgagcctaacaggggtgaggacagtgaaggaagtggccctgctgtgaggggccagagcttgggcagggtgaggaggacatcaatttacaaggatggtctggcacaaagtgttgaagcccaaggaggataggaaggcatgcacactgaggggtgttgagcatcctgagagcacttgtaggatgagaaaagttgctgcctgaaaatgtaatcagatgtagtaaaggaatacagggataagcaggattttcacatattaggcagtggacaggtccacaagaagtgttaaagccagaaaatgatcaggagggcatccacacagaggacagggtagcacgtttacaggaaattggttacataacagactgatggcaaataattagtatattgcttatttataacaggaatcagatttcttactgttagaaaaaaagagttagaaatatggaaaggaaaaaacttgaatgatccctgtggtactggagtcgaattagaggaactggtgtaaaacaaaggtagatgtaaaacacacacacacacacacacacacacacacacacacacacacacacagacttgccatctctgttagctggagtcttgggagaagcaacactccaatagcaatgagcttacatagcatctctaaatactattctctactaaaaaggaatcaggttttattgggaaactggttgattccaggcctggagcagggaaacacaagatgctactggactaaattgctgttaaaacaaggaagtgctcaaatagtgaggatatatcaaaggaacacagaagtctgcttgaaggacctcccacaggccaaaccatggacaatttgagcatcggaataaataatgttagcaacagaatgaataaatggattaaacttgctagttaaaagacaaaaattatcaattagaatatatcctactatatcttacttacaaaagattcctaaaatattaacgtagaaaggttgaaaataaagaggtgaataataatgtaccaggcaaatagtaataaaagaaaactgatgtaatactggacaaaatgggctttaaagcaaaaccactgttgggggaggtggtggtcactatataatgattaaataagtcattcaccagaaaaggataatagtctctagatactcaacagcagagtctcaaaatacataaaacacaatatagcataattactaagaaaagctggtaaattaactgtgacacggagagattttacatgtttcaattagtaataaacagatcaagcagacaacaaaaatttaaggatattaaatacttgaaccacataatttgtattagtaacatcacaaaaatatatagattcctgcatctaggaattaaataaaaatacatttcaatgagaccacgcatacaacatttataaaactgtgaccctcctggaccacaaaacaggtcccaaaacatctaaaaggattaataccatttaggaaacattatctgaccacaatcaataaaaatctgaaattgcctccttccccactcctgtaacatatgcataacacaaaagtttaaaatattccctgtctgaatgtttggaaactaaaaaaaattctaaatgatccctgggctaccaagaaaacataatataaattcgatgtagttaagactcaaaagtatgaaaacgttgtataataaaatttgccaaatgtaggttttgtattaaaaaaattacagccttaaacacataaatacatcagtaagaaaaaagacagcaaattaataagtaaataacagccaaattaaaatcttatataaaagaagagcagggtaaatacaaagaatgcaaaaggaaacaatgtagacaaaaccatatatattataaaaacaacaacatataagaaataatctacaaatgaaacccaggttttgaaaagagaaataacatgaggaaatctatggcaagtttgataaggaaggccctaaaaacatcaaaattaatatacagagaaaatgagtaaactcagatatcttaaatgagaatattattaacttaatgctaaaaatttggaaaggtaagtgaaataatttttagagaaaatatagatcacaagccttttttttgtttttgtttgtttgtttgtttgtttgtttgagatggagtctcgttcttgtcgcccatgctgaagtgcaatggcgtgatctcggctcactgcaacctccactcccgggttcaagggattctcctgcccctgcccctgcctcagcctcctgagtactgggattacaggcacccaccaccatgcctagctaatttttttatttttagtagtgatggcatttcaccttgttggcgaagctggtcttgaactcctgacctcaggtgatctgcccaccatggcctcccaaagtgctgggattacaggcgtgagccactgtacccagccagaaaacacagattattaaatctgaatgaataagaaatagaaacacaaatacttgtaaccattaaaatggaataaaatatgtaaaattatgcacacacacatttattttagcaaaaacttcatattgggtgtaatcttggggaattaacagatacattcttatatatgaaagcacataggacaaacctacataaattctcctaagtaaagcaaaatgacagctcatttaacagctcatttatatcaaaatcaacagatgagagacagaaggagaatgaagtgaagaaagtaggaacataatgattttcaactgaagtaagcatcaaaaaaaagtgaatcggcaaagagaaaggagatcaaaaagcccacaaaacctgccattaaagccgcagaatctggcagtcctgggacccttagtgtaagagcaaattggcctacatctctatcactcctgagggctccgcagtcctctaaggcccggacaattactgcctctgatggcaaccacctgtctgaataaaagatgctgagatgtccaatatactctactataagaagagggggaagtagaaactagcagttttaactatttctaagacaagagttaaatagatagtaagtttcattgacaaggaaaattcacctttggggaaaagctcactctcatgaataccagataaattggatacaagtgaagactgcaaagcaggtagtgagaaggacacacatgggcgtgttttaacattctgctcctaagaactactgctcctgactttgtattgctcttttcaccacagcttttagtattgagacaacgaaaatcaccatacaaaaatcatttgaccttcattcttggcttggctaacgtgtgcttagctaagaattaaatagtgatacacaagggaaagcttctgggtcacactgctccaaaggaaactgggcatttttttacgggcaatgtgcactttggctcttgtccaaggacttgtgtcattttttaaactttacctaggaaactagtcaaagaaattcacccaccctgctgagtagaacagtaggagaaggaaattccgaggaacatttgccaggtaattaatatatttgtaatgattaacattacactaagggataaataactcttgaggtgcagtatttatattcctattgctctggaaaattagcttctcttacttgaatctttgcaacactgtctacccagtaactagtcacctgtattccggttttgtatctccctgaaaattatccgctctgcattgatgtctcccttaatgaagtgatacacttcccccaaggatagagatcagtccttacttacgtagcatattgcctatcccatagcagaaaatattcttttctactgaaaaaaattgattcaactaattttttttttttttttttgagacggagtctctctctgtcgcccaggctggagtgcagtggcgcgatctcagctcactgtaagctccgtctcccgggttcacgccattctcttgcctcagtctcccgaatagctgggactacaggcgcccaccaccgcgcccggctaattttttgtatttttagcagagaacggggtttcaccgtggtctcaatctcctgacctcgtgatccgcccgcctccgcctcccaaagtgctgggattacaggcgtgagccacgattcaactaattttgatgcttcttccttctacattccttctgaaatatgggaatcatttcttaatcactcatctattccctacaatgcctgaagaacagtgctttgaagatagggacaaaataaatattggttgaataaattcctcttttcattatttttaagctctgtataccaaaagagagggagtggattaagagtgtaaacttgaatcaggctagacttaaatttgagccattttgtccctctgagcctcagtttcctcatctataatatgtgaacaataaagataccttacagggttgttgtgagaatgaaatgagatcatgcacacagtgtggagcagagagcaatactaataacttactactattatttttattttggctctcatacttctggataatccatatgtcaaactttttcaccataacacttttgctttattcttattcaaattaaactgacatcaacttcactttcagtagattataaattttctgagggcagagacttctgtctcatttgtctattgctataattgcagggcccagagcagtttcacaggatatagttctaaagactcacgtatgataaaacatccccccattcaaatatttacaaatgttattgtattgttaaaagacaaggaatttggagtttatggaggtgaaagtaaatcaaagcatttcacaggttaaaaacctttatagccacaggattcctaacacaaccaaattagaaaacaaaatggaccaaggtcaaagccacaagaaatcagatccctagaatcgatctcgaacaatccagatttgctatgtgtagtgcaacatacctgaaattcagagacgtacttccagggctgcttttaccatttataaccgttattaccacattgtaaataccgtaattagtaaaattaggttactaccacctgagctgcctacatttcactattcttatgaggaacaaatacaatgatgtaaacaaaagcatatgggcaaaaatatacatattatgctatcattatattaccttgcatattttactcataaactcccataggatttagagcaagtggccttggatcattaatgtaatccccccctcacttataagaaagctgatgatgagaaatgtgatccagatttttttttttttttggattaagagtcttgctctgtcactcacgctggagtggtggcacgatctctgctcactgcaaactctgcctcccaagttcaagcgattctcctgtctcagcctcccgagtagctgggactacaggcacctgccaccacacctagctaacttttgtatttttagtacagatcgggtttcaccatgttggccaggatggtctcaaactcctgacctcaagtgatctgccagccttggcctcccaaagtgctgggattacaggcatgagccactgcatctggcttgatctagataattcttacgatcacttctaattctgagattctgagaaagaccaaatgaattgtacagtgaggagaaagaactgattaaaagcttgcacatatcagaagtcactttcttcagactctttatctttccccagcaaaatttaaaaagtaaccccagaaacgtagtgtcttgctatcaataggatagaaagcaaatccatgtcttctgatatccctaataattccctaggaatctctaagtgaaaataaacctcaaaggaaaaaaccattttattaaaaactctctatagaatctctgtggtgcggaggagaaagttatgttcctgacagaagtacacctgttgtgtttcaaataattatgtgtctagacaagttttaaagaagtctttggaaaaagattacaaacctctatcatagccctcaatttataattattgtataccaaatttgagtacctgaatgatattttgggtgtctaaagcaagctggtaggattttgtaggataatttttaaatctcatctatttaaaggcaattcaaaataaatactttcactggagaaaataagtgtacactgagaaagaaatatagcattacttcttggccttttggctaagaaaaaaaaataggcatcatagccacagatagggataaagttagagactatattatagaggtcaaatgaatttctctcacggggatctctagtcacaggacaaacaacaatactgtagtacattacactttgtacgtaaatacttggtaaatacaaatagtaaataaatgtacttagtacatcttagtactaagtatattttgatattgcattttgtaacatataagcaatgtaatcaacattttatcatataatcaatacagctatggaaataattatataaacaaccaaacatacagacataaaacttctcttaagtaactctcaaataattcctacacaaattcttgactgcagcctactcagataccacactggattctcaggatgaaaggatgaatgggcttcaggaagctcacagccagtaggtaaaaaaacaatgtaaatgaattacttgctagttatgtagttgcatttatgtatatcctaccattttcacattatgtatgtatacaattttgtcatttcttggtggcataatgaaaaaaataattctaagaaaaaatttattttaggtgtaataattatgaaagtgttaaaaagctgatttttatagagtttaatttatagagtttaattatatatagatcactgcaatttatacataacgatgaaataaaagcataatattaaatttaagcatgttattttagtattacatatttaatatagattgaaatttaggtatatatcaaataagaccaaaacagcatttgtgatatattttgggacttcctaccttttatagttaataaagtaaaactgttcatgtttataatttccacatttgtttctaaataagagatgtttcaaatcgttacttgcgaatgatttttagccattcgaaatataggaagttcatgaatatttttactttctagaaaaagccatatgcaatgttccaaatcattaggatttccggttttaatattgatttttaaagtactagtgatagcttgatattccacataaaaatctttatcaggccaggcacagtggctcacgcctgtaatcccagcactttgggaggccgagatgggtggatcacaaggtcaggagatcaagaccatcctggctaacaggtgaaaccccgtctctactaaaaatacaaaaacttagccgggcgtggtggtgggcgcctgtagtcccagctacttgggaggctgaggcaggagaatggcgtgaacccgggaggcggagcttgcagtgagctgagatcgcgccactgcagcccggcctgggcgacagagcgagactcgtctcaaaaaaaaaaaaaaaaaatttatcaaatgaatcttctcttcagatcaaaggaataccttcttgtagtaaatgtgcagtaacgtttctgttttcattctcattgacacaggattttagtaacggagttccctgtgctcctttctataaccaacactctattgtgatacaaatcagctaaatcagggcctcccatcagcatgccatcgtacataatgagctatgaagagtttataggggtgagaggaactgaaactttcaacctggtgtatacgaaaataattattttctatgtttatgctttgatatgaagaaggatgagaagcattgaattacataaaacttgtctagaaatataaataatttaaagccgtagagggctcaaaccattattgagctcacaaaactatatccacgtctaagaaataaacctcccagtaatgcagtcctgctgatagccactgactgttgcgcactcacaggatgacctgccagctcccaaactgttctgctttaaagtgaaaatttctttaaataatatattttgaaatagaaatagcaataggctacctactctagcaacattaacttcccaatcacctcctaaaccatagggcctctcaaatcaccagcatggggacactttgcaaaactgtacattacagctggaaaaaggtgggtatgtcttttcattgtttgatccctagtccctggcacactgcctaacacatagatgacattcagtaatatttcttatatgatgtgtttgacctggatactgaagcaagagttcactagaaattggaagagatgtgaagaatgtaaagctgaactcttattctgctgatgaggaagtggaggaaaggtggtgtgaccttcctaggaccaaagcatagtcttgctctggaagaagtatattctggggaacgtaaccaccccagttcctctcttcatgttctaccaaaatacacagaaatataaagtttctgattctgagttcatcattaggttgtatccagcatgccactatttgtattattttaattcaaactatactttattgtaaaaaaaaaaaaagggcaagaaaatattaatagaatgagtcagataaagttttgccttcctttcccacaccttagtaacttgcaaatattctttgagcctcagttttcttatctataaaatggaaaaaaaaaattaccttggagaactgatgggggtataggtgattctgcatagataacttttatcattattccttgttcataatcagcactcagcatatggaatgaattgactggatgaggcaatgaatcactataattttgtactgtggatagagattttgactatcactttctagcaatacctttgagagtgtgagatttccttcctttacttttacagtattgacactacagtttcttttcttgaaaatactgtggctatatgctggaatatttggccatgaaaatatacaatttgttattattacttctaaactatatgatgatctttaaatcaatgactccaagccaaattagggttgtcagatttagcaaataaagatataaaatgcctagtaaaatgtgaatttcagatgaacaacaaataagttttgtatagtatacactatgtaatatttgggacatggttatactaaaaattattgtttattgtatgagacatgcttatagaaaatacgtatttttcatctgaaattcaaatataactaggacctgtaggcatagtagggtctctggtatctctaagctgaagacaaaaaggagccttgtagatcacaattaccgctctttccttctacagatgagtaaatgaaggcccagggaagttggttacttggccaaagtaaccaaagaaatgagtggccgagacagaaactgaaccaggtttactaacagcccatccagaacttgctccttacacacaattgcaaagatgcccttgtcttgcccatcggaaattcttagggatttgcgatgtgaaattccttcgttattttggttgttctaaaaaaagaaaaaaatcaagcaaaacaagagcaataaacctcttattcatccaggctccaacatggccttcattgcctttaaaagctgaactgacacttcctgatcctctctccataaatacaatacctggcaagaacaaggaaggacaacacgccattacagctcccatcctccagcccgccttcatcttcttccccgtaacaatttgtttttatctttctgacttgtctgagggtagcagaataatgagtatgatgcaaatgtggttttgtgggtggtgtctactggacactggaattgtttaccttgtcataaatagctgtcttcagggacacacccagacactgagtctgctttaccaacctcacaaacatagacaaatctcaaaccccttgactgaggacagcccactagaaacacaaaggataaagttcctggttacaatgcatgaattttgacaataacatcctaaccagaataaacactaagaggaaagtaaatatagtacagcagtgaataatatgagctttgagataaaataggcctgggtttgaatctcagatctgccacttatagttatgtgacctctgtgaatcccatctcttaagtggagaagaatcccacctactttcttcaaaactcataggtactgtgaggggcaaagatgaattacttaaagattttttttttccagaaaacataccttggtcatctttatcccaggagggagttttgcttttaaaagtttgagtttaggtggagataaaaagagctttggtgtgaaaactgtacactcaatttggaattgtgcactttaaaagtatgcagtttattaaatgtattataaatttaccctaataaacttgatgaaacaaatggatagataggacagcagagtaaagtggcttggccagtgtcacacagctagctagtaagtggaaacagtttgggaaagggcaaagttgagctttaggaaggaacaaagaactcaaggaaactgaggaaagctggagaaagtaactgggtgttctggtaggccagaatgagatctactttaaccgtagaagactatgaaccaagcagcctctgcagtccatagggcctgacttcagtccatgagaacataccagtccaagctggcatgggtcagcagaagccctgtccacccaaaatctatttgaaaatgctcctgaagccaaagttattattttatcaacagattgtaattagatcactccttagaaaaggtaaaaaaataaattttatgaggtcaaagagtgtccaaggcatatttaaataacacataacattctgtctggtcaacccactggaacatgactatttcggaattaacccctaaccaacatcaacgccaagctcctccaaaaatgttgttactgagtaattaactgctacttagtaaactctagaaaataatgtgttttagatagagaatatcttagcaggtaaagtcaaagctgaaacagcccagagatcaaaggaggaattaaacaaatgtgcaaattaatctttgaattccaaacactcatgacctggaacacatataaagcaaaacagccaagaaatcacatctctttcattacatggatgaggtttccatcacagctcacagctcttccagacttgtgagtcaaagattttcacagagtattgccttcaaacttcacctcctcgctcaataagctgtagtgcaacagagctgacacattcaaagaaaggccaagggtgtctaattctagtcattgtcaaggaaatgagcattagatgtggtaagagaagtatgagagaacaattcaattctttctgggtagtaacctcacttttatttatattcaattagtgaacaaacaaactgaaaaaactacaatccccttgtctaaagctcaaagttcaggctttaagaagtggatatgtatttagcttataccacatttaaccctctatttacagtgaaaatctttttttttttttacttagatgtggctaacataaacaaaaaataccattgtcctagaccattcttaagtaaattcaacaaatatctattgagaactaaatatagccaggtggtgggttgggctgcagagaacacaaagaacagaaaaacaccatccttgccctcaaaatatttaccatggagtcatctttggattaattttaactaagtattcatgctactagacaaaacaattgttttgcgtgtgtataaattctgcaaacctatttctggtcttgactcatgtttttctttcccatatccaaaaacaatctggaaaactgtttgcctaatatctctctttaaattaacttgccttaagtattaattaaacttaggtaagaagaaattaagctacataagtatatttgttttggaatcaccttaatcataagtgtccataaaatcatgaggtttaatgtacaggttatatttttaaaatacacattaaaagaaatacttgtctattaacacaaatacttggtatgtactacctaaaatcacattgggaaacgtagctttaatcctccgtcatagtcaaatcctttcctctacctttcaaaactccaccctaactgaggtagttcctcatatcccagcactcttagttgatgatcctttctttcaattaaccaagaaaatcaagtctctcatacatgagcttcctcattacttcaacattccatcactttttcttatttttaagattattttcttctgagatatccatactagtctcctctgataacatttttacctttattccagatttcatcttctatcaactcaattacttcctttattaatatttattttgtcttcaactgatttctcttctttggtccctttgcctttgtttacatatatttagtttaaaaatatttattatctgctacatgtcagagactgtgcaaggattctagggatgtagacaagaaagacaaagcaagtcacagacctcaaggagcttactggtgtctaaggagacaggcctgccctgaatcatcccatagtgtgataggtgctatgttaatgtaaatgcaagagtgtccagggagggagcacaattagagctcgaagccaaaattgggaaggatttcccccaggggagggaataaaacttcattttattgtacttctcagataattgtgtttttttacaaattcaaggtttgtggcaaccctgccttgagcaaatctataggcaccattttttccaacagtatgtgctcacttcatgtctccgtatcacattttggtaattctcataatatttcaaactttgtcaataacatttttattatatctgttgtggtggtctgtgatcgtaaatatcactactgtaattgttttggggtgccataaattatgcccatataagatggcaaacttaattggtaaattaagtttttgttctgactgttccaccaactggccattcccctgtctcctctctccctctcctcagtcttctctgttccctgaaacaaaacactattaaaattaggtcaattaataatcctataatggcctctaagtgttcaagtgaaaggaagagttgcacttttctcaccttaaatcaaagccaaaaatgattaagtttagtgaggaagacatgttgaaagtcaagacaggtctaaagctaggccttttgcaccaaaccattagctaaattgtgaatgcaaaggaaaagttcttgatggaaactgaaagtgctactacagtgaatacatgaatgatcagagaccgaaacaattgctgatatggagaaagttttaatgatcaggaaagatgatcaaaccatccacaacattcccttaagtcaaacactaatccggagcagcactctaactctcctcaattttatgaaggttaaaagaagtgaggaagctgcagtggaaaagctggaagctagctgagttcatgagattgaaggaaagaagcctcctccataaaatgaaagtgcaagatgaagcagcaagtgctgatggagaagctacagaaagttatctagaagctctaaactcagataattaatgaaggtggctatactaaacaacagattttcaatgtagatgaaacacctttttattggaagaagatgccatctaggactttgctagctagaatggagaagtcaatgcctggcttcaaagcttcaaaggacaagctgactgtcttgttaggggctaatgcagctggtgactttaagttgaggccaatgctcatttatcattctaacaattctagggcccttaagaataatgcctgtgctctgtatatggaaccagaaagcctggatgacaaaacatctatttacagaatagtttactgagtattttatgcttattgttgagatctactgctcagaaaaaataaaaaaatcctttcaaaacaatactgttcattgacaatgcaccgagtcaaccaagagctctgagatgcacaagagattaatgctgttttcatgcttgctaacataatatccattctacagcccatggaccaaacagtaattttgactttcaactcttactatttaagctatacattttgtgaggctatagctgccataggtagagattcctctgatatacctggacaaagtcaattgaaaactttctggaaaaggttcaccactttaggtgccttgagaacatttgtgattcatagcaggaagtcaaaatatcaacattaacgggagttgagaagaagttgattccaaccctcatagatgacttggagagattcaaaattccagtggaggaagtaactgcagacgtggtggaaatagcaagagaactagaattaaaagtagtctgaagagggactgaattgctacaagctcttgataaaatgtaaatggatgagaagctgcttcttatgaatgagcaaagaaagtggtttcttgagatggaatctactcctggtgaagatgctatgaacatagctgaaatgaaaacaaaacattcagaatattacataaacttagttggtaaagtagcagggtttaaaaggattgactccaattttggaaaaagttctgctgtgggtaaaaggctatcagacagcattacatgctacagagtaatctttcacaaaaggtctgagcacagtgacatatgcctgtaatcccagctacttgagaggctaagaggtgtgaggatcacctgaggccaggagtttgagaccagcctgggcaacatagtgagactactttaaaaaaaaaaaagctttcacaaaaggaagagtcaatcaatgcagcaaacttcattattgtcatattttaagaaattgccagaaccacccccaaactccagcaaaccaccaccctaatcaattagcagccatcaacatggaggcaagaccctcctccagcaaaaagtacaacttgcagaaggctcagatgatcatttgcactttttagcaataaagtacttttaatcacagtatgcacattgttactttagatattatattatcgtatacttaataggctttgatatgcactgggaatccaaaataaattgtgtgacttgctttactgcaatattcactttattagagacgcttggaatcaaacctacaacagaacccaccatatctccaagatatgtctgtaacgcctaagtttaaatcacaaatcttatacatttgctggttttgtgacccaatgagcttattttgtcatccaggaaaggggatcaattatctattgcacccagccgtaatgagtaaggagacagcatgtaccggtgggtcaggccctccagtcagtgagcctggattcaaatgccaactctaccaatctatgtccttgggaaggttattttacaactctgtgttggatttttatcaataaaatgaggataaataataatatcaatctaataaggttgatgtgagtaaataatccttggaaatcattaattagtaagcattcaataaatattagactctattatcagaaggtttttcaaatctcaaaatctgtacataaatcctgctaagtaaacaatattccgataaatgaaattcttgtcatttataattcttcattctatcattcataacttacagtagatcccatctattaagtgaattaagtaggagagataaagataaaacttcaaaagtatcaaattggcaaagtaaagtaatttaaatttaaaaaacaatttgattttttcaaaaatctgccacattctcatctaatatgagttgaattgagcctatccaaaatttatatgttgaagccctaactcggagtacctccaagtatgaccttatttggacatgggctcattgtggctataattaattaagtgaggatgaggtaatactggattggggtgagctcctaatccaatctgactggtagtcatataaaacaaggaaatgtgcagacagacacacacacagagaaagtcaggtaaaggtgaaggcagacgttggggtgacttctgcaggccaaggaacaccaaagattgacagcaaaccacgagaagctaagtgagacatgggacagaaccttcgtctcaccctcagaaggaaccaaccctgctgacactgtgatttcagacctccagcctccagaactgtgagacaacacatttctgttgtgtaagtcacccagtgggtggtactttgttatacattcctagaaaagtaatacagcatttgacagactttgtttctttcgagtcagaatgcagatctcagtaacacatgtatcaattcctgaaacatatatttaaattttagtctgaatcacacaattggtcatataccaaaatctattctctacctctttgtgtaataaatctcctttccatctacattatcggctccttgagaaaagaatatattcatttattaattcaataattagtatctagtaaagccctactaaatgaaagatgaaaaaacacaagttcctgccctctaggaattcacaacctataagtcaaatcctaagtatgtaaagaaccaacgtaaagtaggttggtagaagcatttccgaggcacaacagcaaaccaagtttcattcccatggctgtcaacgggtcatcccttacactttggcttctcgtgtaaaaatactgtgttcttccaaggactagttatcttcttccttggccctgacatctacttcccttctttcagtttcagcacaagttgacattggaagtcagtccactgtaattataacaatccatttttcctcctagaataagcaaatggcaggtactcccataggcagaaatacaggcctatatggacaaggcctatttggagaagcctccctaatgcccacgattctagtgttttctgactctgtcctagcaatcaggaatacctgccagggaagactttaaactcaccttttgcactaaaggattctagcagaagctaggccaaaacagactttcatcagcaaggctatgaatgcagaatcccaaggtggtttggaaaaagtggtagaggaagtacaggatttgaggctcataatctgaaggaaccatagcctttgtagcttttgtgaacatctttgtggattttctgtcatgagccaagataagccccacctctgtttcatagtccctatctcaccacttgattattcaaaattttctctagtcctggctcttcctactttcccttattcctaaacacatcccaccttctgtcttcactatccttgcctcttttctcagtgttaaggcacagtgttgtatactcaattcagcaagtgtttactgaatgccaactgtgttccagaccttgtgctggtggctttcctatgcattttctcaagtaatccacacatctaccattactgttattaggaaaagaaggctaggtaaatctaaatcccctggctacgactacatccctagggattacatccctagatttgtatgacctcaaagcccataccacttcttaaaggccttgaaagtgagaattcataatgatgacatcatcatctgtttacagttccacacagacaagccagtccacctatttctttaaagaaaatgaaacaaaacaaaacaaaacaaaacaaacacaacttaaattcaactacaggggtggttaagatgccaaatcactcttagactaaagactgtttagtctaagagtcttaatctgtaaaacctattcattatgtatgtggaagtgtatgcatgggccagaatgttttcaaagcatcagaacttaatacaaaaacactaaaaagctcatcgtaacactagtgtcatggaaaaagactcataatacacaatgtgagatttccacattggggtgactgcaatgcagtttatgacataagaggtagcagagggagacacgaaagggcttgcctgaacctacaggccaacaaaaaccaggcaatatgtggcactatggcactttctaaaacatcctggcctctgcttattctaagaaaaaaaaatccgtggcaaaggggatccctcttctctgcttgatttctactgaccaaagaagtcactgtccagtgatataaagaaattctgtccctagggcataaataaatatccaacacctatagttcatgggtgtataagagcctgagaggcctggaatcgatccaacccattttaactagcaagaaactacctggtaataccttgtttgtatttcttggaggagggacacaagaaacacttatttcattccacacaataattcaccacaatcagagagagcacagcaagggcaacaccatctcccagctgctgattacatcaaaggcttgcagcacaaattcaattttatgatgttaatctcagcctgccactcagaaattttctctgagggatatgatttttctctggatttcattttaagaatgattttcttcatccacaatcaataaagatatgttttcatcaaaagactctatcttggcagaattcaattggctatttcaaccccttttggtgacacaatgttaattaaaatagtttatgttgcacctcaactggaaaaagaggcagtgaaaataggagctactcagaacacatgttctatatacatcaacatggaaggcagaaaataattttctccttccccaggcgacagctattagctattcaagagagttgctctaacttggtttatctctgtgatctcactggaaaaaagaatgaagtccttcctgtttatatttttttgttcaattggaaatcaaaatgcatataaagaagatactttaaatgcttacatcccagttcctcaacaagaggagaaataattatctgtgctcctatgtggcataacggattattaggcatcacattcattatttcccttaactaaaaattaatgatgctattacaaattatttttattttcaattttaaataataattacagctaaatacattgtatttctcaaaagcaggcatatagattctcaaaagcgggcatatagaattagcacagggttttgcacatttaagaaagagaagaaaactatgcaatgcatcacagaaaataaagcaatttgttttaacagtggtttgggaagtggcagttaattaatttaacaaagatttataaagcacctactgtgttcttgactctgttctcctcttgagaatgagatgaaggccccacttcctgtcccatgatgctgacagatcatggggcctccattaccgcagaaagagaagggctaggcctggttcccacaaagcaggtagagagcgcagcagaggctgcacttaaccctgctgggaggagatcaagaagagtttctccaaggaagtccaattactgaaacattcagctggtaatttacatatccagtctaaaaaagtggggggcatagctcagtctctaatagaaaaggtagtctctatcaaccacaccttctcactcccccattctgaaattcattattcctcttaacataagaaagtggtaacaaagaaagtaggagtactgataccctaaggagaataaggatttcacaggactctgtgttctaatctatactaaagcaatctaaaaatcatatcagctttctgggctaatatggtttggcttcatccccacccaaatctcatcttgcagttcccataatccccacatgtggtgggagggacccagtgggaggtaattgaatcatgaggatggtttcccccatgctgttctcgtgatagtaaggtctcgcgagatctgatggtttcataaggggcttccccctttgctccgcactcattctctctcctgcaaccctatgaagaggtgacttccgccaggattgtaagtttcctgaggcctccccagccacgtggaaatgtgagtcagttaaacctcttttctttataaattacccagtcttagagcagtgtccttagagcagtatgagaaaggactaatacatgggccctcacaactcactgccgactcacaagcaacaaaatgtcaattaaccaaaaggttgactggttcagtaaattacatctccctcatcctgtactcgcttattgttttaaacacttactgtgtagggctttacatttctcccagttgaatttcaacttgttaaaaaaaaaagacagagagagagaggaaaagtcagtgtcaaagtaaacaattgctaccacttactgactatatgttaagttgtagacactgtgctgcttagattacgttcactgcttcatgcggtcctcataatatcaatatgcattattatcactattccaaacatgaagaaaatgagtcttggagaacataagtaacttgccgaaggtcagagctaggaaacaaacagatccatcagtctatgaaaaactcaattcttaatcactgcactatgctggttaggtggggcagaggtggtggtcagcatgtgaggacagcctctggaaatgagagcaaattctggaatcagtgttcccctacagcaatgatatctagctctgtaaatgaaaatttgcattttttagaaaagttcaaaggggcccaaatgtcttttcagaccaaagatatctctctcattttgaagataaacgtgacacatgtaaataaagaaactcctgggtccccaaagttgattaggaagaggtcttgcaaggacttcaaagctgacctgggcctagacctcagtgcacagatagatacttttagtccaggtctccaccacatctgcctgcttccaattcagcctagagaagaactgaatctacaaagcttaacaactgggaaaaaataaccatacatatagaaaaggcctccagaaaggtaccttttatgatgtagcgatagaattattcctaaatggccaggcacggtggctcatgcctgtaatcccaacactttgggaggccgaggcaggtggatcactagaggtcaggagttcgagaccagcctggtcaacatagtgaaaccccacctctactaaaaatacaaaaattagccaggcatggtggcaggcacctgtaaccccagctactggagaggctgaggcaggagaatcacttgagcccagggaccagagggtgcagtgagccgagatagtaccactgcactcctacctgggagacagagtgagactccatctcaacaacaacaacaacaacaaaaaattaaaaattaaaaaaaagaattattcataaaggacatcctctattgtgagcaacattattactaacattattattattaaataacagaaatttcgagtatatgaattgtcaagctacaaagatatctgaatgcaacaaacttgaaatcttaaaatcttactgataccattattttcaaggttcctttaagttatttcacaagtcaaatgcactcttccattccagtaggcatgtataaactagaacgtcagatttctaaagcattcagttcattgggtagagaccgttaatggaagatttcacacacagggagaaacttaagagtttattttctctctctctctctctctctctctctctctttttctcttttgagacagggtctttctccgtcacctagcctggagtacagtgaagcatgcaatcatggctcactgcaatctcgacctctcaggctcaagtcatccaactccctcaggcttcctagtagctgggattatggactgacgcacaccaccacacccagctgatttttgtagagatgaagttttgctatgttgcccaggctggtctggaactcctgagctcaagcgatccacctaccttggcctcccaaagtgtttgaattacaggcatgagccacagcgcccagcctagttaatattttcttgacaaaatacttataattttaaaataccttttccaaaagaagtgaaagctttggaactcaatataaaatattaatttttaggttaaaaaaatcactttactagacaccttcaagggcagtttccctttctcctacagccttttacattctttacagaagactctattggcacattttaatattgaaggagttaaaaaaagacaaaggaacaagtgatgtttacaaaaaaaaagctgcacaagaccaacttaaccacaagtacttgcatgacagaagtggccgctttccttttcactggtttgtaagtggtgagagctgaacagggaagaaaggaatggtgttttggcagtgacaatgggaaggggtggaggaaaacacttcaggtaaaaagatccccaacaggtgacctagtctccaatcggtgaccttgaagtcatttaacacaaaactgcggggggggggggggcggtgcgggcgggggaagacaaacgtaccatacacctacgttttgtttaacagaacgtcgttaactgtattgaaatggatacaaaaatgctataataagtggggaagatggtataagtcagcaccagtttccaaaaggaagtattcccagtgcatcaccttttccagattttgtcagcacagacagtcccccctttatcttcctgcctctcatccaaccttacaaggggcaaaagtcttgtccccgcagtctttattgccgactcagcccaagcggcagagcaaggaaagtttcgccagcccccgtccccacagccccaagctgtcacaccccagcaggcttaggcccacccggtcgttttccctgcccttgaactcagctttaaaattaattcgacctaaaattaaagttttaaaaataaataaataaataaaattaattcaatcgattccgttccatagaagtccaattcccaagttccaagaaattatcctaatagggaaaggcaggtccctaaccgtatctggggtagactcctcccaggagcataggtagggatactgcgagatgagcggctttgttcactcctgatgccacatctggaaaagagtttgaagagggacttttccagtttccaagtgcaagaacttagagcaaaggaaggggttagagatagcgctgcgcacgcccaccctctttcccggcccagctgtatccaagcgcgggccgtcccctcctgcgccgtgctctgaaggcgggaaggcgtgcggctgcaccagccaggggcagacgaagaccaccagcctgggacccggcagcccgacctgcgctctgggggtgcctgccttacctgagccgtggggcggaggagcggcagaggccaggcaggctggcgggtctcgcccttagggtcacgggtaccggccccgcccgcctcgccccgccccgccccgccccggtcctgcccccgcagcgcgcggaccgggctagctctggccccagccgcccgcgggcgggtgcacccgctctcccttcctgcaacctggacccgctgcctccctccctccctccctccttctctcacttgcggtggcggctggaaaaggcccgccagcagcctgcggttgcctgtcctctcagggctggagagaattagttagggggggttagatcaaaagagcccaggtgacgtgaactcttgaccctaggcattggcagagatgaggcctcaaccttttttttttttttttttaagtttttggggatacacagtaggtgtatatatttatggggtatatgccgtattttgatacagacaaacaatgcgtaataattacatcagggtaaatgaggtttccatcacctcagcatttatcctttgtgttacaaacaatccaattatactcttttagttatttttaactgcacaattatattattattgactatattcaccctgttgtgccaccaaatagtaggtcttattcattctttctgttttttctacccatttaccatttccacctccacccgactcccccaccccccactacccttcacagcctttgataaccatcctcctactctctatcttcataagttgaattgttttaatttttagctcccacagataagtgggaacatgtgaagtttgtctttcggtgcctgggttatttcacttaacataatgatctccagttccatccatgttgttgcaaatgacagaatctctttctttatatggctgaatagtactccaccgtgtatatgtaccacatttttcttatccatttatcggttgatggacaacttaggttgattcaaaatcttggctattgtgaacagtgctgcaataaacacaggagtgcagatatttctttgatatactgattttctttcttttggatgtatacctagcaatcgggttgctggatcatatggtagttctagttttagttttttgagaaagctccaaattattctccgtagtggtggtactaaagagcttaaacaactcaataggaaaaaatataataattcagttttaaaatgggcaaaaggccagacacaatggctcacatttgtaattccagcactttgagagggcgaggtgggcaaatcacttgaagtcaggagttcgagaccagcctggtcaacatgatgaaaacctgtctctactgaaaatgcaaaaattagctgctcatggtggtgtgtgcctgtagtcgatgctactccagagactgaggcaggagaatcacttgaacccgagaggtggaggctgcagtgagctgagatcacaccactgcactccaacctgggtgtcagagtgggactccatctctaaataaataaataaatataaaaataggcaaaagacccaaaaagacatttttcgaaagaaggcatacaaatgacaaataggcatatgaaaaggtgctcaacatcattgatcatcagagaaatgcaaatcaaaactacaatgggatatcatcttacccaaattcaaacggctcatatccaaaagacaggcaataacaaatgctggcaaggatgtggagagaagggaaccctcatacattgttggtggcaatataaataagtacaaccactatggagaacagtttgaagcttcctcaaaaaaataaaaataaaactaccatatgatccagcaattcctctgctggatatatacacaaaagaaaagaaatcaatatatccaagatcttttggtaagggatggaaggacgttttcctcaagactgcataggcatggtggctcatgcctgtaatcccagcgctttaggaggctgaggtgaatagattgcttgctcccaagagtttgagaccagcctggacaataggaggagacccccatctccacaaaaaatacaaaaattagccaggcgtggtggctgtgcacctgtagtaccagttcctctggaggttgagtcaggagggtcacttgagtctgtgagttgaaggctgcagctagctgtaccactgcactccagcctgagaaacagagcatgactctgtcaaaaacaaaaacaaaaacccaaagcagaaaacccacaaaacaaaaaatgcagcctctgaatagggaaaagccattaaaagtatcaagagtgggtgaaaaattcaacattgaaaccagcatcctagcctgttgtgaatagactaagtacctaaactgaatgactgggtggtttagtaaaatgtggggtggggagacactgcttttttttttaaggtttctcagttacatgactttaccctccaaatcctattggctccttagtcttggattctaatactcctggaagcaggttgggagagattttaactcctcctttttttcactgatatctggcttcccaaatattaaggatatttggccaggcccaagtaagatcacaggttttccatctcttaaacttcacatatcctgggtcttcctgcatgcagtgtttcctactagagcactcctctcgccttctgcatcctttgggactggttcatttccattctggattctcacttccctcctgcaggttagatgtgcttgttactcactcctaattaccttgcttcctctgtcattacacttgtcacaactgactaccattgcttgtgcattggcctcccctgcttgactgtaagctctgtaaaggcagggacaccaagcacgtaggagatacagaataaatgttgttgaatgatgtgcctgtgacagtcaacggttaaggcattcccagccatcaactctttaatgaatttccctcaccaatcctttccttctaagtctgcaggttcttatatcaaagttaatatccccacacatcccctcatccccaagccttcatcctacctcttgagcagagccttctccatagttttcatagtcgcaaatgtagaaagaggtctagacctagttgctcttgtctgagctctgctgtagctagcttagtggtcttagagaccctcagcctctctgtgtctcagatcagggctggcttatccattagggacggtgcccaggacccataataatttgggggcccacaaaatgggggcagagagaaaagaacaaaagaac

SEQ ID NO: 1032 - DNA, 27112 bp, Homo sapiens
tcaagataaatatattttaatacaatatttataaaaattaaattactgcaaaaactccacaacatcaacattttacataaagatggtatctgagaaggtcaagatgaaggtgaaaagagtaaaggagttgtactaggacaggcctcccattagacacatgctgtcttccaggggtcccaaattggatgggtgtttccagtggcatgctcttacagacagacctgttaatttccagtttaccttctcctacctgccatctgtaggctccttcttgagcaaactacagtgcgaggtgatctggggactattgtacatgaagccatgcagctttgtctgaaagatacctactcaagtaagttttaattttgcaactcttttggttaagctaattttttaaaattacaaaaaacactaagtattatgcaaatgtttacaaagcaatgactttcttaggaaattaaacacaacttttggcactttacatataagacaacattttgtggagaataaaggagtctataacaccgcttttatataactgagcaatcaaaatgtatgaatataaaatttaaaaaattgaatgagtccactctgtgaaaataaggctttaaaatcagttggaattaatgtaacctgaactttcattttaaatacatggcataaaatttaattttaaaatactcaattattataatgtgccctctaaggatggaagagaaatagtatcttttctaaagtgttcattataataattatgaaaggattttaaaaatacagaacactggaaaaaatgtatgagaaaagaaataaaagtcaccaaatgctatcatctaaagatagaatattaatatttaacaaactgtattctaccatttttctaataccatcatgttcaaagcagccttaatttagtttctaaaatagtaacagaatgtttgatacctggggctactttttaactgtgtgtttctaacattatacatttttccttatatttgaagtgtttaatagtgctcacattgctttctagcacctctggatgagccctgtgagaaagctctccaacacaggggagggaatgaggctctgacaagcacagcaagcacacacggcctggacacgctgccgaggagcctctgcttttaaccctccaggctttccaggtactttttcctgcaatatacaatggagccaatgtgaaactcaacagcaagtcaaagaatcaaggcttgcaaatgaaaatatgatattcctttgggggatatgccatatatatatatatatacacacatatatatgtgtatatatatgtgtgtatatatatacacacatatatatgtatgtatacacacacacacacacacacaaatacattcataaatatcaccaagatgattaccaaaaaagaaacacaagacaaaatttttaaataaattttttattacaatgacaggaagactccggatacaaacacatttgctaatataatcactccactggttacctaggcctagacgtacaaaaggacacccatatctcatcaggagaaagacaattttgagtttctgggtgtagtaccaagtggttatgatcaccacgtacgtggtctatccagttaactgtgtggcaatttgctatttcaagtcctctcataacagaaattactgaaatatgtggaacaccagtcaatataaagaattcatttttaaacagactagtgaatttgtgtcataaacacacttgcgtatggatattaggagagcattgcttgaatatctctaaaactatttttaggaattaaaagctttcatagttaatggtatgatattggccttcagaattcatattgataaaagcaaaccttagtcatttaacaggaatgtttaaattttagagattctaacatgcgatgccgaaaaatcctaacatttccacttagtaatgtcagggttgtgccagttctaatttcccatagctagtaacatcagaaaatatttatcagagattcaatattggtttcattagaactgataaatgctaagtatggcaactattaaaacctattgttattcttgtttctaaaagggaataataggatgtagctataaaaataatgaagcttatttttcataaacatatcataacctgagcgtccaaatagattttaacaattaaaaatgcctcatttgagaggacatacacttatttgatattgccatccttcaaaatgcttttgggagtccttataatgtccttgacaactggtatacaacaagcaagaaaatataatccatcgcctaacttgctaccttcctttattttgaaacttgtttgaagtggcttttgactgtttctaaaggagggggaatatatttatcaatcagttttcaaaggataataattttccatgattattcatattaatgctatgttagtttctaaacttcaactcaaatgtaatttcaagcagtaaaatcatattttaggaaacaaagaatgcacactttaatctactttaagggagtcacactcatttgacatctttatcctggtatgtttattcagatcatcattaattataagttccttaagggtgcagcccacgtcatttcaattacacagttctcttttctaatttccccatctcctgtctactgcatcccagcataagacctgaggctggtcccatgctcaaaaatgtttctttaattgaagtgacttgaacttctctgttagatacatacatagatatagctatatatcatatatttaatgctttatatccctttttcaattatatagttctcttttctaatttccccctctcctgtccactgcatcccaccataggacctgaggctgctcctatgctcagagatatgtttcttcaattgaagtgacttggacttccctattagatacatagatagatagatatagctatatatcacatatttaatactttatatccttttttctatggattaggcaatatttatatacataagatatgtagattaataattttgatgattttctgtaaatcgaggaactgtacaatataaatcatagtaaatagatcaccaaaggctttaatagaagagcactttatgtctattcctatttatgctgtttgatatatttcagttttagaattcctgctagtcaagcttctttctgggaaaagacctacaagagtttatacttaataaggatcaattgtgatatgctgtaagttgattccccttccctagttcacatctatatggccaacaagatcaaccttgagctaaagacattagcctcaatgtcattagaagttcaaattaactcaacagtacaaggttggtcactgttatactttgtatctcttatttgggctaattgataactaaatggaactgggtatttgttgacaacatttcatgcttagggatgagatttactgcagtaattgatccgaattaaagcatatccactaaaacaaaatatcctaaccagacaaatcaaagttggtaaaattttagattaaataccttgaagcagtattaaatttgtaagtaagtattgtgtactacattggttttaacattgtttattatataattcagggactaaaaggataggagaaaatttaaagcagtattaaatttgtgtctgtggactggcattccctgttggaaatattaacagaaaaagtaagaaacaggaatagagaatgatctaggcaatatttttctaaaattagatgaatatgaatattttcaatcagtatgtattgcattgtaatcagcatgtattaaaatcactttaatacatgttggctaaagtattagcaaatccactacagcctaataacttgaccaataacaacaatgcttttatacagtaataaacaaatggcatcttttggatttcttaatttgtccaaattcagctcctactgatgagattccatttaagacaccttgcaggggcagacctttgctatccatgaatgatgccttggctcacctaggaaaaaagcagatatcttgggttatatggtgaaatctaaaaagagaaaaaagagaaagaccaagaggaggggagggagagaggaaatgaagaatagatacagaaaggaagaagggagagaatgaggaaaaaaagaaagaaaggaagaaaggtattgcttataatttctacatgtcttttccatcctaaaataagacaagttaatataataaaaatatacttgtcttataaagtaggtaaatacactttaattgcacacattattaatagcttggggatttttttttaactgccaaggaagatggaagttttctataagaaaaatttagtttgaaattagtaaatttccataaatttcaaacagcttaattgttcttagaaaaatccacaactgcagttttagggtcaaaatttattagttgaaatactgtttgagttagagaatcaaacaagtatttatttctcagattacttggatgattgcctttgtaggctaaaaaaagccactcatttaaaatcaaattgactaccaaactaattggaacattgttccttaataactattttaaaacacatttatattaatgacatgtctatgaatagtaactttcactcctactggcaaaaactatggtttagttaaaccagtactgtatactaactgtgtgtgtgtgtgtattaatgtataattttgcattctttaaaaaatatgttgatgcttgaattttgcttttgggtaaattttaagaatgtcatattgttaaaaacaactcgaagaaagtgcttatatcttcctactggaattgctcttaattcttctagattttttttagcgctaaccataagaagtgtgttctcaatggccatgattgatcggctgctcacacattccacattttttctgcttcatgcatcatcatcagccatctccaacactccagtcctgaatctgtcctactttctgttacctgatttttgctggtgattcatgagccagaatagaaaaagaaaaaaaaaaaactccaccttggcttttcacagtatagtatcccctggaaactctgtgagaaatctagttttggtcatcagactcatgcaaatgtaatattgattgacaatgatgtatatagatctacatagataacctgccttataaaaaccacaaaaatgttctattaatggcagaatgcatactgattataaactacttcagaatgatgtggaaacacttacgtaaatgcattttgttggacttctaattctctcttgtcactattattttcagctgaagctactttggagtgcactgtttctagtgcactaaaaagaaaaattattaattttccaagccaatatggtgacaaaggcttaaggtttctcattaacactgtcataaaaattgtgaatgtcacactaaattttctatcatcgaatgagtttaaagatgaggagctagaaatccttaaaaaattattctgaagaatgaaaaacaagctttaatcactgtaaaagaaacagtaagaagttaaccagcaaaaggctccactgaactatttttgtgataacatctttcagattcagaagcaaccaggccttaaagagccaaagaaagaaagcctaatggccctaaaatctcaaaagagggagctgaaagttcatgatactgtctcagtgcttctattactagacatcaaagttattcccacaggtttcaggaaggtataaatgccagtgaaggagcaagtagacttcacagagtctaagccggaaacttcaatctgggattcacctgtgagtgaaaactctttgctaatgaattattccgaagacaagacactactcagagacacttttccctatcagacaagacctccaggttcactagcagggtcaaagtaataggaatgctctggtctaaaggtgctttgcctaccttaatggactccaggcactcacctgggtatacagcttgaacccataaagagatcacaatggcatgatgaataaggtagagtgctctagagaccaggtgaacaatcactccacaagccatctaaattgtgacctatatgcagactgcagcccatttacaaatgggtcatcctagtcaattcagtgctggagaaggagtgatgccaatataaaaataaacaatctacatactgagttcaagcccattgtattcagaggtaatacacgaagtggttatttctattttatataaattcaagcaacttggctttgttaatgacattttaaaactctatcaacatctaaatatcaacttcactttttccaaaaactttttctgtgcttcaatgtcccttttgctttctgcctatgaaaatacgttcgtattcacaatataaaaccagaagagtttaaagtaaaatgatgtttacaaggtttgcaaagaagagaatttatgtggaatgaacaatatacaaagcaatatacttgaactgtgtttgcatggaaaatactttttttcattttctatatgctgttcaaacaactgagctattcattaaaatgatgtaataattatattagtcatttagcattgcatagataaaaccatgtaagttcaatatccattaaagttagaagattgaccacattcagctttgtaactgggggattttgcaggtacataaaaatgttaaaaggaattttaaatgaatgaaaacattccagttgaaaatggtaagaatgtgcattcagaattaaatgcactcttttccatacagtgactaaggaatacactaatgcaattgtaagtttagctactgaagcacctcttctggttcgaggacattttcccaaatctcaccacctaaaaaccccaaatttgtttcttcttctgactgaggtagttaatattttccagagaaacaccactcacatgtggtaaatagaggtaactaaaccactagagtaatgcttatggttttggaacccctacattttgaaagacttgatattttgaagttaacgtttgggctttgaaaagtgaaaagtcatatttttatagttcaagaacatccctctctgccaccaaattcacacgagaaacataaaacttattttcctccatgttcaattttaagaattttgcccatcgaatactcatgcttcaaggaaacacactctctcatcaaaatctttcttactaaacaagcacctctgtcagaagtgtcttaatttcttatcacagaattttatccacacaaggagcaataaataattcatgtcactgcctctttgttgtgtgtccctgaactgcacagagctggaaggctgacagctgtgtcaggacaagcaccaaagatctgacatgacaagtgactaacaagtttctttcagttcacagtgaaagaagacaatggcccaaagtgcagaaagaaatcctaaaacaaaataaaactgcttctttctttttagctaagtgtttgctatgagcttatttccaacccacaagccctggtcattttataggactgcccagccccctttattcctcacactggcttggccatttactcctggccacggatcaatatgagcaattcttggagaaatacgatgtctccatgacaaccaagccacaaattctcagtggaaggcagtgagaccagtagtgaactctccagaggtttctaggcctataaggcaagatgtcttaaaatgcaggaagggacagaggaaaaagccagagtaattcattctttattaccagcataatgatgtccgatgtatagaacggtactcactttttgagttaagattctttatcagcacctatattttctaattaatctttctttcttgataaacacgtttgtgtgtatcaatcagatagagaatgttatatttgaatctcgctcccattccattcatattaagggatgatggaaatttattctacttttgaaatgatataaagctgatctattcttatcaaaaacaatggacatttaggtaaaaacctgattcacagatttacctgtctgacaaaatgagtaatagaaaactgtattaagacacttttaaaacctaataaaaatttggcaacattagtcaaaactaaaagtaatggataaataatttttattatagaaatttaacactaccatttatttaccctctcccttttagagtgagactcatctacatttttcttttggctattatggcaaggggtggggttaatttgctcattaaacatttctgtcactgctaaagatgccatttctcagttccatgggatctgaaagcagaagtgtggttgagaacaggcacagggcagcagtccatcttcagaggaatcttggtggagtgaagaggactgatatacaatgccatcgccactgcgcctattggggttccgagatgacttaggggacctgacatagattgcaggctgcacctttcactgaaaattaaatctcagtaactctccttggggaaggatcaggggactgtttgtttgcagctgccccctgtcaacaaaggctacaagatttggaaatctcttaactaagctgacaggccacagagaggatgaatcaaaaatatgatacatggatcagcacacaaagatgtgagagggtagagggtacacaggagccagataaaacaggaatcacaaatattaagtggaggagatatttaactctttcattcatgataataaggtaccttctagcaccttataactttgtatttatccaggaatgttcattcgacttttacaagattttttgattctaattaattagttaaggctaggcgtgtttcaaaatgaaacaaaaatagaaacagaaatccttgtataagtgtttctagctgtatccttctagtacatttctcttttatttctataaaggatatatacaaatatgtaactttgacaaagaaaagcttttattgcatgagagaagggttactattttctagactttattttccctaaacatttgacagtattcattaccatcatgctaaaatcctgtcatcccagttacagtcctgtttgtttctagaaaggtaaatagaattgtaatgatgacagtttctcttttcacccccgtctgtccacttccgctcccctcttgttagtttccattatttgaaatatttaaaatgttgccatttctctatagtttccaatctctggctctattaaccatttagcctaaaattgatgataatgaactaatagtgtcagcttcccttctcagtcataaagcctttgtacttcctccaactgaattcttgatgaaagaggaaaagataacagctccacactgtgacccctggaggtgaccattaatttgacagtgcagctgctaagagaaaacagcattacaatgtcctctcccctcacccccttccaaggaccccaaagctgtgtcaaatttatcattttatacttgactatttttaaatggctttcacctggactctcagactcttccaaggcacatctgtcaggcatgtcctccacgtcttggaagtttgccgagtttgagttgctgtcatgcttgaccgggctgactggagctattaaaagagagagagagagagagagagacagaagagagaggatgaaaaagtagtagcaaacaccattaaaacatttcctttcagttccacagatatttccagggacacactatgtaaacacaaataataaattgaaataaaatgtatcctctaagtatttattggcagacatgtaattagttgaaaaatctatagatgtgactttatcttagaagaaaaataagttcacggcatcagcttaaaagctacaaagtaacaaagtgatctcttcgaagtagaaatcgtatttttaatgcataaatctaaaacaatatagtcaattaacagcaatagaacacagagagaagaacatcaggctagtcaattagaaagaccagctctgtactggtggcaatgtttcctctcactgcactaatcacagctaatgaacattttgtgtgcattttggctctctttcattaaattaaaaactatggtaccaaacaccaaaaaaactagtactataaaaagtaaattttaaaatgtagcatgaatatacactgaaagttataataagaagggctattgtttcaaatggtaggtctccagacaacctatcatgagatattgtagaattatgaccagaaatggaaactagtacagaagtccaaaattttctataaacccatggtaccgactaattctgtttgagaaacagactgaagtttccactttttccacaagttgtaatacttgctctatgttgtctccaggaagtaacatatttccatattacatttgttctagaaaatatttgtcagaaaaagtgggccttgtcttcatgaagaagctcagtgaaaaagcaaaacaagcctgcaatagcataaattaggtcacaattaagccaaatgttctaaatatatggatactgttgagtacaatggaattttatttattacaagttgctgcaataaacacgactactgatttgataacacatgcaatgtatttataaaccataaatgcaataaacaaaatatatatttacaaatcacacataagatatgtttgttggcacaggggagtgggcctagacactgtttctaaacctctgttaccagacaagaaagcaatgcagaggctgagactgtgctacttcacacatttggtacgtgacacaacggtgtcccacccaaggtccagtcagcattagtagtgttcagacctggcacactcctccacttattttaatgaagtgtgcatagcactgatgtttgtaacctgaagaccacacggacaaactttagagaagactagtaacatgattctggtttaaatattccttctagattgtttcaccaactctctcaggacacagatatgacttctctgttctatcaaagtgccagcatagttagaatttactacgtttctaaaaccttttttgggaacaaaatataagaaaagcatgaaattgctattttcaataataaatctgatcttttcattttcatccatatgtttctgtggacttcacatgcaacagtgtctaggccatagaaggtattcttgaaggatctgtgaaatgaatgaatgaacacatgaatgatgcagaggtaccatgctaaatgtccttctgatccaagaggatatgtgctttcaattatcttttcaatggatctgttcaatttccttgttaggccaacttgagaccaaggatgcatgtttgcaaaatggtgatgtgggttagtttgtgacatggaaggagaggatgtgtggcctaagtagttattgatgcagctgagtttaattttcttaattttcttcagtttaggtcatacttacagattatttttgaatccatagattttttgtgaaatgtttaagtggtatagttaaatgtatcagtttcattcagaatactattatgttggtcaagatttcctggcctactttaatgatttttatctctatatatctttcttgataattttctgaaatatttatgttggtatttataaaaggaaataaatcatatagctaaatctattactaaaagccaatgaggtggcacctctattgatttgggcaaatgcattgcacttgccatccaacacactattctttcataatttaaaaaattcctccattcattcatttattcattccttcaaaaaatatttatcaagcaccaaataaatattcagaagatactgttctaaatcagggacctcacagaggaagaggacatggtattagacaaagtacatgtctgcaaccattctttgtggcaataaagtggtcccagaatgaactgacatcccaaacccttcaaaaaggccagaaagttagctgtagttttagctgcatgatcttcattaaactcacactagtaggtaccatgctacaactttgcttccacctctgattttggagggtgtgacttgtgtgggggaggggaaataaagatggttattcttcagatattgaacttggttacagattagtttccaaatttaaaatgatacaagatttgtcatttttactggatagttcctagggcatccaattaaatttactgtagaagaaatagctacattctgccagttgggaatagaaggcactggagaggttaattactgccattctactttttccttgtttgtttgataggctaatccttgcaattgttcttttgggtgtttcctgtgatgtttcatcactgaactctgacatgatgtgtgaccaaggcttctctaatgaatcacttcaataatgatgaatcaacaaatattgctctagtgtttattatgggtagagctctgtgctggactgtgaggggtaaagacatgaaggcacttttaatgtgccctcatacaacttgtgctctaattgaagtgtgatgaaaagtaactagtaggaacaccggagaagacattctaagagggacatggtttttagtagtgcagaggagaattcctctacaatagagtagtctgaaggtaaaatttgaattagacatccttgagtaggaatgtggaaaacccaaagggagctcattcaaggaaaaagaaaagggtgtgaacctaggcatgaccaaagatacacattagcctagtgccacagatatagttgttaaagctgctgcctactttggtatgtatttttaatgaattctctttacatgtctctttgagctttttctaaattgctgctgttagctaattcttctcacctgtgaaagttagctatagacaggtttttccttgctttagatagtcaataatttgatctttactcatggtgggcccatttatcacagtaagttgtccttttactatacatattgacttttatttatcaataccaaagtccatttgtagctcatcactaaagttcttggatattttcagtagtttttgaaggtgcatttcagagcttggcagagagatacttttgacatcaatataatgcaaatggttgctagacttatctttagcttaaaatcaactgtttatttcctctgtaatggattctgaaatagtccacatttgaaggtaaggggcaaaaaaggcaaactcttcttgacagttctgccactgaaagatgtaaggctattccatttactcatcacatgcctcaaaatattgacgactgaagggccagtgttctaaatatctttgcaatatctttggtagctagagaagagaggaatctatgaacttcgtatggatgtgtttcactatggtgcatttaactattagtgtaattcttctagatcctaaagaaatgaattgtttggccaaagagaagatgaaaccaatagtttttaaatcacattcaagaacactgtaagaggaaattcaggagatagtatgaggaagactctatagcaggatttgttgttaaaattagaaaagtggtagcagggccatcggtgataatactcctccacctgctctgttctctattttggtttcagtcattctctaaaaattccgttcttccttttctcctcacttgcagaaagatggtattagctgttaaagggggctaggcctaggcagcgaacaactccccccagaaacatttccacatccccagcaagagagtggccactggaaaaaagtctccatccacgtccacaaacagtggctggatcttccaagctaggcaactgctgttggacagatggagcccattgaaaaaaccctataatttacagtgtgaataaaatctgcagtcctaaataacattttcaatacaataacttatgaatgatttaaaaatagatctcattcgtcatctgtataggctttttggaagtaatgaggatatttataggaaaatcattaattaaaagatagagcagtttgaaatattgggcaactgaatagaataaaccactgcagtaccagaccaaagccaaacaaaaatcttaattacacattaatcaggggcacaaaaataatgtacaggatgcagaggtcaggaaagactaaaagatagctcaggcctgtgaaataagcagtgaaaaagaactcaaagatttgaattcaaagttactagctcaatatggtagccaagagttgaatgccatcctgctttataattcagatctctctccaattttaaagagtcactataaaataaactaaaagatagcattctagaagtatggaagtgagaaaagctacataaaattcaggtagaagaaaatattaatgcaatactggcagatctcaaaagactgcaagatattttaaatcagagggaggcataatctatgaaaagatgttaagtggtaacactaaatttgtaaacaaagatgatgtcatttgaacagactccaaattcagtttacaagtggcatctctctggacagatgtcttatcaggaaaacttatctggctaaagagctgtgtacacatcacccttactttaagagtatctattcagataatcaagtgctaggacttcctgattatatttgaatagcaatagttacatattgcattagactttaggcttactttgtcttcagtgtgaactggaaattggggaagaatcatgtagaaatgcccccaattaaattaggtatctaacgcttctttataactaataactattttacagacaagtttagcaagatgagttaaggttagacttatgtgttttgccatcttcctgcagttgtaatctaatatggaatattattttgtgggtagcattttctagaatgaatcgctttaaagaggatctatttttcaactaataaaaaatgaattttctgaaatgttgtgaagagtaactattatttttgtattattacctagatgtagagaatttaagttattatttcatttaaatacacacagagaggattaaattattgactatttaggcttaggggaaaaatctgtctatagcaaacttccacaggtgagaagtatggctagacccccagccaagtttggggaagataaatgagaaagaggtatcaattgcttacggaatctgtttaaacattgctgtattcctctcaaattgttctgttattcaggactttgagcaatgggctgcctcagtaaggctgataagcaagcagatactgcacttccagcctaatgcaaggcacaataaaaactttttaaaaatcaatgattaatttcacttgcagttttaagggaaaatctcaaggtctagttagggtttacagctcaagcttaatcaaaaatgtccaaaaacttcttattaatgccaaaaggaagtctgcataaagaaggaaaccctgtctgacttatttttggatggaaaataatattccacactgtttagcccatatatatatatatatatatttttttttttttttttaaaagaatataaaaaatttcattaaagaggtgaacttatgagttcccagagagggaatgtgttgtattgttaaaaacaaaaaacaaaacaaaacaaatccttaaacaggtttcaatcttacctctgctcctaatagtgtaaccttgggcatgccgtttcacttccctaaactcaggttctttcctttataaaatgagggagttgaagtacacagcctctttgataccttccagctttgagactcaaatattctgccagctaagaatccaagaccaaccaactactgagtatacaattgaacaggatactaagagggtaaatggccactacactagtgttggaactaatgaggacttctgaggccctttctgaattaaggaagattggcattttcctaaaagagaaagtgttccttcttggtttcagtttctcagcgataaggaggttctcaatgattgctgaacgaatagacaaggttatggagcagtatgtgttcctgtggactcatactctcctcaatccaaagggagaatcagtatactcccaactctttctattccttttatatgtaaggatggggtccatgaagtcattttgtcttactcaaaccaggcatgaaagccaactcaaatcaaattatctaaactctcagaatctgaaacagattataaggatataggatggaaggagtattacaaagagaaaacgtgtaggttgggaagtagaaaaggagagtaacagggaatggtacaactgcattccttcctcctgctacatttcctcgctcccaaccaggtaattctaagagttcccactgggaggtttgcctagatttctttatgttctcctttggaaaaccattttttgtggcaagcagtgttccaaggagacagctggtgagtagatgagcagacacttaaaggaaatttcaataatttccatgactttggtctctgaatattactgagtaaatctcttctttaccaaattgtagataaatatacaaaataagaaacattacttcttattttgtatatttatctacaatttggtaaagaagagaatttctatatacaagaagttaattggtcatatcagtaagctgaattccagtttttataccatacagataatgaagaaaaagagattcagaaacatctgaaaggatctgttcatcactaaaagaagtatggtggtgaatgatttctaagaatgtatagaaactaattcgcactctttatgcaatttagtttctgcaaagtcgtttgttttctttttaaggaccaaatcctatggtaaatacagaaatgtattaattttacttactgttcacaagttcaagaaaatactaagttgaaagcaggaatacattccaaagaagaaaataaatagatacccacatattgataaattgaagaacagtcagtaaagggaaaattctaggaagaatttatagtaaacttcccagcttgtatttaaaaatttagaaggaggccaggaaaacaagagacccttcaatcaaaagagcatcatgctagcatttgagactagagataaacatgatttatatatgaacttaagataaggattcacatcacagggcaatttaaaccaaggaaaagcaccaaaaaacattcccctcttgaatcagtaggagaaaaaactgttaaatggcactagcactggaatttgtaagagcagcaacctttccacagactgaagctaagacaacaccatcagtgtggggagaatagttggcaggcagtctcaaattcccagctgacagccatctctatctcaagggaaagcgtttgtctcagatggttagtcaagtgtcagagctctttcatctcccagataggaaatggaaaataagaaaatcacattatctagactacgtctccattttctagttctttgtcaacattaagaaggatgcaaggaagaacatgtctgagttaccatatttcgtatcattaggctgagttactctgaatgtgacttatttttatttgaatgacatcaaagtggtatgttagctacttaaaaacatattgagattgaacgaaagacatgcttggatgctaacaagtattttacaactatatgataacgcaatcagtagtgagtatcactttctcacacccccacaccctccatatgcatttacacaagacatagaaagcataggtggtctgttggcatcagctggttcttactgtcacacatctcaatgtaggcactcatttaaaagtattagttttattgagagataaataacagaaagatgccttctcaaatcctcaagctgtctcactgcataacactgagtatttggactaatatctccaagagatggttgctgaaaatatggaagtgaccttgataagtagtagagtttcatttgatattacataagctactgacatctataaataaaggataggagaaacacacctaaagaaagccaagttttaaagagcaaacatgcacgtggataaagggaaactagtaaatataatctaatgatacttccagaaagctaggttccatacaaaagagatgttatcatattggagagctaagaaataggaaacaaaaggttaagagatgaatagatatttctagataagacagtttcctagattagtgtaaaaatctctctctcaatatagttttacacattgtttggaaaaatgcatggtaaatctctaagacactaagggttcttgagttgtgaaatgttagaccaattagattagttatagaaaacaatcgtaaggcagaatgaatgagaataaatgttgcatacacatttgagtaaagtttgggaaacatttagaggaaacacaacccaaagtatatgtaatacactaatcgttagagaaatgcaaattaaactacaatgagacatcatctcactctagtcaaaatggcttttagacaaaagacaggcaataacgaatgctgtcaaggatgtggagaaaggagaaccctcatacaccgctggtgggaatgtaaattagtacagctaccatggagaacagtatggaggtttctcaaaaactaaaaatagaactaccatataatccagcagttccactgtggggtacatgtccaaaacaaaggaaatcagtatgtcaaagggatatctgtattcccatgtttattgtagcactattcatgaaagtcaagatgtggaatcaacccaactgttcatcagtggatgaatagataaagaaaatctggtactatacaaaatggaatattattcagtcataaaaagaatgaacttctgtcatttgcaaccatatgaatggaactggagggacattatgttaagtgaaataagtcaggtacagaaaaacaaatatcacatgttctcactaatatatgacagctaagaaaatattgaactcttagagatagagagtagaatgatggtaactaaaagaaggttagtgggaagcgggggataagaagggatggttaatgagtacaaaaatacagtaagatagaaggaataagatctagtgtttggtagactatagttaacaataacttattgtacatttcaaaataacaaaaagagtggaattggaatgttcctaacacaaagaaataataagtgggtgaagtgatggaaacccagttaccctgatttcatcattatacatgtatacgtacgtcaaaatatcacatgtaacccaaaaatatgtataagtagtatgtattcataataattacaaataaaaaatttaaaataaccctaagtatacgtaataagaacatggcactgagctatcatttgttatgactcaaggacattgtgtcaatgtaaaaatgtaggcaaatggctaacagaaggctggtgctttcggaaggagacgagcaacacaatcaaccaaccacaaggaaaccaagtaagcccatgaggactccacacttggaacactgtgtgtgtctccagttactgttgcccatgcagaagacaatggaattgaagaggccatccaaaggtctgggaggaagtaatggggaggacagtttatttatataagagtatctcaagaagagattaagaagacaaagacgctagtctgaaagtaaatctgaagaagagtatatttgtaaaattgctaaaaagttatatatacctatgactgtcattttctcatttcccattccttcaacccattaagatataccctccttctgtttgacattaccagaatcactcctctattttaattatccaataataggtatctttccctccagccattctttaaattaagacaagtcatacccctaaaaccaaggtctgatcatgtatttcctaagtagaaaacccacaaggacctttgttcactcagcaatgaaagattctggagccatggatttcacagccttttgcaatataatctcaactcgcatttagcgatttctcactagatgctacccctctctttatccttccaatctcagcctctgatatcatcactatagttagaggagactgctcactgtcccctggatatgccatttatttactgcatttgtgcctccgcacagatgcccagtttgagatatcccctctaacatcaatcttcaaatctctgctatctcaaatactttttattgaagacttagctgaaatttcacctttctgtgaaatcttcatcaatctgtcagttaacattattttttctcctctttcctgtattccttagcactttatttggcctgtgttatacttataatcccattctttgggtctcatttctgactaccccactggggtagggaagcaagacattttagacacattttgagactttgaggctgatgttatgaggataactttgcctctctacaatggaacctctggtgctgaaatcagaagactgagctagaaaaatcagaggcctgacccagtgtgtcagtttctgtcatctttagcttatctcagacaccaggaaatttatagattatatgtttgctccactaacatgatgagtctaatgctcatgggacagctaacttccaggtagtgatgactgaagaagtctactttatttgcactgaatgtttatgtagcattgggtggatcatattatgcaatatctctaggccaaagcatcattttcccaacactcactttcctaacctttagataactttataaaataatatgagtcatgcgttgcaaaagattacaccttctccctacaacagaaggggaaattcactgatttccactcccttttccttattctcataaatcataaacttaaatttaccctagggattttatttctttgaactcaatgtacaagcataaaacaaattttgttctcacaggacatcccatttttgtttcattagttcaaggaaagggtcactcaatttttaaagcatttggtttgatctttgctatgattcatgctacctaacatccacagacacactctatatactgaaatgtatcttatatataaaatgtgtctccatggaccctataatggtggtactctcacgtaaagtactcaaaagctgtattatggatacatgagtctaggcagggtaaccagaagtagaaaataaattaattttgttgaatatttaaataattgttgttttgcccaagttcctattacacgacagatttctgtttcttcttatgaaaggtaaaatacttccctggggctacgggaggaaatgcttgaaaaaatttcaccaaatataaggcctagattatactagttctattttatacatttttattctatgttcagccatctcactgatatttcattccacagagagggaggtgataaaatatttttttaaggtaataaaggaaaaaggaaataaagaggatttgtcataatttaactagataaaaataattcttgtgatcttaatgtaagaatagactatgatctctaaaagaatactgaattatggaaacatgatttttacataatagaaccatttacacatagaatttaatcctactaaacaataattcttaaggctctattggcttatatacatttttgtctctaaatcctttccagggcaccgttaagttattttaaaatatttcctcattgtattgccatggaagagattctcccttacctcttctcatgaccaaaattctatttcccatgctgggtatcgacagggaaccatgatcatcaacctttgcagagaacttctcttcatgagtttaagatcacagagatttatttgcaaaaacaaatagggagagagattcggcttaaaattttttgccagattatggccattatttagtcttaaaaccctaaaggtcttagataggagggtcaaacctagtacagcactgttggagcctgcaaatggcagctgaacctgggaggaaccagttatttccagggcatttctctcctatttcccacagtaaaaaagttgtccaatttagaggcatttggtatagctagagtaaggaggtaaacaaacatgctttagaattccatttcattgacaaatctgaaacacagatcaaattggccttattccaagactaaacagccccccaaatcatctcattttgtacagcagaatctcagagcttccaacccacctatggcacaagatcctggcctccagtcagccagctagttatccatggaagtggctcaaggctgacactcagattgactggttcacactaatttacttcacacagattccatttatctcctagaagatcccctggcagcagcttataatggcatatcctaggatgcctgcctgcatgcgtgtttaaagcaacagcgcttgatgaatctgagtccagaaaacagttcacagattgaggagtaggtgcaatcagaaaacatcaagaggcacagctgggacttggtggcttgcttgactggtcagagcagctgagcattaagcgtgtctgcttttctgctggctgctcaccatcaccaggacaaatcagagagccaccccctttttcctttaccagtcaccctccaaaggaaaagagaaaagaaagtatgtcaccatcccagtagcgtgtgcagctgtagagaaagctaatttgatcatttacctttacttcttaaatacttcgatattattctcagtagaactacagctggtagttctaaggttaagttgttgaatggttggattggcaagatgtagttagaaaaagtggaagagaacttcaacttattttttttactttcaacaatgagtcccaaagagctgtctgaaacgctatgatcatggggctcatcggtcgacctccaaagaaaggaagggtgcctttctggttactctcctacatctataagagagcttggggaaatatacaaaaaagctggatatttatctaatgagtaaatgggtggatgaatgtatgaacaaacaagtcactgttctccagctgacgttttagaagtgtggtgaaccattgcacagtaacatggtcagcctccaaaggtggagagaattgagatcttttaacggcattgaagctaaaagttttaaacaatgacaattcactgagaaatgtaccaaagcagtgacatagcacatttagtacttataaggttaaacactgggctgcagtagctgcttgaccgtaaaaagtaggattaaggcttttgcatgagccttgacatgatcctgttgtctgtctgctgccttaagctttgaaaaacagctgggatcatcttcttataagctccagctcaaagatgtttaagcagtccccaatccaattaaacagaggtaaatagaaggaagaattgtactgagcaccatcatcaccttttttcttaatgaaaaacagtgtaattgcgggttacacagctccttaatctcacattaaatctaatagattgctgacttatactgagcatgacagtcccagctttctatattggtgtgcttaattttaggtcattatcctttattatgtgacttgtaatccttaaagcccatgattgtgtctggatatttggcaaggattgtatttggtaatacaaggattctgcttctaagagtgatggtttaattgaatgacattgtataattattagatgttcagagaattacatatatttctttccttttttaattggctggtttcttataagtgtttccttcaacaaacattgttcaagattattattgagttttaggggctcttctgaaaaggacagctttcacaaatgaaagacaagtagtttattgatatggaaatgtatctaaatgctattaaaatgcccagttcaaatacaatcctggctcatctacaaactgggaaaccttggtcatgttactttacctttctgtctctgtttcttcatttataaaatagcaatagtgatggtgcctaccaggggcaagaaactgttgttacaattatatgagttaaaacatgtaaagtgctcagcctaatggctcaaatgtagacagtctaagtaaattcagtattattattatttgtatatctgtctttgtctagaaatatgcataaatgtaaataagatgtccagccttaaggtcaagacattttattttattttactagcaatgtagtaatatctaaaatttctctaacctagtaatagaagaaatattttaaatagctatattatcttgatcttcattgaagactgtagaaatctacaagttattgttagtggcccccttttattttaccagtttaaagaggcatgtccatttgtatctattaactaaataaaaacctgtccaaagtcatctgtaattcttttttcttatcaagagtgctgaatatggaaggaagtaaaagtgacttctgacaatgctgaccagataacatagaacctcattggaaagttattctaaatagcttttttaattttttgctgataaattaaataaaaattaaatggaatggaaatgatgatatggtgatatactttacatatatattagccttttagagaactgatttgggtttggaaatttaaattattgtatgtgcacaatcaaatttcagcttatggatatgattagatcataacattttaaatgagcaactataatcttttatatttcaaagtaagaacaggtcttgcaccatcacttgtgcatggttcttgattgctgcttttttcctggtttccattcacacattaagatttaagaaatgctagtattgaaactgaaagtctaatgaagctcagctccgtcaatggcaaacacattagtggaggaggtcatttgacggtgtatacatctaacacacagaaatagtggtttacttgttattaacattcttctttttcatttctagggtagaaagcaccataaaacctcatataaaataacatcaaaaaattctctttttcttgaacaccaggttaacattgggtgatgcggaatgcattattatatccattttagttaattttaaaggtgaaaaaatagacttattttggtttattataaaaagttttttgctgtgtttttatcttgtttgacccaatatttatactgctacccgccctggctcacccacccctagacacacagcagatcacagaatgaatcagatcactgcatggttctgatccttctataaaagcagctgaaataactggatcagagatttcatgactggtctcagtaagtacatttagatataagtagtgccttgcttttggtctttacaacacatactccatgaaactcattaatttgaacttatagataatagcaatattctatatttgagcaaatttcaaaatagtgatagaaaaataagtgggtcaagttactcataagggaaaaaaataaaattgtcaaaagattctgatgacaacactttaccccagaaaataaagtaacatacttaaaaatttaagagaaagaaaaaattgaactaagattttctatccagcaaaattgacttttaactagaaaggctgcaagttaatataagcatgcaataacttaagaaatattgtttaaatatgcctttcctgggtgacctactaaaaatgagctttagataactagaataattgaaaagccatcagcatcagaataagaggtaagcactaaatatacatttacctgtagaactaaaatcaaatgatggttatagaaatatggctgtattctctgacaattcatagaacaactatgaaaaatgcaggtgatcagagggatatggagagtgcataaaaagcaggataagctgagtaattacatagtaatacatatacttagtagtatatgtattacctgagagtaaaagagtatcatttcaaattagatgctggaagagagaaagtaaaaatgttagtagcaaattatttcattattgctaatagttgagggctaactggcaatgagaagaaaggtaatacgtaaaggttttagcataaaggtaaacattaggaaaaaaaaaaactaccaaatactccctcaatacctacatacagaaagtgagagagaaagagagattttgaggaaaataaaatgaaatagatgacatagtaaaagaacatatatagtttcatatatttgtgtctatgtacaaacttaccatctttatcaataaatgttaatggacttaattcacctattagaataaaagagattaagattgactaacaaagtaaaatctaacactatgttgtttttaaaaagatacatcaaaaacaaagagttaagcaagattaaagataaaaggatagacaggatataaataaatttttaaaaagcagtggtcacaatattattgagcatggtggaatgcaaaccaaagagcaataaataaagacacagagaagagtatttcgtaatactaaagactgcaattcacaatggaggtatttcaatgactaatatatgtgtaagtaataacacagctactttaataaagcagaggctaaagagaatggaaactaacgatagataatgttagcacatatctctgaatataagacacataatggggacgaaatattgacaagaatatagaaaacctacagaactaagtcaataaagtagatgtaataatcaaactctaatgccaatagtagacagtacaccttgtacttaagtgcacatgaaacatttaccaaaactggccacatcttattttccggagtgacccctccaacattccaggaatggaactagcacagaaaacttctctgatcacaacgcaataaggctagaaattagatcgttccacctggaaatttcaaaacacattactaaataattcagctcaaaagggaaattcaatacaaaactgtagaacttaaaaaaattgtaataatgaagacataacaatacagcaaaccaaaggaagaaagaaaaaaaaaaaaaacaagaggaaagaaagacaatgaattagaaagcagtaaaaagaagaacaggaggagccaagatggctgaatacgaacagctccggtctacagctcccagcgtgagcgacgcagaagacgggtgatttctgcacttccatctgaggtaccgggttcatctcactagggagtgccagacagtgggcgcaggtcagtgggtgcgcgcaccgtgcgcgagcctaagcagggcgaggcattgcctcacttgggaagcccaacggtcagggagt

SEQ ID NO: 1033 - DNA, 27363 bp, Homo sapiens
tcaagataaatatattttaatacaatatttataaaaattaaattactgcaaaaactccacaacatcaacattttacataaagatggtatctgagaaggtcaagatgaaggtgaaaagagtaaaggagttgtactaggacaggcctcccattagacacatgctgtcttccaggggtcccaaattggatgggtgtttccagtggcatgctcttacagacagacctgttaatttccagtttaccttctcctacctgccatctgtaggctccttcttgagcaaactacagtgcgaggtgatctggggactattgtacatgaagccatgcagctttgtctgaaagatacctactcaagtaagttttaattttgcaactcttttggttaagctaattttttaaaattacaaaaaacactaagtattatgcaaatgtttacaaagcaatgactttcttaggaaattaaacacaacttttggcactttacatataagacaacattttgtggagaataaaggagtctataacaccgcttttatataactgagcaatcaaaatgtatgaatataaaatttaaaaaattgaatgagtccactctgtgaaaataaggctttaaaatcagttggaattaatgtaacctgaactttcattttaaatacatggcataaaatttaattttaaaatactcaattattataatgtgccctctaaggatggaagagaaatagtatcttttctaaagtgttcattataataattatgaaaggattttaaaaatacagaacactggaaaaaatgtatgagaaaagaaataaaagtcaccaaatgctatcatctaaagatagaatattaatatttaacaaactgtattctaccatttttctaataccatcatgttcaaagcagccttaatttagtttctaaaatagtaacagaatgtttgatacctggggctactttttaactgtgtgtttctaacattatacatttttccttatatttgaagtgtttaatagtgctcacattgctttctagcacctctggatgagccctgtgagaaagctctccaacacaggggagggaatgaggctctgacaagcacagcaagcacacacggcctggacacgctgccgaggagcctctgcttttaaccctccaggctttccaggtactttttcctgcaatatacaatggagccaatgtgaaactcaacagcaagtcaaagaatcaaggcttgcaaatgaaaatatgatattcctttgggggatatgccatatatatatatatatacacacatatatatgtgtatatatatgtgtgtatatatatacacacatatatatgtatgtatacacacacacacacacacacaaatacattcataaatatcaccaagatgattaccaaaaaagaaacacaagacaaaatttttaaataaattttttattacaatgacaggaagactccggatacaaacacatttgctaatataatcactccactggttacctaggcctagacgtacaaaaggacacccatatctcatcaggagaaagacaattttgagtttctgggtgtagtaccaagtggttatgatcaccacgtacgtggtctatccagttaactgtgtggcaatttgctatttcaagtcctctcataacagaaattactgaaatatgtggaacaccagtcaatataaagaattcatttttaaacagactagtgaatttgtgtcataaacacacttgcgtatggatattaggagagcattgcttgaatatctctaaaactatttttaggaattaaaagctttcatagttaatggtatgatattggccttcagaattcatattgataaaagcaaaccttagtcatttaacaggaatgtttaaattttagagattctaacatgcgatgccgaaaaatcctaacatttccacttagtaatgtcagggttgtgccagttctaatttcccatagctagtaacatcagaaaatatttatcagagattcaatattggtttcattagaactgataaatgctaagtatggcaactattaaaacctattgttattcttgtttctaaaagggaataataggatgtagctataaaaataatgaagcttatttttcataaacatatcataacctgagcgtccaaatagattttaacaattaaaaatgcctcatttgagaggacatacacttatttgatattgccatccttcaaaatgcttttgggagtccttataatgtccttgacaactggtatacaacaagcaagaaaatataatccatcgcctaacttgctaccttcctttattttgaaacttgtttgaagtggcttttgactgtttctaaaggagggggaatatatttatcaatcagttttcaaaggataataattttccatgattattcatattaatgctatgttagtttctaaacttcaactcaaatgtaatttcaagcagtaaaatcatattttaggaaacaaagaatgcacactttaatctactttaagggagtcacactcatttgacatctttatcctggtatgtttattcagatcatcattaattataagttccttaagggtgcagcccacgtcatttcaattacacagttctcttttctaatttccccatctcctgtctactgcatcccagcataagacctgaggctggtcccatgctcaaaaatgtttctttaattgaagtgacttgaacttctctgttagatacatacatagatatagctatatatcatatatttaatgctttatatccctttttcaattatatagttctcttttctaatttccccctctcctgtccactgcatcccaccataggacctgaggctgctcctatgctcagagatatgtttcttcaattgaagtgacttggacttccctattagatacatagatagatagatatagctatatatcacatatttaatactttatatccttttttctatggattaggcaatatttatatacataagatatgtagattaataattttgatgattttctgtaaatcgaggaactgtacaatataaatcatagtaaatagatcaccaaaggctttaatagaagagcactttatgtctattcctatttatgctgtttgatatatttcagttttagaattcctgctagtcaagcttctttctgggaaaagacctacaagagtttatacttaataaggatcaattgtgatatgctgtaagttgattccccttccctagttcacatctatatggccaacaagatcaaccttgagctaaagacattagcctcaatgtcattagaagttcaaattaactcaacagtacaaggttggtcactgttatactttgtatctcttatttgggctaattgataactaaatggaactgggtatttgttgacaacatttcatgcttagggatgagatttactgcagtaattgatccgaattaaagcatatccactaaaacaaaatatcctaaccagacaaatcaaagttggtaaaattttagattaaataccttgaagcagtattaaatttgtaagtaagtattgtgtactacattggttttaacattgtttattatataattcagggactaaaaggataggagaaaatttaaagcagtattaaatttgtgtctgtggactggcattccctgttggaaatattaacagaaaaagtaagaaacaggaatagagaatgatctaggcaatatttttctaaaattagatgaatatgaatattttcaatcagtatgtattgcattgtaatcagcatgtattaaaatcactttaatacatgttggctaaagtattagcaaatccactacagcctaataacttgaccaataacaacaatgcttttatacagtaataaacaaatggcatcttttggatttcttaatttgtccaaattcagctcctactgatgagattccatttaagacaccttgcaggggcagacctttgctatccatgaatgatgccttggctcacctaggaaaaaagcagatatcttgggttatatggtgaaatctaaaaagagaaaaaagagaaagaccaagaggaggggagggagagaggaaatgaagaatagatacagaaaggaagaagggagagaatgaggaaaaaaagaaagaaaggaagaaaggtattgcttataatttctacatgtcttttccatcctaaaataagacaagttaatataataaaaatatacttgtcttataaagtaggtaaatacactttaattgcacacattattaatagcttggggatttttttttaactgccaaggaagatggaagttttctataagaaaaatttagtttgaaattagtaaatttccataaatttcaaacagcttaattgttcttagaaaaatccacaactgcagttttagggtcaaaatttattagttgaaatactgtttgagttagagaatcaaacaagtatttatttctcagattacttggatgattgcctttgtaggctaaaaaaagccactcatttaaaatcaaattgactaccaaactaattggaacattgttccttaataactattttaaaacacatttatattaatgacatgtctatgaatagtaactttcactcctactggcaaaaactatggtttagttaaaccagtactgtatactaactgtgtgtgtgtgtgtattaatgtataattttgcattctttaaaaaatatgttgatgcttgaattttgcttttgggtaaattttaagaatgtcatattgttaaaaacaactcgaagaaagtgcttatatcttcctactggaattgctcttaattcttctagattttttttagcgctaaccataagaagtgtgttctcaatggccatgattgatcggctgctcacacattccacattttttctgcttcatgcatcatcatcagccatctccaacactccagtcctgaatctgtcctactttctgttacctgatttttgctggtgattcatgagccagaatagaaaaagaaaaaaaaaaaactccaccttggcttttcacagtatagtatcccctggaaactctgtgagaaatctagttttggtcatcagactcatgcaaatgtaatattgattgacaatgatgtatatagatctacatagataacctgccttataaaaaccacaaaaatgttctattaatggcagaatgcatactgattataaactacttcagaatgatgtggaaacacttacgtaaatgcattttgttggacttctaattctctcttgtcactattattttcagctgaagctactttggagtgcactgtttctagtgcactaaaaagaaaaattattaattttccaagccaatatggtgacaaaggcttaaggtttctcattaacactgtcataaaaattgtgaatgtcacactaaattttctatcatcgaatgagtttaaagatgaggagctagaaatccttaaaaaattattctgaagaatgaaaaacaagctttaatcactgtaaaagaaacagtaagaagttaaccagcaaaaggctccactgaactatttttgtgataacatctttcagattcagaagcaaccaggccttaaagagccaaagaaagaaagcctaatggccctaaaatctcaaaagagggagctgaaagttcatgatactgtctcagtgcttctattactagacatcaaagttattcccacaggtttcaggaaggtataaatgccagtgaaggagcaagtagacttcacagagtctaagccggaaacttcaatctgggattcacctgtgagtgaaaactctttgctaatgaattattccgaagacaagacactactcagagacacttttccctatcagacaagacctccaggttcactagcagggtcaaagtaataggaatgctctggtctaaaggtgctttgcctaccttaatggactccaggcactcacctgggtatacagcttgaacccataaagagatcacaatggcatgatgaataaggtagagtgctctagagaccaggtgaacaatcactccacaagccatctaaattgtgacctatatgcagactgcagcccatttacaaatgggtcatcctagtcaattcagtgctggagaaggagtgatgccaatataaaaataaacaatctacatactgagttcaagcccattgtattcagaggtaatacacgaagtggttatttctattttatataaattcaagcaacttggctttgttaatgacattttaaaactctatcaacatctaaatatcaacttcactttttccaaaaactttttctgtgcttcaatgtcccttttgctttctgcctatgaaaatacgttcgtattcacaatataaaaccagaagagtttaaagtaaaatgatgtttacaaggtttgcaaagaagagaatttatgtggaatgaacaatatacaaagcaatatacttgaactgtgtttgcatggaaaatactttttttcattttctatatgctgttcaaacaactgagctattcattaaaatgatgtaataattatattagtcatttagcattgcatagataaaaccatgtaagttcaatatccattaaagttagaagattgaccacattcagctttgtaactgggggattttgcaggtacataaaaatgttaaaaggaattttaaatgaatgaaaacattccagttgaaaatggtaagaatgtgcattcagaattaaatgcactcttttccatacagtgactaaggaatacactaatgcaattgtaagtttagctactgaagcacctcttctggttcgaggacattttcccaaatctcaccacctaaaaaccccaaatttgtttcttcttctgactgaggtagttaatattttccagagaaacaccactcacatgtggtaaatagaggtaactaaaccactagagtaatgcttatggttttggaacccctacattttgaaagacttgatattttgaagttaacgtttgggctttgaaaagtgaaaagtcatatttttatagttcaagaacatccctctctgccaccaaattcacacgagaaacataaaacttattttcctccatgttcaattttaagaattttgcccatcgaatactcatgcttcaaggaaacacactctctcatcaaaatctttcttactaaacaagcacctctgtcagaagtgtcttaatttcttatcacagaattttatccacacaaggagcaataaataattcatgtcactgcctctttgttgtgtgtccctgaactgcacagagctggaaggctgacagctgtgtcaggacaagcaccaaagatctgacatgacaagtgactaacaagtttctttcagttcacagtgaaagaagacaatggcccaaagtgcagaaagaaatcctaaaacaaaataaaactgcttctttctttttagctaagtgtttgctatgagcttatttccaacccacaagccctggtcattttataggactgcccagccccctttattcctcacactggcttggccatttactcctggccacggatcaatatgagcaattcttggagaaatacgatgtctccatgacaaccaagccacaaattctcagtggaaggcagtgagaccagtagtgaactctccagaggtttctaggcctataaggcaagatgtcttaaaatgcaggaagggacagaggaaaaagccagagtaattcattctttattaccagcataatgatgtccgatgtatagaacggtactcactttttgagttaagattctttatcagcacctatattttctaattaatctttctttcttgataaacacgtttgtgtgtatcaatcagatagagaatgttatatttgaatctcgctcccattccattcatattaagggatgatggaaatttattctacttttgaaatgatataaagctgatctattcttatcaaaaacaatggacatttaggtaaaaacctgattcacagatttacctgtctgacaaaatgagtaatagaaaactgtattaagacacttttaaaacctaataaaaatttggcaacattagtcaaaactaaaagtaatggataaataatttttattatagaaatttaacactaccatttatttaccctctcccttttagagtgagactcatctacatttttcttttggctattatggcaaggggtggggttaatttgctcattaaacatttctgtcactgctaaagatgccatttctcagttccatgggatctgaaagcagaagtgtggttgagaacaggcacagggcagcagtccatcttcagaggaatcttggtggagtgaagaggactgatatacaatgccatcgccactgcgcctattggggttccgagatgacttaggggacctgacatagattgcaggctgcacctttcactgaaaattaaatctcagtaactctccttggggaaggatcaggggactgtttgtttgcagctgccccctgtcaacaaaggctacaagatttggaaatctcttaactaagctgacaggccacagagaggatgaatcaaaaatatgatacatggatcagcacacaaagatgtgagagggtagagggtacacaggagccagataaaacaggaatcacaaatattaagtggaggagatatttaactctttcattcatgataataaggtaccttctagcaccttataactttgtatttatccaggaatgttcattcgacttttacaagattttttgattctaattaattagttaaggctaggcgtgtttcaaaatgaaacaaaaatagaaacagaaatccttgtataagtgtttctagctgtatccttctagtacatttctcttttatttctataaaggatatatacaaatatgtaactttgacaaagaaaagcttttattgcatgagagaagggttactattttctagactttattttccctaaacatttgacagtattcattaccatcatgctaaaatcctgtcatcccagttacagtcctgtttgtttctagaaaggtaaatagaattgtaatgatgacagtttctcttttcacccccgtctgtccacttccgctcccctcttgttagtttccattatttgaaatatttaaaatgttgccatttctctatagtttccaatctctggctctattaaccatttagcctaaaattgatgataatgaactaatagtgtcagcttcccttctcagtcataaagcctttgtacttcctccaactgaattcttgatgaaagaggaaaagataacagctccacactgtgacccctggaggtgaccattaatttgacagtgcagctgctaagagaaaacagcattacaatgtcctctcccctcacccccttccaaggaccccaaagctgtgtcaaatttatcattttatacttgactatttttaaatggctttcacctggactctcagactcttccaaggcacatctgtcaggcatgtcctccacgtcttggaagtttgccgagtttgagttgctgtcatgcttgaccgggctgactggagctattaaaagagagagagagagagagagagacagaagagagaggatgaaaaagtagtagcaaacaccattaaaacatttcctttcagttccacagatatttccagggacacactatgtaaacacaaataataaattgaaataaaatgtatcctctaagtatttattggcagacatgtaattagttgaaaaatctatagatgtgactttatcttagaagaaaaataagttcacggcatcagcttaaaagctacaaagtaacaaagtgatctcttcgaagtagaaatcgtatttttaatgcataaatctaaaacaatatagtcaattaacagcaatagaacacagagagaagaacatcaggctagtcaattagaaagaccagctctgtactggtggcaatgtttcctctcactgcactaatcacagctaatgaacattttgtgtgcattttggctctctttcattaaattaaaaactatggtaccaaacaccaaaaaaactagtactataaaaagtaaattttaaaatgtagcatgaatatacactgaaagttataataagaagggctattgtttcaaatggtaggtctccagacaacctatcatgagatattgtagaattatgaccagaaatggaaactagtacagaagtccaaaattttctataaacccatggtaccgactaattctgtttgagaaacagactgaagtttccactttttccacaagttgtaatacttgctctatgttgtctccaggaagtaacatatttccatattacatttgttctagaaaatatttgtcagaaaaagtgggccttgtcttcatgaagaagctcagtgaaaaagcaaaacaagcctgcaatagcataaattaggtcacaattaagccaaatgttctaaatatatggatactgttgagtacaatggaattttatttattacaagttgctgcaataaacacgactactgatttgataacacatgcaatgtatttataaaccataaatgcaataaacaaaatatatatttacaaatcacacataagatatgtttgttggcacaggggagtgggcctagacactgtttctaaacctctgttaccagacaagaaagcaatgcagaggctgagactgtgctacttcacacatttggtacgtgacacaacggtgtcccacccaaggtccagtcagcattagtagtgttcagacctggcacactcctccacttattttaatgaagtgtgcatagcactgatgtttgtaacctgaagaccacacggacaaactttagagaagactagtaacatgattctggtttaaatattccttctagattgtttcaccaactctctcaggacacagatatgacttctctgttctatcaaagtgccagcatagttagaatttactacgtttctaaaaccttttttgggaacaaaatataagaaaagcatgaaattgctattttcaataataaatctgatcttttcattttcatccatatgtttctgtggacttcacatgcaacagtgtctaggccatagaaggtattcttgaaggatctgtgaaatgaatgaatgaacacatgaatgatgcagaggtaccatgctaaatgtccttctgatccaagaggatatgtgctttcaattatcttttcaatggatctgttcaatttccttgttaggccaacttgagaccaaggatgcatgtttgcaaaatggtgatgtgggttagtttgtgacatggaaggagaggatgtgtggcctaagtagttattgatgcagctgagtttaattttcttaattttcttcagtttaggtcatacttacagattatttttgaatccatagattttttgtgaaatgtttaagtggtatagttaaatgtatcagtttcattcagaatactattatgttggtcaagatttcctggcctactttaatgatttttatctctatatatctttcttgataattttctgaaatatttatgttggtatttataaaaggaaataaatcatatagctaaatctattactaaaagccaatgaggtggcacctctattgatttgggcaaatgcattgcacttgccatccaacacactattctttcataatttaaaaaattcctccattcattcatttattcattccttcaaaaaatatttatcaagcaccaaataaatattcagaagatactgttctaaatcagggacctcacagaggaagaggacatggtattagacaaagtacatgtctgcaaccattctttgtggcaataaagtggtcccagaatgaactgacatcccaaacccttcaaaaaggccagaaagttagctgtagttttagctgcatgatcttcattaaactcacactagtaggtaccatgctacaactttgcttccacctctgattttggagggtgtgacttgtgtgggggaggggaaataaagatggttattcttcagatattgaacttggttacagattagtttccaaatttaaaatgatacaagatttgtcatttttactggatagttcctagggcatccaattaaatttactgtagaagaaatagctacattctgccagttgggaatagaaggcactggagaggttaattactgccattctactttttccttgtttgtttgataggctaatccttgcaattgttcttttgggtgtttcctgtgatgtttcatcactgaactctgacatgatgtgtgaccaaggcttctctaatgaatcacttcaataatgatgaatcaacaaatattgctctagtgtttattatgggtagagctctgtgctggactgtgaggggtaaagacatgaaggcacttttaatgtgccctcatacaacttgtgctctaattgaagtgtgatgaaaagtaactagtaggaacaccggagaagacattctaagagggacatggtttttagtagtgcagaggagaattcctctacaatagagtagtctgaaggtaaaatttgaattagacatccttgagtaggaatgtggaaaacccaaagggagctcattcaaggaaaaagaaaagggtgtgaacctaggcatgaccaaagatacacattagcctagtgccacagatatagttgttaaagctgctgcctactttggtatgtatttttaatgaattctctttacatgtctctttgagctttttctaaattgctgctgttagctaattcttctcacctgtgaaagttagctatagacaggtttttccttgctttagatagtcaataatttgatctttactcatggtgggcccatttatcacagtaagttgtccttttactatacatattgacttttatttatcaataccaaagtccatttgtagctcatcactaaagttcttggatattttcagtagtttttgaaggtgcatttcagagcttggcagagagatacttttgacatcaatataatgcaaatggttgctagacttatctttagcttaaaatcaactgtttatttcctctgtaatggattctgaaatagtccacatttgaaggtaaggggcaaaaaaggcaaactcttcttgacagttctgccactgaaagatgtaaggctattccatttactcatcacatgcctcaaaatattgacgactgaagggccagtgttctaaatatctttgcaatatctttggtagctagagaagagaggaatctatgaacttcgtatggatgtgtttcactatggtgcatttaactattagtgtaattcttctagatcctaaagaaatgaattgtttggccaaagagaagatgaaaccaatagtttttaaatcacattcaagaacactgtaagaggaaattcaggagatagtatgaggaagactctatagcaggatttgttgttaaaattagaaaagtggtagcagggccatcggtgataatactcctccacctgctctgttctctattttggtttcagtcattctctaaaaattccgttcttccttttctcctcacttgcagaaagatggtattagctgttaaagggggctaggcctaggcagcgaacaactccccccagaaacatttccacatccccagcaagagagtggccactggaaaaaagtctccatccacgtccacaaacagtggctggatcttccaagctaggcaactgctgttggacagatggagcccattgaaaaaaccctataatttacagtgtgaataaaatctgcagtcctaaataacattttcaatacaataacttatgaatgatttaaaaatagatctcattcgtcatctgtataggctttttggaagtaatgaggatatttataggaaaatcattaattaaaagatagagcagtttgaaatattgggcaactgaatagaataaaccactgcagtaccagaccaaagccaaacaaaaatcttaattacacattaatcaggggcacaaaaataatgtacaggatgcagaggtcaggaaagactaaaagatagctcaggcctgtgaaataagcagtgaaaaagaactcaaagatttgaattcaaagttactagctcaatatggtagccaagagttgaatgccatcctgctttataattcagatctctctccaattttaaagagtcactataaaataaactaaaagatagcattctagaagtatggaagtgagaaaagctacataaaattcaggtagaagaaaatattaatgcaatactggcagatctcaaaagactgcaagatattttaaatcagagggaggcataatctatgaaaagatgttaagtggtaacactaaatttgtaaacaaagatgatgtcatttgaacagactccaaattcagtttacaagtggcatctctctggacagatgtcttatcaggaaaacttatctggctaaagagctgtgtacacatcacccttactttaagagtatctattcagataatcaagtgctaggacttcctgattatatttgaatagcaatagttacatattgcattagactttaggcttactttgtcttcagtgtgaactggaaattggggaagaatcatgtagaaatgcccccaattaaattaggtatctaacgcttctttataactaataactattttacagacaagtttagcaagatgagttaaggttagacttatgtgttttgccatcttcctgcagttgtaatctaatatggaatattattttgtgggtagcattttctagaatgaatcgctttaaagaggatctatttttcaactaataaaaaatgaattttctgaaatgttgtgaagagtaactattatttttgtattattacctagatgtagagaatttaagttattatttcatttaaatacacacagagaggattaaattattgactatttaggcttaggggaaaaatctgtctatagcaaacttccacaggtgagaagtatggctagacccccagccaagtttggggaagataaatgagaaagaggtatcaattgcttacggaatctgtttaaacattgctgtattcctctcaaattgttctgttattcaggactttgagcaatgggctgcctcagtaaggctgataagcaagcagatactgcacttccagcctaatgcaaggcacaataaaaactttttaaaaatcaatgattaatttcacttgcagttttaagggaaaatctcaaggtctagttagggtttacagctcaagcttaatcaaaaatgtccaaaaacttcttattaatgccaaaaggaagtctgcataaagaaggaaaccctgtctgacttatttttggatggaaaataatattccacactgtttagcccatatatatatatatatatatttttttttttttttttaaaagaatataaaaaatttcattaaagaggtgaacttatgagttcccagagagggaatgtgttgtattgttaaaaacaaaaaacaaaacaaaacaaatccttaaacaggtttcaatcttacctctgctcctaatagtgtaaccttgggcatgccgtttcacttccctaaactcaggttctttcctttataaaatgagggagttgaagtacacagcctctttgataccttccagctttgagactcaaatattctgccagctaagaatccaagaccaaccaactactgagtatacaattgaacaggatactaagagggtaaatggccactacactagtgttggaactaatgaggacttctgaggccctttctgaattaaggaagattggcattttcctaaaagagaaagtgttccttcttggtttcagtttctcagcgataaggaggttctcaatgattgctgaacgaatagacaaggttatggagcagtatgtgttcctgtggactcatactctcctcaatccaaagggagaatcagtatactcccaactctttctattccttttatatgtaaggatggggtccatgaagtcattttgtcttactcaaaccaggcatgaaagccaactcaaatcaaattatctaaactctcagaatctgaaacagattataaggatataggatggaaggagtattacaaagagaaaacgtgtaggttgggaagtagaaaaggagagtaacagggaatggtacaactgcattccttcctcctgctacatttcctcgctcccaaccaggtaattctaagagttcccactgggaggtttgcctagatttctttatgttctcctttggaaaaccattttttgtggcaagcagtgttccaaggagacagctggtgagtagatgagcagacacttaaaggaaatttcaataatttccatgactttggtctctgaatattactgagtaaatctcttctttaccaaattgtagataaatatacaaaataagaaacattacttcttattttgtatatttatctacaatttggtaaagaagagaatttctatatacaagaagttaattggtcatatcagtaagctgaattccagtttttataccatacagataatgaagaaaaagagattcagaaacatctgaaaggatctgttcatcactaaaagaagtatggtggtgaatgatttctaagaatgtatagaaactaattcgcactctttatgcaatttagtttctgcaaagtcgtttgttttctttttaaggaccaaatcctatggtaaatacagaaatgtattaattttacttactgttcacaagttcaagaaaatactaagttgaaagcaggaatacattccaaagaagaaaataaatagatacccacatattgataaattgaagaacagtcagtaaagggaaaattctaggaagaatttatagtaaacttcccagcttgtatttaaaaatttagaaggaggccaggaaaacaagagacccttcaatcaaaagagcatcatgctagcatttgagactagagataaacatgatttatatatgaacttaagataaggattcacatcacagggcaatttaaaccaaggaaaagcaccaaaaaacattcccctcttgaatcagtaggagaaaaaactgttaaatggcactagcactggaatttgtaagagcagcaacctttccacagactgaagctaagacaacaccatcagtgtggggagaatagttggcaggcagtctcaaattcccagctgacagccatctctatctcaagggaaagcgtttgtctcagatggttagtcaagtgtcagagctctttcatctcccagataggaaatggaaaataagaaaatcacattatctagactacgtctccattttctagttctttgtcaacattaagaaggatgcaaggaagaacatgtctgagttaccatatttcgtatcattaggctgagttactctgaatgtgacttatttttatttgaatgacatcaaagtggtatgttagctacttaaaaacatattgagattgaacgaaagacatgcttggatgctaacaagtattttacaactatatgataacgcaatcagtagtgagtatcactttctcacacccccacaccctccatatgcatttacacaagacatagaaagcataggtggtctgttggcatcagctggttcttactgtcacacatctcaatgtaggcactcatttaaaagtattagttttattgagagataaataacagaaagatgccttctcaaatcctcaagctgtctcactgcataacactgagtatttggactaatatctccaagagatggttgctgaaaatatggaagtgaccttgataagtagtagagtttcatttgatattacataagctactgacatctataaataaaggataggagaaacacacctaaagaaagccaagttttaaagagcaaacatgcacgtggataaagggaaactagtaaatataatctaatgatacttccagaaagctaggttccatacaaaagagatgttatcatattggagagctaagaaataggaaacaaaaggttaagagatgaatagatatttctagataagacagtttcctagattagtgtaaaaatctctctctcaatatagttttacacattgtttggaaaaatgcatggtaaatctctaagacactaagggttcttgagttgtgaaatgttagaccaattagattagttatagaaaacaatcgtaaggcagaatgaatgagaataaatgttgcatacacatttgagtaaagtttgggaaacatttagaggaaacacaacccaaagtatatgtaatacactaatcgttagagaaatgcaaattaaactacaatgagacatcatctcactctagtcaaaatggcttttagacaaaagacaggcaataacgaatgctgtcaaggatgtggagaaaggagaaccctcatacaccgctggtgggaatgtaaattagtacagctaccatggagaacagtatggaggtttctcaaaaactaaaaatagaactaccatataatccagcagttccactgtggggtacatgtccaaaacaaaggaaatcagtatgtcaaagggatatctgtattcccatgtttattgtagcactattcatgaaagtcaagatgtggaatcaacccaactgttcatcagtggatgaatagataaagaaaatctggtactatacaaaatggaatattattcagtcataaaaagaatgaacttctgtcatttgcaaccatatgaatggaactggagggacattatgttaagtgaaataagtcaggtacagaaaaacaaatatcacatgttctcactaatatatgacagctaagaaaatattgaactcttagagatagagagtagaatgatggtaactaaaagaaggttagtgggaagcgggggataagaagggatggttaatgagtacaaaaatacagtaagatagaaggaataagatctagtgtttggtagactatagttaacaataacttattgtacatttcaaaataacaaaaagagtggaattggaatgttcctaacacaaagaaataataagtgggtgaagtgatggaaacccagttaccctgatttcatcattatacatgtatacgtacgtcaaaatatcacatgtaacccaaaaatatgtataagtagtatgtattcataataattacaaataaaaaatttaaaataaccctaagtatacgtaataagaacatggcactgagctatcatttgttatgactcaaggacattgtgtcaatgtaaaaatgtaggcaaatggctaacagaaggctggtgctttcggaaggagacgagcaacacaatcaaccaaccacaaggaaaccaagtaagcccatgaggactccacacttggaacactgtgtgtgtctccagttactgttgcccatgcagaagacaatggaattgaagaggccatccaaaggtctgggaggaagtaatggggaggacagtttatttatataagagtatctcaagaagagattaagaagacaaagacgctagtctgaaagtaaatctgaagaagagtatatttgtaaaattgctaaaaagttatatatacctatgactgtcattttctcatttcccattccttcaacccattaagatataccctccttctgtttgacattaccagaatcactcctctattttaattatccaataataggtatctttccctccagccattctttaaattaagacaagtcatacccctaaaaccaaggtctgatcatgtatttcctaagtagaaaacccacaaggacctttgttcactcagcaatgaaagattctggagccatggatttcacagccttttgcaatataatctcaactcgcatttagcgatttctcactagatgctacccctctctttatccttccaatctcagcctctgatatcatcactatagttagaggagactgctcactgtcccctggatatgccatttatttactgcatttgtgcctccgcacagatgcccagtttgagatatcccctctaacatcaatcttcaaatctctgctatctcaaatactttttattgaagacttagctgaaatttcacctttctgtgaaatcttcatcaatctgtcagttaacattattttttctcctctttcctgtattccttagcactttatttggcctgtgttatacttataatcccattctttgggtctcatttctgactaccccactggggtagggaagcaagacattttagacacattttgagactttgaggctgatgttatgaggataactttgcctctctacaatggaacctctggtgctgaaatcagaagactgagctagaaaaatcagaggcctgacccagtgtgtcagtttctgtcatctttagcttatctcagacaccaggaaatttatagattatatgtttgctccactaacatgatgagtctaatgctcatgggacagctaacttccaggtagtgatgactgaagaagtctactttatttgcactgaatgtttatgtagcattgggtggatcatattatgcaatatctctaggccaaagcatcattttcccaacactcactttcctaacctttagataactttataaaataatatgagtcatgcgttgcaaaagattacaccttctccctacaacagaaggggaaattcactgatttccactcccttttccttattctcataaatcataaacttaaatttaccctagggattttatttctttgaactcaatgtacaagcataaaacaaattttgttctcacaggacatcccatttttgtttcattagttcaaggaaagggtcactcaatttttaaagcatttggtttgatctttgctatgattcatgctacctaacatccacagacacactctatatactgaaatgtatcttatatataaaatgtgtctccatggaccctataatggtggtactctcacgtaaagtactcaaaagctgtattatggatacatgagtctaggcagggtaaccagaagtagaaaataaattaattttgttgaatatttaaataattgttgttttgcccaagttcctattacacgacagatttctgtttcttcttatgaaaggtaaaatacttccctggggctacgggaggaaatgcttgaaaaaatttcaccaaatataaggcctagattatactagttctattttatacatttttattctatgttcagccatctcactgatatttcattccacagagagggaggtgataaaatatttttttaaggtaataaaggaaaaaggaaataaagaggatttgtcataatttaactagataaaaataattcttgtgatcttaatgtaagaatagactatgatctctaaaagaatactgaattatggaaacatgatttttacataatagaaccatttacacatagaatttaatcctactaaacaataattcttaaggctctattggcttatatacatttttgtctctaaatcctttccagggcaccgttaagttattttaaaatatttcctcattgtattgccatggaagagattctcccttacctcttctcatgaccaaaattctatttcccatgctgggtatcgacagggaaccatgatcatcaacctttgcagagaacttctcttcatgagtttaagatcacagagatttatttgcaaaaacaaatagggagagagattcggcttaaaattttttgccagattatggccattatttagtcttaaaaccctaaaggtcttagataggagggtcaaacctagtacagcactgttggagcctgcaaatggcagctgaacctgggaggaaccagttatttccagggcatttctctcctatttcccacagtaaaaaagttgtccaatttagaggcatttggtatagctagagtaaggaggtaaacaaacatgctttagaattccatttcattgacaaatctgaaacacagatcaaattggccttattccaagactaaacagccccccaaatcatctcattttgtacagcagaatctcagagcttccaacccacctatggcacaagatcctggcctccagtcagccagctagttatccatggaagtggctcaaggctgacactcagattgactggttcacactaatttacttcacacagattccatttatctcctagaagatcccctggcagcagcttataatggcatatcctaggatgcctgcctgcatgcgtgtttaaagcaacagcgcttgatgaatctgagtccagaaaacagttcacagattgaggagtaggtgcaatcagaaaacatcaagaggcacagctgggacttggtggcttgcttgactggtcagagcagctgagcattaagcgtgtctgcttttctgctggctgctcaccatcaccaggacaaatcagagagccaccccctttttcctttaccagtcaccctccaaaggaaaagagaaaagaaagtatgtcaccatcccagtagcgtgtgcagctgtagagaaagctaatttgatcatttacctttacttcttaaatacttcgatattattctcagtagaactacagctggtagttctaaggttaagttgttgaatggttggattggcaagatgtagttagaaaaagtggaagagaacttcaacttattttttttactttcaacaatgagtcccaaagagctgtctgaaacgctatgatcatggggctcatcggtcgacctccaaagaaaggaagggtgcctttctggttactctcctacatctataagagagcttggggaaatatacaaaaaagctggatatttatctaatgagtaaatgggtggatgaatgtatgaacaaacaagtcactgttctccagctgacgttttagaagtgtggtgaaccattgcacagtaacatggtcagcctccaaaggtggagagaattgagatcttttaacggcattgaagctaaaagttttaaacaatgacaattcactgagaaatgtaccaaagcagtgacatagcacatttagtacttataaggttaaacactgggctgcagtagctgcttgaccgtaaaaagtaggattaaggcttttgcatgagccttgacatgatcctgttgtctgtctgctgccttaagctttgaaaaacagctgggatcatcttcttataagctccagctcaaagatgtttaagcagtccccaatccaattaaacagaggtaaatagaaggaagaattgtactgagcaccatcatcaccttttttcttaatgaaaaacagtgtaattgcgggttacacagctccttaatctcacattaaatctaatagattgctgacttatactgagcatgacagtcccagctttctatattggtgtgcttaattttaggtcattatcctttattatgtgacttgtaatccttaaagcccatgattgtgtctggatatttggcaaggattgtatttggtaatacaaggattctgcttctaagagtgatggtttaattgaatgacattgtataattattagatgttcagagaattacatatatttctttccttttttaattggctggtttcttataagtgtttccttcaacaaacattgttcaagattattattgagttttaggggctcttctgaaaaggacagctttcacaaatgaaagacaagtagtttattgatatggaaatgtatctaaatgctattaaaatgcccagttcaaatacaatcctggctcatctacaaactgggaaaccttggtcatgttactttacctttctgtctctgtttcttcatttataaaatagcaatagtgatggtgcctaccaggggcaagaaactgttgttacaattatatgagttaaaacatgtaaagtgctcagcctaatggctcaaatgtagacagtctaagtaaattcagtattattattatttgtatatctgtctttgtctagaaatatgcataaatgtaaataagatgtccagccttaaggtcaagacattttattttattttactagcaatgtagtaatatctaaaatttctctaacctagtaatagaagaaatattttaaatagctatattatcttgatcttcattgaagactgtagaaatctacaagttattgttagtggcccccttttattttaccagtttaaagaggcatgtccatttgtatctattaactaaataaaaacctgtccaaagtcatctgtaattcttttttcttatcaagagtgctgaatatggaaggaagtaaaagtgacttctgacaatgctgaccagataacatagaacctcattggaaagttattctaaatagcttttttaattttttgctgataaattaaataaaaattaaatggaatggaaatgatgatatggtgatatactttacatatatattagccttttagagaactgatttgggtttggaaatttaaattattgtatgtgcacaatcaaatttcagcttatggatatgattagatcataacattttaaatgagcaactataatcttttatatttcaaagtaagaacaggtcttgcaccatcacttgtgcatggttcttgattgctgcttttttcctggtttccattcacacattaagatttaagaaatgctagtattgaaactgaaagtctaatgaagctcagctccgtcaatggcaaacacattagtggaggaggtcatttgacggtgtatacatctaacacacagaaatagtggtttacttgttattaacattcttctttttcatttctagggtagaaagcaccataaaacctcatataaaataacatcaaaaaattctctttttcttgaacaccaggttaacattgggtgatgcggaatgcattattatatccattttagttaattttaaaggtgaaaaaatagacttattttggtttattataaaaagttttttgctgtgtttttatcttgtttgacccaatatttatactgctacccgccctggctcacccacccctagacacacagcagatcacagaatgaatcagatcactgcatggttctgatccttctataaaagcagctgaaataactggatcagagatttcatgactggtctcagtaagtacatttagatataagtagtgccttgcttttggtctttacaacacatactccatgaaactcattaatttgaacttatagataatagcaatattctatatttgagcaaatttcaaaatagtgatagaaaaataagtgggtcaagttactcataagggaaaaaaataaaattgtcaaaagattctgatgacaacactttaccccagaaaataaagtaacatacttaaaaatttaagagaaagaaaaaattgaactaagattttctatccagcaaaattgacttttaactagaaaggctgcaagttaatataagcatgcaataacttaagaaatattgtttaaatatgcctttcctgggtgacctactaaaaatgagctttagataactagaataattgaaaagccatcagcatcagaataagaggtaagcactaaatatacatttacctgtagaactaaaatcaaatgatggttatagaaatatggctgtattctctgacaattcatagaacaactatgaaaaatgcaggtgatcagagggatatggagagtgcataaaaagcaggataagctgagtaattacatagtaatacatatacttagtagtatatgtattacctgagagtaaaagagtatcatttcaaattagatgctggaagagagaaagtaaaaatgttagtagcaaattatttcattattgctaatagttgagggctaactggcaatgagaagaaaggtaatacgtaaaggttttagcataaaggtaaacattaggaaaaaaaaaaactaccaaatactccctcaatacctacatacagaaagtgagagagaaagagagattttgaggaaaataaaatgaaatagatgacatagtaaaagaacatatatagtttcatatatttgtgtctatgtacaaacttaccatctttatcaataaatgttaatggacttaattcacctattagaataaaagagattaagattgactaacaaagtaaaatctaacactatgttgtttttaaaaagatacatcaaaaacaaagagttaagcaagattaaagataaaaggatagacaggatataaataaatttttaaaaagcagtggtcacaatattattgagcatggtggaatgcaaaccaaagagcaataaataaagacacagagaagagtatttcgtaatactaaagactgcaattcacaatggaggtatttcaatgactaatatatgtgtaagtaataacacagctactttaataaagcagaggctaaagagaatggaaactaacgatagataatgttagcacatatctctgaatataagacacataatggggacgaaatattgacaagaatatagaaaacctacagaactaagtcaataaagtagatgtaataatcaaactctaatgccaatagtagacagtacaccttgtacttaagtgcacatgaaacatttaccaaaactggccacatcttattttccggagtgacccctccaacattccaggaatggaactagcacagaaaacttctctgatcacaacgcaataaggctagaaattagatcgttccacctggaaatttcaaaacacattactaaataattcagctcaaaagggaaattcaatacaaaactgtagaacttaaaaaaattgtaataatgaagacataacaatacagcaaaccaaaggaagaaagaaaaaaaaaaaaaacaagaggaaagaaagacaatgaattagaaagcagtaaaaagaagaacaggaggagccaagatggctgaatacgaacagctccggtctacagctcccagcgtgagcgacgcagaagacgggtgatttctgcacttccatctgaggtaccgggttcatctcactagggagtgccagacagtgggcgcaggtcagtgggtgcgcgcaccgtgcgcgagcctaagcagggcgaggcattgcctcacttgggaagcccaacggtcagggagttccctttcctagtcaaagaaaggggtgacggacgcacctggaaaatcgggtcactcccacccgaatattgagcttttcggaccggcttaaaaaacggcgcaccacgagattgtatcccgcacctggctcggagggtcctacgcccacggagtctcgctgattgctagcacagcagtctgagatcaaactgcaaggcggcagccaggctgggggagggacgcccgccattgcccaggcttgattaggtaaac

SEQ ID NO: 1034 - DNA, 27363 bp, Homo sapiens; identical to SEQ ID NO: 1033

SEQ ID NO: 1035 - DNA, 174223 bp, Homo sapiens
gcactccggccgggctctgctggctgcggcgggagctggacgcgggaggaggcggcggcggcggtgagtgagctccgggctggagcggggcggggtgtgcgccggcagccgggtttcggggtgctaggggccgcccagggcggcgggacccccaggggttcgggctcagccaggtgcactgtgctcagtccgcgcgtccactctcggtgacccgcgccgcgcgtgtcctggggctcgaagatgcgacccggactcccgcgccgcgccccgccgagggcaggcgcagaacagatgcgggcgatccctggggaacccgcttcggggcggggtgggagggaggaggccctgcagaacctccctttagtgaagagggactttctgccttcgcacccctgcctggaccctccggctctagtgacagctgggagagactcacacgaagcagtttctgacctatcctgtcgtacacaagtcctcggcgtgctcggccggaccatcccctggaaagaaaggggcgtgtgacctttctctccccgatcctccagaccactgcgccgcccagggaggtcatccccgagagagcccccgcctcactcggagcacacattctagctctccccgggacttttccaagttgcatcactgtttggcctctagacaggtacttggctgtcatgttggagttagttacacaggatttttgaaactttgtatatttgctttgtgtgttcttcaccctaaggccgctgccctcccgactctgcttatgccgctcaaaacgttgctcaaagctcgctgggaatgcttttgcgggcattggttctcaaacttggccccacatctggagagttttaaaaaatactggtgcctgtgtcccactcccagagatctggattcggcttgcctgggttgcagcctggacaatggaatttttaagacgccgcaggtgattctaatgtgcaggcaagtttgaaaacctctgctttgagagttgctcccaccagccactcttcggacggctcaagatcagtcctgatctagaactcatctcaggtcctcatagctcttccctaatccacctctccacctgaagaacctgttgattggtgctttccaactttagacagtagatggtgcctttactgaagatccctttgtttctacctctctgtttacagtcaatactgccagggcactttctgccaaggaggtgggagtgtaggcattagaaccgagcagtccttgtcagggtcaaggttataatacagggttgtcctattcagggaaaaccaagtgataatttgacttgtcatattcgggaatgatttcagattaaaaggagaaaaaatactttagggtttggtcagcttttggagaccctccggagactcccccacgtagataatggagttgcataaatgtggagaattttccttcaaaaagccaaagctaacaacatccttaaggttttgtggttgatatttgtgttaacataagtccatttttgtagattaaacttattctggaagtatgatgaagccctgcagacagaacacagtgtataacatggcacatctgagatgacacctgagacacctgtcacatggtcttaaaaatgatagagaagtaggactaaggaaaatgtaaccatgcttatattggctaaattaggtcatatattttatcaagaaaatgtgttttcactgccctttttagtaatgtgatagtctccggggatcttggttaatttacttttgtaccccaaatatgatgtttgcattaaaatttccaccctgatgttgctacctgaccacaaatcagtggttttaagtttttcttagggggtggccctctatgtgtttttttttttttttttttttttttttttttttttgagacagagttttgctcttgtcgcccaggctggagtgcaatggtgcaatctcagcttacggcagcctcggcctccctggttcaaatgattctcctgcctcagcctcccaagtagctgggattacaggcacccgctaccatgctcggctacttttttgtatttttagtagagacagggtttcgccatgttgtccaggctgttctcaaactcctgacctcaggtgatctgcccacctcggcctctcaaagtgctgggattacaggcatgagccaccgtgccccgcctgtatttttattaacagtgggatgacatccttccaagaatgccttgctgaagtgaaagaacatttacattcatttctagctgctaatgtaagtccaaagaacattcattttgaaaaatacaaaaatgacataattttgcccacttggttttctcgcttttccccaacttccacgaccatgctctgctgctactactgtattcacttgctggaggtgtgcaccctgtgggagccgtcttcattgtcttggctttggcttgaaatggaggttacatgcagcgcattgtcttacagggtgtcccctgacccgaatcatcaccctttggggagcaagactatatggaaagtgttttcctactgttttttttgtgtgtgtgtgtgtgagtgagtgagaccatgccaacaaaatgaagccatattattaaatggtttgttaacttccaaatcttgtctcaattgggaaaagaaaaatgcttattcgaggatgctgttgaattcatggtgtctgaaaagtcacccctgaacagcaatagttacactgtgaatataataatacactctacccccccaaaaagaaaagtttatgtaaatgtgggcctaagcacatttattgcaatttctcactttggagtagcagctctaatatcctaaagtgattagaagaaagtaagtgaagaaaaatatgaagaaagggttagtgagatactttttcatttagggaaaggggatacagcaactagaaaaggccttgggtttgtgttaagaatttattgccctggtggcttcctttttttctttgtttaatttgcttgtgctgatgggtgagggagagttaaagaaatttaatggcctcctaactctctttccccgtgaaacccatttatctaagagatgccattggccttttaaaaatatccaactgattttatgcttttcctttcttttcatcttctgatctcggcactaaagggcggtggcatggctgagaggttggcatcagagcaggaaaacaaagttcaaggggaaaccaaaaattgggtaattttctctgaatgaccaagtgcttacttttttcaggcatgtgacattgctgttatcaagaaaccagttatgacatgaaaatcctgaaaatggaaaaggaaaaaagaaaaaaaaagggaatggggtgggggatggaaatagcaccagggttgactgacctttaccgaggagggaaggcttagtgttttcagcctggtgtcccccgtgtcccgattgcagccccctgtacttctctcctcatgcaccctcctgcatccctcaagccaatatccttgggggagatagtgcttcatcttaaattcacactaaggtgtctttttgtttttgttatttgagactctgctctgtcacccaggctggagtgcagtgatgtgatctcagctcactgcaacctccgcctcccgggttaaagcaatcctccctgcctcagcctcctgagtagctggaattacaggcatgcgccaccataccccgcttatttttgtatttttagtagagatggggtttcaccatgttggccaggctggtctcgaactcctgacctcaggtgatccacctgcctcggcctcccaaagtgctccgattacaggcatgagccactgtgcccagctgttagtagcccctgttactagcaaaagctatgtattacccagagttgttggtaaacaggataaggttcctgccttaaggggcctgagtcaggtggggatgtaaaccctgggttgcaataagttaggaacttttctaatcaagaggaacacagtggcccgtggggtactgtggggcacctggctagcctcgcctgggtagatgcctcctcaattcattggcacaggaggcataagacatgctttacttgggtttacattaaagcttattctattaggcccgtaccccaaatgactgattttggaaatgtccgactccaggagcgagaagggtgcaggtatccatcatgcaaaggggaggtgggaggtggaggaagagaacagattctggcaggtgtcttttgcttctggagtctactgaacaggggtacttcctgggagtgggaagctcatggagaatgtggctggatccatttttggcacattagtaactggtaaagtaagcttagtagcggctacctccgcaacagagctgaaaggagaatgcaaagtgcagtgtgaaagccgcagctgcagcactttttggagcaagtggttgggtttgtatctatggctcctgccaatgggcagacattggttcctcatcataccatggttgctgtagctcaggcttccttgggcaggctgaaaactggacttcacactgtttttcccttgggtaggtggtttccaaatagctgacccatagggctaataacctcatggttataatagttactatttgtttattgactgcctttcaagtgccaggtagcatgctcagcacttttcgttcattactgtaaaccctttacattcctgagaggcaggtggcagtgacctcattttacatatgaggaaactgaggcccaaggaggtgctgaatcctgcaaaggtgcatagtagttgacagtggcaaagttctcatgcctgtaatcccagcactttgggaggccgaggcaggtggatcccttgagcccaggaggtcaataccagcctggacaacatgctgaaataccgcctctacaaaaaaatacagaaattagcctggtgtggtggtgcgtgcctgtggtcccagctactctggaggtcgagatgggaggatggcttgagcctaggaggttgaggctgcggtgaaccatgatcatgccactgcactccagcctgagtcacagagtgagaccctgtcttaaaaacaaacaacaaaaataaaatggcagagttgaagttcgagagtactctggtctgtctgaatacaaagctaagttctctctactgtttctcgctcctcttaagctgagctgattaagaaattgtgttctcagtgccttgtttattttttaacatcacagtctccttaggtctgaactgatttactattttcctctacctcgtgtaaataggaattttactattttcctctacgtgaggtagaggaaaatagtaaatcagttcagacctaaagagaaagtattccgctaaaggccactgcgaccttgtgatcccaagggaaatttatggactgctgcttttctaggtgtcttaaagaagagggtagattaggctgtgcagaaagtctctgaacgggtcccacatcctaggttagagagacgtgatttccacccttcttcaagttctgcaaacctctgagtttctgtagataattggttgttgggtaagagattaaaaacaaaattcagcgttgggcattctagaataaaacgaagctgtgcacatccaattcctgtttatgtggtactcgcgacaaaaacaaaactttgctgcatagtaattacctcaagctcttaaaattacaggtagtaagggcttagaggccatatggagttataattagagatgagtttaaaaaagggctagtgaatgaatgttcattactacaatgagcactagctgaatatttcaacccgagaaggatcagctccaaggaacatttccagggagttagcggagggtcgtcatggagttagagtgtttgggattagtgcacagagcatttgttatgaacgtgcaatatttctgccagcctggccagaagcctctttgtttacagggcagggtttcttccctgctgcccaatcacagggatttctgctttgctttggtagagtacgtaatcgttcaggtgattgctttgtagtgtgttaggtctgtaaagctcctcgactgttaataatcttttcctgttacttatctctttgctggaagattgaggtaagatgacctctagttttggcctcaagaattctcttgtttttgaccttttcccttagttttctatctttgtgtttcattgcattcaaaacaggccctctgttttcccttgcaaatttatagtccacatagggaagaggaacgactgtgaccaggactatccaggaatcctgtgatgggagtgttgttagtcccattttccaagtgaggaccccttcctctctaaggctgggagtttgggtattccaactaggactgttaaactttcaacaatggggctcttttgacttgattacaaaagaaaaggaaatggcccagttttcaaagtcatgaagaggttctagtatatcttatgaactaatatatatccttgaactcttttgtagctgacagtattaaaaaaggtttgattccccaccttttttgcctgtgtggtttttatcttcctttctataaacaatgacttactcagaattatacagcagcagctgaaaagttgattagcctccgtccttgccctaatcaagtatcaaaaacctggaatgttcacttagagtggtgattactgtgaaagctttaggtgctggagaggacctgataaagaatggagtgagagataagagagagagagaaaatagcttgcaaagggattgcagggtggagtttaacaaacttaagatttctttcttcctttttttttttttgtttttttgatacagagttgcccagccttgttgcccaggctggagtgcaatggcacaatctcagctcaccacaacctccgcctcctgcattcaagccattctcctgcctcagcctactgagtagctgggactacaggcacgtgccacgacgcccggctaattttttgtatttttagtagagatggggtttcaccatgttagccaggatggtctctatctcctgacctcgtgatccgcctgcctcagcctcccaaagtgctgggattacaggcgtgagccaccacatctgccttttcttttcttttcttttcttttcttttcttttctttttttttttgagataatctcactctgttggccaggctggagtgcagtggtgtgatcacagttcactgcagcctcaacctcccagactcaggctcaagtgattctcccacctcagcctcccgaggagctgggaccacagatgcaggctactatgcctggctaatttttatgtgtgtgtgtgtgttttgtagaaatggggttttgccatgttgcccaggcaggtctctaattcctgagctcaagccatccacccacctaggcctcccgaagtgctgagattacaggcgtgagccaccgtgcccagcccaaacttaagatttcttttacttgtgagtttcaggtttggggcttaaatgcatttggtctggttgtggccagactagctcagccctaacagtctgtgctgccttgggccacctataagctttggggagtggggtgggtgggttgggaggagaaggtagggtgaagggagaggggaaatagtgggtaggagataagacccaccagttagctgattctccaggcctggcttgctcatggcatgactgcttctccctgcaggcctgagtccaactttctgggtgtgaggcagctggatggggtacaaaagagggagagagttgccagacactttccaggagacctgcccaagatcagtaattctcataatagcaaatgctcccatagcatttgcctccagccccatcctagagcttttactatagcaattctatgggataggtgctatcataaacccattttacaggcgatagaaacaaggccacgggaaattgggtaacttgtcaaagtgctgaaatccagggttgaaacccttgctgtccggctctgagctatgctaacaactaccacctcattaggcatagaggcctggatgctgcacctgctcttcattcattccttgaactcacccacgtatttcttcaacaaattattgatagcctgtatatgcctttatcttggcaatgagaacaacataagtgctctttgtttatgtgtctgaattcccataaactttattttctttcttttttaaaaaaattgccataaactttcaaacaaacctttaaagagacgagacctctttactgaccttgtatacctggtgtctggtagaaaataggtgctcaataaagctttgtggaagaaggaagaaagacagtgttttgaaacttgacatccttgtatttcctctgtctctagcagccacagtgatatctaaacagaaaaacagacaagccttaagtaaagtgagagtgtgtggggagtgttttgcaaaaataacaggagagaatttttgataaaagcatgctgtcttgtatgcatttcaagttctcatggtgaatcattttttgcttgtttgcttaaagcatttcttatctgaagggcatcccgacacccagcttgcagactactgagtgaatcagggaggcccttcagacttccatgcattgttcggggctgctcttgtcatcagggtctgcagaatatattttctttgcagttgaggaccaaatacctggtaaggttcaagtccaccatccattttcctgtttaacatttaaatgcatgagctagtagaaagtagtttcaccttgggctgggtgaagtggctcacgcctataatgctagcagttttggagtctgaggcaggccgatcagttgggatcaggagttcaagaccagcctagccaacatggtgaaaccctgtccctgctaaaaatacaaaaaattagctgggcgtgggggcgcatgcctgcattcccagcttggcttgaacccaggaggcggagattgcagtgagctgagattgtgccactgcactccagcctgggtgacagagaaaaataaagtagtttcatctcctgtattttcattccttcttcacactgtggggcaaagaaaggtctcattcacttggattggaagctctatttgacgatcactaggagtgatggctctttggttcctcttccatttcaggtttgtttcctcctctgtaaaatagatgtaatgcctaccccatacagtcaagccatatctctttgacatagtacagtggttctcaaacagggtccccccaacctccccacccgggggtacatttgacaatatctgggggcattcttggtagttatgactggggtggtgatggctcctggcatctaatgggccaaggccaaggatgctgctaaatatcctttgattcaaaggacagtcccccacgggaattatctggcttaaaatgtcagtagagccaaggctaagaaaccctgacaaagtggaacctcaaacaacggtagctctttttaacatctctgatccaagggagctattggccagggacaaagatccctcctttcttaagtagggtggaaagaatggaatttaacgttttattgatgcctctgggtttccccacaggtgcccctgaggtgggaacacctccttttctctccattaaacatgacttaacttcatttgaaacttgcttgcatcgtttacatataaatagccatgctaaaaccagtgaaaccacttagcctgtggggtggttaaacccattccctgcagaggacattggtggagtggggcctgtgctgctacaggcttgtgagcctcgcttttctcccctgttaaagggcagataggtaattgtgtcaccctcccatctcgtcatgttgctctgactctgcacgtgtgaaactagctctacgtatgtgaatgtgctgtgtgattcctaaggtatgccttttgaaggcatttttcacgggatccgtttcagtcaaggacactaaaatggttggggctcaacaaagaatatctgtgttacgggcatagtaggaggccccccaaatagttcctgcagcagggtgtgtgattcgggaagcagtgtggcccagtggttgacagcatgaggtcagccactcacaggctgctctgtgtacaacctttggcttttcccgtgcttgttgtgtgaccctgggttagctacttcacctcgttgcacctcagtttcctcacctgtaaaatgaggataacgacagtgacgacgataacacccagctgaagatgggtgcgaggcttcagcgactggtccttgtgaggtgtgcggtgaagatgggagcttagctcaataaatgagttgctgttagtaaaatactatttgatgttggcttgtagcttgtgtatttttactcagatgaagagcttgctcctgatttaggagctgaaaaaggatctttctggttcttggtattttttttggtggcaaaatacagcataaaatctccattttaaccaatttaaagtgtacagtgcagtggcattaagtacactcacaatgttgtgcaaccatcaccactatctaattccaaaactttttcatccccctgaaaggaaaccctggacccgtagagcagtcactccacgttcctcccttcccccagccactccctccctgcgagcccgctcatctattttctgtttctgtggaactgcctagtctagatatttcatataaatgtatttcatgcaatagatggccttttgcatctggcttctttcacttagcataatgttttcaaggtgccatctgtgtattgtaacatgcaccagcacttcaccactttttacctggtgtcttttttgcagagcaccccaagcctcagtgtcatcaggcctgtggttctctgaagtcatgccctgttttcaagttttaaactgtctttcttcattgattttgatccttcttggccagccttattttttccacttttcccatccagtacttctaatgacccttgaaatgaatgtggaatgaagccctcatgccaggttcttggtgctggggaataggtcttattaggtatcttacttctgtgaaagaattagcagcaggagcacacataggggccctgagtggtgcttcatttccccatgactctgcgtgacaggttttaaaaacaagtgtctggaaaacaccaccaggccccttttattcatcagtttaaaagcttcccacaatgagaagtggccctcaattaagtcgtttaataaaaacctccccctgttttaaagcattcttgggaagtgtttacatttgacgccactgcaggcttctaaatgaggagctgtggagtgagtgatccttaacctgtgactttaataatatcctttgctttagatttccaggtggaggcctgggccagatttgtagcttgtcattgacccagactgggttcagagatgggggctgggcagggggtggaggacattcttggctatcctgcccccctcagctgccactagtagaagattcagaaaggctgaaagccacatagatatgtaaaaccagctccttggagagagactggactggaaggaggtgaagcatttccctacctgggaagggcagttaccctgccccacttctgaccttatctgcagtgtcggggggcttcagtgggcagagattaaagcatttaggagagcagtgccaggctcctgagattctggggccttagggtctgagagctggaggaggctctacttttttctctgattctggagaggtgagtaggccccgagaagaggaagcaggctgctttagcttcagggaaaactccggagttgtcattagaggagtcctgggaaaagctaaaataaagaaaattctagggtggtctttcctttgtgctggacgaagacaggagggtgaggggagcccggagctgctgacacgcactggtgatttgtagaggttgccaaggtgggcagttagcagtctggattctgggcctggactgcccggatctgaatcctccctccggggttctgttctatgaattcttgtgtgtccagtgctcagagcagtgtctgcagaggtagctgtagatatgtgtgctcgcacgactgtactgacacttcactttggtgagtttctggttagaatcatagaaatgcttcttgttatcagagctaatttgcctgcatacctggcagccttgtgcagtccatgggacagggtgatgttactggactctgaagaaaacatgactcgcagatggagaaattatgcttggcaaatctattaaagttctccgagggagagaataaatgtgggaagaaggacaaaccagtggatctagattttatttagacttccaaaagattgttggaaagacttcatggcaaaggctattagatgtgggagtctcccatgactttctgagtggaggtgaatggaagaaggagtctggctgaaatttgtctttttccattgtcctttagaggaggaatcttcacatttgcagatgaaataaaattctaaaggtaaaaatgaagacttcggagtcaaactatagagaggtgttttttttttctttttaaatttaaattttgggcacgaggggatgtcaactaccctttaaaataattcgtgatcagtggctgcacctgggcagctgggctttggaactaggaatgatgtgtgtgctgctttctagcaaagttaaaaatcatgtgcctggggcatcagagtgctcaggaaataaatgaagattagtggaaccaaggagttcattaaaaatgattcaagttccactccagcctgggcaaaaagaacaaaactccatctcaaaaaacaaaaaacaaaccaaaaaaacctgtagtttccaactgtcttttaagtgaatagtacatttgtagaaaaagtagattctgctatcaacaaatgtaagagttcacttaaatgcacagatgttgaatttcatgccttttgtgttttaacccaggatagtaaatgaatgaatgaaatgagcagacactttttcaacacagacccttccctctcgcccaataggatttaggaagcttggagttacgcttgaccaaaaagacacgtgcaggagttagttacctttgtgtttttctttttactcagtgtcctgtgggccttgcctggtgccttatgtataggagtgctctgtatgtgtttgaatgataaatggactcagatttccttaacataagcgtaaatattttatcatcgtgtgtcattatgtgccaggcaaacttagttatatttgctcttacaatggttgtattggatattgctgcttaatattgccgtgtaacaagcaatcccagatctcagttttttgtttttgtttttttttgagatggagtctcactctgttgcccaggctggagtacagtggtgccaccttggctcactgcaacctcccacctcctgggtccaagcgattcttctatctcagcctcccaaggagctgggattacaggcacgtgccaccacacccagctaattgttatatttttagtagagacagggttttgccatgttggccgggctggtctcgaactcctgaccttgggtgatccacctgccttggccttccaaagtgctgggattacaggtgtgagccaccgcacctggccccagatcccagttctttatgaccacaaaggttcattttcccctcgctcagctgttggttgggtgtggtttggttgagccaggctgtgcttcacttggccaagccagactccaggcttccatctgggttgaggtctattccacatgtgttttattcagcagcccaggctgcaggggcaacaaatatgcagggccagcttgccttgggcagattacagaggcataagaaggcaagcagaaatgctggaagcctcttaaagctttggtctataagcagcccactgtcagttctgccaagattcccttggccaacacaaattgcattgtcaagccccacatcagcagggtgaggaagtatacctggccagttctagtaggaggtaactcgaagtcatatggcaaagaaggtagatgtatatggaggagcaaagcactgagaacaataatttcattcacaatggtagagaatgaataagacggaagagagcagtttgggccaaactagccttttgggagcttgcgagacctaggctgactgggtgaaaaatcatatgcatttggtgcaggtaccagcccaggccttggcatttcctgtacattcgctggcatgcgctgcctctcggctggctggacattgatcatatcctttcactgcgatggggctcgtgggagtgctgcctatctgtgggaggagcagaaggatgggcctgattttcttcgggttagccatcatgacctgacaggctgccagctgtggtggcaggagtgtgacaagctgagagggcaaagaggacaaagaaggaccacagtgttgaaggaggccaggggcttgcctcagcctaagtcccacctgtaatagtcagtgacaggttagcatcagtgcctgtgtgtaccatgtcccaatcttcataaggatcctaggctgtagcttccagaccctgccttttacatccaaagaaacaggcttcaggaggtgaggtgacttgtcttcagccaaccagctcaaaaatggcagatgagagccaggccaccctgttcccagtctagggtctgtctttccacaccctgtggttgtcatagtctagcagagtccggactggtgttgtgtgttatagtatattctggccctgtgatgacagagtctgctttggaagaagccatgtgagcctcgtgcccataagggatgacataggcgaagcagaatgagtgaaatactggccaatgataagcagccttgctgttactgctttgcaatgggccatttctttagtgaagagctgctagactttgaggaagaaaaggctctagccacttgtgaaaatgaaccaggaatagatggggaccaaaaccttgtaaagccaagggtgtgaggagacagacactctcacatgtgctgagtgtgggattataaattcactgggcttctatctagagagcagtttggcaatggggctgcttttacttgcaagtaaacaaaactcagttgaaggtggtttacataagaataaaaacagcaaaaagtggttaaaaagtggtttaaataagacatttcaaaatgacatttgttacctcatgtaaacaagaagtccaaagtctgggctgttgggggagttagtttgaagacccaggcttatttcctctttcctcgcctcagtgtttgatgtttgccttcaagcttgtttcctcatgatctcagtgtggctgttgctgctccacccatcgtatccttattccatatccttattcagagtgatgtccacaggcaggaaaagaggaaagaacagaaaagatgcaaatcagcatgtattctgagatcccatttttttgttcgcaaaaataaacaccttcacatttttctttcccccccctcacctgacaccatcacaataaaagtcttaattttttcagcaccataagatggtgaaaaaaaagtcttaatttttgattgtgaatatcaatttctggaaccaagaattttggttatttctgggccatgggatggtgctgtggttttgttttccatttcatgcccttcttggctgtttgaattttataaatatcactgcatgtattacctttataatacaaaagaaagtgataggtgttttcttagtaggggtgggagatattaaagagaggaaaccaaggccctaacaggggcattatctgagacatgatgtgataggataggagtgcatttagctgtgtgtgatcagcctagagggaggttggggaaggggaaaagtccaggagtgaaataaggtcattttaaatctcttttggtacctggcacagtgtcttctacctagtagagacaaaaactcatttgaagtatgaatgaatgtttaggtcaagacctaacacaactttatgaggggctgaaacccaaccaagcagctcaagtcagcaagaaagtacattctgctggaaatttatcttgcaaagaagtatgactgtcatttcctaccttttccttgagctcccagaatctaattcattgctaaggaaacagtgtaagtatgagaccttctgttcatcatctgtctcctactgaaggctattgtcccaggatctggataataaagctgtataaggtttttacaactgagggtagagcaaaggcaagaaaccaccatctcatgttaactgtgttaatagtctgtggcttgaatggagtctagatgtttaaagtctactaagtgtagaatgaacagtcatttttttttaaaggaaaaataaagttctttgataccctggactaatacataaaaaattgttatcttaatgatgtgacacagataacagttgtgagatagggattttcaacctgattggccagtattagtagaagagtgtgaatatgcctgttggtgagatgaaagaattatatgtagtggtattttcaagtctaattctcttccatatacaaaaataaaatgggtattgaaggcctttttaatggcaagggtggaaggaggggaggtagagtactacccttacattgtgccatagtcttaattcccttgctccagggttctaagtttgatgctcataaatcaaaagaaagaatgttgtaactgacatttctattgagttacttttaacttttgtacccttgggttttagcattgaggccttctgcaatggccaccggatacccactttattcagacaatgataatatcgttgagctatggtaagatcatttcctttggaacaaaatgaaaagctttcagtgttcacaattggaggaaaatgtaaaagcttagtaggcctcctctgctgcagggtgaagagtttgtgtttgaacaccatccactttgctcctcaaatgtgcagtggaatgattccagtgtgcttttgaaatacagaaaacaagtgtaccttttcagtgtgtgtgtgtatttatgcatgtgtgtgtttaatgggttcttggaaatacttggaagaaaagtaatatttaacatctttttttgggatcattttgggatccaaagaatctgagatcattggtacgttatgttccagagtagccccgagttaaatttcttgagagagagagaaagtgcatgtgtttgtgtgtgtgcataagtattactctaaagaccaaatgtcatgcttacttgacatgatcttagtatatatccttatctgcttctcagtctatattatatctgcagattttgtgactaagtggtgtaattttacatgaattctgcatctgcatcagaaagtatgataacaattaatgatactaacacttctatgtcactaaacagtgcttgatactgttctaagtacttaacatgtattaactttttttttttttttttttaaagccaaagccttttgtcacccaggctggagtgccatggcacgatcatggttcactgcagcctcagcctcctaggctcaagccatcctcccatctcaacctcccgagtagctaggaccacaggcacgcaccaccaaaccagggtaatttctgtttgtttttttttttttttttgagatggagtttcgctcttcttgtccaggctggagtacaagctcatgttgcccaggctggagtacaatggcgtgatcttggctcacggcaacctccacctcccgggttcaagcgattctcctgcctgagtagctgggattataggcatgtgccatcaagcccagctaattttttgtatttttagtagagatggggtttctccatgttggtcaggctgctctcgaactcccgacttcaggtgatccacctgcctcagcctcccaaagtgctgggattacaggcgtgaaccaccatgcccggcttatttggtttttatagtaacgctattgattccatttttaccaaggaactgagatacagagagatttagtaacttgcccaaggtgacataactagtaaatggtgggggtaggttcaaaatcaggcagtttgctatttcttatttaaagccacaattcatgagaattgagccattctcaaatgtacaggttattcttgtaaattggagactattgtatcagtgttacaaatgacctattgtaatctcccatccaagaactaaccatttctgaccctgcttagtgtcaatagtcaggtgcattcagggtggtgtggctggagatgatcttatatgatctgagccccttgcttcatgaacaatattttcagttactttacacagtaagcacgtacttaaacaattatttggctgggcgcagtggctcatgcctgtaatcccagtactttgggaggctgagatgggaggctcacttgaggttaggagttcgagaccagcctggccaacatggtgaaaccctgtctctactaaaaatacaaaaattagctgtgcatggtggcatacgcctgtagtcccagctacctgggggttgaagcaggaaaactgcttgaacctgggaggcggaggttgcggtgagctgagatcatgccactgcactccagcctggatgacagagtgagactccgtctcaaataaacaaacaaacaaaaaccccaccaaaccaaaaaacccaattattttaattataaatctgaactgcattaaaagatagtaaatttagctagtcaacttgaataacttttaacagagagttagttgtctcttctgtttccttagggaagaaagatgagttccttcagttcccaaatgagtcctcaattcaacatgagtgatttcaccagaataaaatcttcttacttctgcaaaaagcagctaatgctttcggaagctaaataatcccaatgtgtgactcctgccagtttcttttctttgaaacctcagcagcagcataactagtgattcacccttcttgaaatgaatgctgtgattcgcgttatgcacagatggctactgaatgcccaggtcacagcctttgcgtctggccttgactcgttaataagaacaggaactgggcatggtgtattgcacagtgattaagggcttaaagctaagagcagtgcctggccccaagtaagacatgagtagaactttgctgctgctatttttgctgttgtatattgggctctaccttgtgctgggcactacgttaagcacgctatgtgcattgcctaattgaattctcatcacattcccatgaagtagttgatggttttgtttttatcttcattttcaaatgtagaaactgaagcttaaggttatgacatttgcccaagaccatgcagctggtaagtggttagcgccatggtacgaaccaagttaaaaaacattttttttaattcataaattataatgtacagaatcttctagaagctttcttgtgcctcctcctgattgttatttttcaacaaagttgcctactattctatcaccacagaaaagctttgactgttcttgaacttcataaaaacagaatcatattcatacagtatgtactctttgtatttggctttttttacttagtattatgtttgtgaaattcatccattgatgtgaaatacatggatttgcatgtagcgataatttgtttttcctcattgctaaatatattgctacatttcttattgtatagtttaatgtacaaatatgcctcactgttgatctcttctactgttgatggactttggttgtttttagttcttggttgttatttattgtgctacttactttctttctttgtttttttttttttttttggaaacagtctcctctgttgcccaggctggagtacagtgatgtgatctcagctcactgcaacctccacctctgggttcaggtgattcttctgcctcagcctcccaagtagctggggctacaggtgcatgccaccatgcctggctaatttttaatttttaaaagagacagggtttcgccatgttggccaggctggtcttgagctcctaacctcaagtgatcttcctgccttggcctcccaaagtgctgggattataggtgtgagccaccatgcctggcctaattgtgttcattcttgtacatgatttgtatacgtatacggctctttgagtacatttctaggtcagcactgctgggtcttaataggtgtggagctgtattctatactgtgaaactgttttctacactcccacctagcagagggttcagtggttctgtcctaacactgtaatgactatcatcattctggtgggtgtgtagtagaatccatatcaaacttgatatggattttgactccatagcctatggacttacctggtaagaacaattttaacaattatagcgctcttgctatacggaaggtgttgtgctgatatgtaataatgaatataacttgatttctgccctctaggagtttatagtccagtggaagagaaagactcagaaatcacataatcatagtccaacacagaatccatgcatagggcactgttggagcactgggagagtctacttcaatctgtgggttcaggacggggtcgctaaagtcttgcagaaagaagtcagtcttctgggatatggcttcttcgggaaggtgacatttaacctgaggctgggggggatgaaaatagagtcatgtgaagaggaatggatcagaagcctgtgtagccacagggaggaagtgaacaggtgatggtaggctgaggtcaaagagccctggagtccatggcatttgtaaaccattgcgggccttgaagtagagagccaatgttgctatgaagcagtcaaaacggttctccttcatcagcctgtgacccacaggggacccgcaggcctttgtggaggctgcctccatttggcggagtggtggtgttggagaaaatggccttactgactcctgaactaggaagctcctgatcctaactctcttagtatctcatcttgcgaattactaagacagggtctttaagatgtcttatttattttttgatgtacattttgtaaattaatttttataatgcttcaaaagctaatttttaaattataaaagtaatagaatcacattacagaagccagaaaatggagaaaaaacccccactatcattttattatatagtttttcccatcgttttaattgtagggtatagattattttatgttatccccgtgtcctttgacatgtgacgagccttttttcttgattatgtagtcttcattactattttattattgtagaatatgaagtggaacaccttgtaccacttaaatttcctctttttttttttttggagatggagtctctctctgtcgcccatgctggagtgcagtggtgtgatctcagctcactgcaatctccacctcctgggttcaagccattctcctgtctcagcctcccgagtagctgggattataggtgcgtgccaccacaccatgctaatttttgtattttcagtagagatggggtttcttcatgttggtcaggctggtcttgaactcctgacctcgagatgcgcctgcctcagcttcccaaagtgctgggattacaggcgtgagccaccatacccagcaccatttaaatttcaatctttctttcacttttaattgtaatgagaaaaaaccaatagatgcttattgtaaagcatttggaaaatacagaaaagtataagatgaaaattaaaaacttttcagttctaccatgaagataaacacatgttaatatttgggtatatttcttttttcccctctgcttttatttacatatatgtatgcttttctttccttttttgtttttttgaatacaaattggggttttttttcctgcaagcaagatactgttaatggggattttggatggccatataatgaaataggaaaacgattaatggaagcccaggaggaaagacttggtgttattataggtttgtatcatatcaccattttcctgttctatttggaggaagagggaaaggggaaaggaagccagcccttattgtgtgcctgccacgcacctggtcctgcagtgctgggaagcactgtgagctctgactcccagaaaagtagacgctggcactgtgggaaagtgggaccctcatggcagcgtgttgtttgaaaaaccagtctttcaaacataataactgagcatgttggaaaaccaggctggcgtcatggtgtaaattgagtttactcaaaccggcaggttgttgggaaggtacacatacctctattgttttaacccacttgaagattaaaatgtgggaagagcattttgaatagagaacaccgtactttatcatttggtgcagaggccttgtatttttaacaaaaattgccccaaagtttcctccaaatgcattaaatccatgtttttgttgtttaaccatgaatattttgaaaaaatttattattttgaaaatccaggccctttaaattttatttttgctctcacaaatccttctttccttttgagttggcacataattgtacatacttatgagaaaacaaagtgatattttgatacatgtatacaatgtgtgatgaacattaatagaggattggctaaattatgatatatataaagtgctcagagaggtggaggaggtaataagatagaaggtggactttttagggaagtcctttagagtaattagtatattcatcacctcaaacatttgtcagtcctttgcattgtgaacatttgaaatcctatcttctagctatctgaaaatgtacaataaattaacttatttctcctatctagctgtaactttgacctgttcaccaacttctttctatcctaccctcttctctacctttcctagcctctaataaccatgattccactctctacttcttcaatatttaatttaatccccaaattctaattgtagtccatatttgaatacttcatattattggtcacaattttgggctttgtattattggtcacaattttggttgattattttttgaaaagtagaatcttgttttttgaagccaggcttaatcacctgaagacccaggacatctatagttgttttttttttttttcctaacaaaattctgtatgcggaaaataggaaaaataatacaagaaagacacaagaaatggacagtgctacatttctgattttacatcttcatgacaatgagtaaagatctctgagttttgtcttcggatcggagtatggaatctgtccattgaggattgcaggtcgagtgcaggggctcatgcctgtaatcctagcactctgggcggggagcctccagcactgaggctggaggattgcttcagcccaggagtttgagaccagcctgggcaacatggtgagaccccatctccatgaaaacttagacactaaataaaactcactattttcattcttattaatcttatttattacttggagatatccttagaggctctaggtgtgtaagtctccttgttcctaccctaaatagctatagaaattgctgtatttctaatacctttttttttttttttaatggggtctcactgtgtcaccaaagtggtggtgcagtggcataatcaaagctcactgcagcttcaaactcctgggctcaagtgatcttcctacctaagcctctcgagtagttgggagtagagatgtgcaccatcatgcctagccaagttttaaatttttttgtttgtagagatgggggtcttgctatgttggccaggctggtcttgaactcctgacctcaggcccgcctcggcctcccaaagtgctgggattataggcgtgagccattgcacccagcctcttctcattcttaggtctgccttttgtggttcttctgtcactttctgtaactgatactgttagcagcttatgcttttgttgcttctacttggctttgggctaaggattgtaacttccatctgtgtcaagttgtgtgtgaaggaggctgagtttgaattgtgttttatgctgggtgctgtgcttgaggcagcttgttgcctaaaaagaaaatggtgggcttcacagcacacacagctttggatgctcaaagcccatttgagcttccattcacttattttctttcttattgtaaaaacaatacatgtttgtgcgggcatggtggctcatgcctgtaatctcagcattttgggaggccaaggcgggcggatcatctgaggtcgggagttggagaccagcctggctaacctggtgaaaccctgtctctactaaaaatacaaaatttagctaggcttggtggcgcctgcctgtaatcccagttacttgggaggctgaggcaggagaatcgcctgaacctaggaggtagagtttgcagtgagccaggattgcaccgttgcactccagcctaggcgacagaatgagaccctgtctcaaattaaaaaaaaaaaaaaaaaaaaaaaaggcatgtttgcaatgaaaattgaagcattacaaaaatgtgttatttaaatgaaaggtaccctgttttatcatctctagtcataactacgctttaaggatttgataatttttttttagatttttctgtaactttatattttttacagagatggggttactctatgttattttggtactgatttttgtatttttaaaaatatatttgtatactttctatggctgtgtatataaatttttgttggttgtttttaatagcttcctggtgttccttggtatagatatatcgtaatttagccaatcttctattaatggatatttggactattataaatacctcatatataagtatttgtactctctgaagtgtttgtataattcttctgttcagagttaattactggaaatagggttggacggtgtatacattgagccagtgcgcccagctgcttttttcttttttaaatgcagaattttaagcctcaactccaaaccgtccgtcagaatttccaagaatgggtctcagggatttgaatttttaaaaagttcccaagtgattctgctggtgcccgagttctagcatgcctaagacatttccttaccagctcgagtgtttcataaaatatgttcaattcaaaggtggatggttgtggaaaattattcaaaacagcttcaacctgatgaagtgtttagttgtccttgaagaatcatttcatttgagccttcatgctttaatacctatccttttttctactaccaattcttctgaacttagtagcactccaaattggctcattctcaaatttccttatgacgcattctgtggtaaagactgctaattttatatccagcagtctttatattctcctcttcttcagtaaccaaaaacttgatttttttggagggtgtacagtgtgccatgccaaaagacagtatttcccagcctccccttctcctgttgatgggctagtgagttaagctctagtaagtgaaatgtgaaggcttgtggaaaggttctagggactgacttctatggacaatgtaccctttttctttttctctgtccttctacatactgcttggaacatggacacaatggctgaagtccagcagccatcttggattgtgaggtaacgatgaagatggaagccatgtgatatggcttggatgttttgtcccctgtaaatctcatgttgaattgtaatcccccatgttagaggtggggcctggtgggaggtgtttgggtcatgggagtagatccctcatgaatggcttggtgctctccccatagtgagtgagtgagttcttgttctatttcatgtgagagctggttgcttaaaagggtctggcacctctgttgctcctgctcttgccatgtggcatgcctactccatctttaccttctgccatgagtaaaagcttcctgaggcctcactagaagctgagcagatgctggtgccatgcttgcacagcctgcagaaccgtgagccaagtaaacctcttttctttataaattacacagcctcaggtattcctttacaccaatgccaaatggactagcacaccatgctctaagtagggcataaagaaaggagcctggatccctaatgactgcagagccatgatcccagccctggactgcttgcctccacacttctgtcttattggttaagccaaaattattttgggttttccgttacatgctgcagaacctaacctaatgaatacccctgctctctgttggtttcacagtgtgtctccaacaccatcttgaaggtgcagtgacttgcatatagtaggtgcttggtaagtgtttgacaagttaagtacccaatggcattgaggtaaagagttcaaaggcttcagctgctctgacctgtccccttttctgctttagattaagttattcatggggaccttttgttttttgccatctcaccccccaggaaggtatttcccagccctcagtgcagggctttagggctacaggcttgaatcattttgacaagacagcaggcagaagacattggagattctaactgcacatatgcgtaattccaaatgaaaatataaggggtgggcacttttctgaatctcctagagaaactggaggtggtggttcaaatgatgtcagaaaaggccaccattgaatcctttgctatcatttggaggctgtactttccacaatgcttgccaggacttgatgtcagggaagactttcaaggagccttgattgccagctattgacgaaggggtctgtctgctcagtggcaacctccatggtggtcttggccagaccagcctgcccctgactcatgctgagctttgtcagccaggttgaaacgcccctctttggggcccaggacaacatgctggtttcccggaagcatctgggccaagactctgctgctaagaaaatgatattgtttttgcaagcatgggagtgtgtttaaaatgcttcccctttccccccaacaacattaaacctccatgcaaagaaacacgaggttaaaaaccatctcccaaacccagaaaacagaatgcaaaacctgggaggtgaattaactctttactgatgccaaggagtttatttcaaaacaggattcatcgactacagggatttgcagtctgccctcctgtgtgcccactgagagcaatgggcagaggctgacccgcagccctttgtggggaaaagtaaattccatggcagacctcagtggctgaagattatttgcttctcctggaaataattagaaaaatacttactctttgaaaggcaacatctggctggctagaggcaggctggaaaatactcaatctaaatagatggaggtgacgttgtgcagaaggaaagaaacatcccgagggagtgtccagtgggttttaatggccgtgtctagagaggcactcctgctctgtacaagggctggcttcttccctggatctaggggttgcccctgccttttagaagacagatgcacagccccagagcctagttgcctcccctgaccccctccaagccttccatagaggaaaggggcctcccatagcactggctgatgctcagagccaagagtttgctgcccagggagtaccttgagctagtgctgggtgtcagacttgactttccaactacttccagtgcaattcaaggtgttgattttgactgctggaactgtctcttccttctcagccctttctcaaggctgcctgtgtgcttgttcttattaaccaagcccagaagccagggatctggaagcctggcagtatttccaggaaagtagcttatttctctcacttgcttctccctgctgagcttagaacggcccagctttggacctcttgaaacatcagggcaaatttttccccctctttcaatttgcatctacctgctggtgaaaaaagcagaacagcatcttcatggatttatgaacgctcagagtttttaaaatgttttatagcttgtaagatattttcaagtgaagaatgcagttctaataaatccaatgaacctgtcacagattttctgaaaccaagtgtctatgaaaaactatggtgatgacatgttgaaggtgcttattgaaaaatatggatccttgtagcgaacatttttgcaaagggtgcattttcacataaaaatgcttttagtagtggcttcgtttagttattctgcagctacttggctgtgggttcccagagagccctgaggcaacctttataaaaggcctaggtttgacttctctttggtcacttcagctttagagcaccctaagaaggctcagagaaccccaaatttcttcccagtaaagaggtcatggaataaatctggaggaactcaagaggggcgcctgcttttgaacagtcattagccaaacatgggtagattcctattaatcatgtcaagagggtacttgggaatcaagttcatgtggaattgggagattaaaagggttaggagtccttggagccgtaagacccctgaagttccaactatgctacttgctttctgtgtaatcttggataagaaatcacttgacctttctgagccttgatttccttacctgtaaaatgggaatgctaatcattgtactgcccaccatactgtctttttatgtgaatcaacaaagccacatttgtattggtgctttctttcctttcttttttttgaaatatgagatgcttcatgaatttgcatatcatctttgtgcaagggacatgctaatctctattgttttaattttagtatatgtgctgctgaagtgagcccatattggcactttctaaagtgtaaggtgctgcgtccacattaggcattaagatgatggctgcctttttcacttcacccaccccattgcctccattgtcaatgatgacgttaacatatcattgtttccctactcttgagcggggctgctttctatctcacactctgactcgggtgtctgatttctcccatcactctggcattgactctgggctacccttaggtgctgctcccgatttgggagctgtgtgtgacctttgcttttcctgccttcaggtaagattttctctttccaaacctttgtgctgtgatactgtctaggttcctgaatttctgtgacatcctttgatctgtcatttgcaatctccagctctttcctacctttcaagggtgtgtggtaagcttggtgagtggggagcagagtggagctggggatcctgagaaggcagttcattcatagggctctttctgtgccttcttatgtcctcctccctcagcccagactctgagcctttccccagggctctaagaagatagaaaaactcgcagaaggtgtggaccttttctttcttttcctttttctttttctttctttctttctctttctttctttctttctttctttctttctttctttccttctttctttctttctttttctttcttttctttttctttcttttctttttctttctgtctgtccgtctgtctgtctctctctgtttctttttttcctagtggggctacaacttatgcttaatacaaataaatgccttttattcatttaatacagatatttaccaagtaccccctgtgggtcaggccctactctcaccctaaggatacagcaggaagcaaagcagaggtggagaagatcccactaaacacacaggcaaggcacatcagtgggtgatgagcgctaagaggaagtatggccagatgaggtagagggtgaggatggggcggagagaatcctacctgttggcaaagccttttctaccagatggtccaggaagatttatctgataagcaacaggagggtgagacctgaaggagcctccagatcagggctgcctgggggaagggcactgtgaagaggggacagggacgctgaaggccctaaggcatgaagcataagagcaggaggctgctgggtgtgttctgggaacagcaaggaggccacagtagctagagggagggagtgagggtgggggttctaagagaaggagggcagagcattctgaactttacaggctggcataagggttttcatctgatgggagttagaagccagttaagggttctgagaagggtggaggcgagtggctcagctaggagcctagtgaagtagcctagaactttctgtggaatttgttctgcaatcatgcgaagtggcagtggcatggtaacatgggtaagtggtagtgactagatcctgagatgggaactgaaagcctggagtgaatgtctcaggaaacccgacacccgtctggcccagagggtccttatttcaaaactgtgtttaaaatggcaaacacatgagatcatggtaatcaaacttacataagtactgtgcaaatccagaaaatttgtagtgagtgtactgaattatttgccaatgatcaatagtgctgggctctgaatgcaatctgaaataaaaattgttttcctgaatgtatttatcaaaatactgagtgcttaccaaatactggtgcttactgtactagttgacccgtacaatcagtttaagtaagctaacttaaatttatgacttttgacttattcctgatctattcacaggccgcttggaatgttgggccatctgtccttttgacatgaattttccctgtaatgggggtagagctggtaactgttggatcatctgattattggagacagaagtcctgtcacttgcccctgctgttaggaggtgggcttcctgaatggctttctgtatacatgaagaatttcaagaccttccgttaaggtggtcagagctaagtttcagcgtttacaagaggtctcttggctgacttgctataacttacagcaacctgatgtttggacaccttttcctttttttgtttttagtaaatatgatgagaaaaaagactcctcatctgttttgttttattttgtgaattacttctattcttaccactcaaaaaaatgtttaaataagtaattgcgaaaaaatagggggttttgccaggcacagtggctcatgcctgtaattccagcactttggaaggattccctcaatttttagagggaaggactgcttgagaccaggagtttgagaccagcctgggcaacatagtgacaacctgtctcaacaaaaaaaatttaaaaataaccgggcgtggtgtgcatgcttgtggtcccagctacttgagaggctgaggcaggagggtcacttgaccttgggaaattgaggctaccgtgaactgtgattgtgccaccacactactttggcctgggcgacagagtgagaccctgtctcagaaaaaaggcagggtggtggggcttgacaatttgtttaatatctgaaagtattagaaaaaattattctcaattttttttttttttttttgaggcagagtttcactctttttgcctaggctggagtacagtggcatgatctcggctcactgcaacctccgtctcctgggttcaagtgattctcctgcccccgcctcctgagtagctgggattacagatgcccaccaccacgcctggctaatttttacatttttattagagatggggtttcaccatgttggacagggtggtcttgaactcctgacctaaggtgatccacctgtctcagcctcccaaagtgctggcattagaggtgtgagccaccgttaccagcagaaaaaaaattattctctttggtattttcaaaatatgtggcagtgagagggtgcagtaagttaggagttaagtgacctgactaaatatctgtgttctgctgaaatcttgcagaaagtgggatgctcaggaagaaaatagtctatcccacgaagccatttcccacaagcagctgaaggcagggcacaccgttatgtttattttggtaaagggaaaacagagttaagtttctcaggggccccaaacctcaaggatgatgaacacacacattcatacacagaagtgacttgcgttgatagacatccttatcttgaatgcctcactcagagacaaatctttccacaaatgtgcactgcccaggtgagccttttggaatcggagaatcaattattcaagaatgtgacttttaagccccaaagcaaagtttggacagttttcccagagccaaacctctggatattagtccacttttccgggataatataatttaattttagtttagttttttagagatgaggtctccctttgttgcccaggctggtcttaaactcctggcctcaagcagtccttccaccttggcctcctgagcagctgggactacaggcacacagaccgcacccagctcattagtgtccttttctgtcaatgagcataggggttcgtagacgccctttttataaagagatacgttcttgaaattgcctttaggccagacacagtggctcatgcctgtaatcccagcactttgggaggccgaggcagcgggatggatcacttgaggtcaggagtttgagaccagcctggccaacatggcgaaacctcatctctactaaaaatacaaaaaaattagccaggcatggtggtgtgcgcctgtaatccagctactcagaaggctgaggcaggagaatcgcttgaactcgggaggtggaggttgcagtgagccgaaatggcaccactgcactccagcctgggtgagacagtgagactctgtcacacacacacacacacacacacacacacacacacattgccttttgacttcctaccctcaggcatgtgtgcattaattgaggacattaggaactaaccacgtgcacacgcgtgtgtgctgagggaacaaaaggtctgaaatctggtccaggggagagttggcaaggtaaggcctggggaaagcaggctggcaagctcaggaagcagaggggcgccatgcatttggagacgtgtgagtaggtgcagagcctgcgcaggggaggcacatgggctggagatgtctggggcctggtcttgaattccatgctgaggagattgtgtttttatgctgaaagcaaaagaagaaacaaatcactgagtaatttttaggctgaagtacaaatttgaaaagatgacggtggccatggggagaacaggttggaggaaaacaagcctgaagactgaggatcaacttagaaggccacagctgtaatccaatagagatatgcatatagctctaattagggccatggtgtcgggatggagaagtatggctgagaggtttcaggaggcagggtcaacaggaagaaatcactaactgatgttgtgtgaaagggggagggagaaggtaggatgcttgcaggtcccgagagggcgtggagttgactgatgccatgttccatgtaagtcaggagctgttaggaagagtcaagtcgggctgggactgataggacttttagacatttagaagctgctaaaacaagaatagaagttctaagttgagtctaaccagggagttgttcttaccagaaaaaaatagagaaataagtccaataaaaccactgcttggtttgaaaaatcaagtgggaagggaatgaagaacaggaatttctctgcagagcatcttcatctgatgcctcgtgtgaggatctcgccctttctgagcctgagagatggcaacgatccttctgttctggaagattaaaggcacaagccgttagcccagaaggtacttcagctgagatggtttggggttctgaccagtgaggactcaccacttcaaggaagtggaatcctgtcttagttcaggggatcatttgcagtgtgagggtcaggcccgaggtagcctggcctaggaaaggaggcaagagaggactgtggagtgagacagactccgtcaggatcctaggtctgtcagttgtcagcttcacaatcaaattacttgaagtcattgtccttcagttttctcattttacatgtcgttaagtagattaaatgtgaacctaggcaaagtgcacaaaacagtacctgactcatgatagttcctcagtaaaccctagttccttagttgatatggaggatggtttataccaccattgggctgtatttcctacccttggccttttgacctaaatgaggcttgatccctggggctgactgccatcatctctcctctcttctattccatgtcgctggctatgtcagcagatgggagagtgttctggaagctttcccatcaccacctctctctttctaggcaggcattttggctgtgtctgtgtggtcccaacatgtgtacgtgtgtgtagcagggagggaggagtgagtatgaagaggtccaataacaacaattgagaaagataaaataaattctttccacaatatcggaggctatattatctgctaaactagtttttcaaaatgctaaacttttgcctcttaattttctcatgcttatgaggagtgcccttcaaatcttgtattagtcaggatgtaattgtatcgctttagcttcttttctctcttgctaaaaaaataaaatgcaatccttaataagagactgaagttcgtaacgtttgtgtcttgtcagattcagtggggaaaaatcagatttgcttgaaaacaagatgataaatatgtggtgttggtgttttcatacaagaatctaaagataagctgtaacagcttagagaacataattgttactgtaccacaaagaccaagttttttaaaaaataacttttgaaggtcttactaaaatttatcacatttataccatgttggatggtgatattggccatgttttcttaatatcaaaatatgactaaagagtgtcatatgttggactccatccacagacacagagacttttctgacatgagccggtctctgagtcttcctttttagaatacgagcttattttctccagaatcatcacagctgtctagagccttcctgttcctcctttcttggagtcactgctggcttcatatttgttcacttggacgttctcttgtataccaactgtgatctctctggggagtcaaaaccagatctggttttccttgtcctcagggaacttgcagtttagctgttctgatatttgtgccatgcactgtccagatgccactagttttctttttttctttttcttttttttttttttgagacagagccttgctctgtcacccaggctggagtgcaatggcgcaatctcagctcactgcaacctccacctaccaggttcaagcaattctcatgcttcaccctcccaagtatctgggattacaggtgtccgccaccatgccaggctaattttttgtatttttggtagagatgaggtttcaccattttggccaggctggtctccaactcttgacttcaggtgatccacccacctcagcctcccaaagtgctgggattacagcatgagccaccgcacctggcccagatctcactagttttttttttttcttccccaattctcttttgatgtggataattccactggcctttggctcagctgctgtatagagcttcttaatatcttaaaaaacctcactgagagccttggtgctgtcttccacccctttcctagtcctggaagtttacttattttaaacaagagcatcaaatgcttcttggaaaattccatcagcgctcatattttctgtgtttgctgtcgattatctagcattcaaagccccgctaacgttcagagcttcttgttgtgtgacattcgcaggtttccttttgggacaggtttggattgacttccttcctctgccaagagggcaaccagctgatgacagtttggagagtttgtgttggcatcagacgggtgctggtgatgtgcctgaaagtcactcctgagattctcgtttatttctgtcccaggctggagtttcacaggcagtggatgttagtgggtggcccgaaccaccctcatcctagctgtagacagaggcagcttcactcagcagggagccttttatcctcaagaccttttctgtacagataaaacgctcagataagatctggagaaaaccctttgttctttggtggctctgcatcctcttttctcttaaatgctgttccttactctgctctcctctggcctctttggtgtgattatcttgatgttctctgtatctgttaagggatgattgttgtctgagtaaatatgagatggcatctttgattatcacatttcccaggaacctggctgatgcgggactcctttctcaaacctgcttgtgaatggatagccaggccctgtttgccttcctccacctcatggggaactcattgtctcctgaaacagcctagtttatcttgacgcatctctgtgagaaagctcatttccccctttcgattgaagtggagtttgtgtccctggcacatctactctttattggttgttctaacctttggagccacacagaccaagtttaatcttcttttcacatgacaaccattctggtattcatatgtgatgagagttgatcatgcttccagctctactcccctccttctgtacccagtgccatctcttagtatctcagtttctttttttttctttttgagacggaatctcactgtcacccaggctggagtacagtggcgcgatctcggctcactgcaacttctgcctcctgggttcaagggatttctcctgcctcagcctcctgagtagctgggatgacaggtgcgtgccaccatgcccgactaatttttgtagttttagtagagatggggtttcaccatgttggccaggctggtcttgaactcctgaccccgtgatccactcaccttggcctcccaaagtgctgggattagggcgtgagccaccacacccggccttcttctccttctttctttctttctttctctctttctctttctctctttctctcttcctctcttcctccctccctccctccctcccttcttccctccctccattcctccttccctccttccttccttccttttgagacagggtcttgctctgtggcctatgctggagtgcagtggcatggtcaatcatggctcactgcagccacaacctcctgggctcaagccatcctccgagctcagcctcctgagtagctgagactacaaggtgcgcaccgccatgcctggcaaatttttgtgaagatgggggttttgcccaggggttgtccctaggggttgcccaggctagtctggaacttctgggctcaggccatccatccccctcagcctcccaaagtgttgggattataggcatgagccaccatgcccggccagcatctcagtagggaaaccactccttcctggccgctcttttttctcttttcttttaaaaaattaatcaacagacattttatttagaagataagcatagctaactagatttcttcccatacccacattcagtgataaaaagtagatcaaatgctttttggatcccttttgacctttttgacaacaatgttgctgggtagatttttgtgggagttctctaccatcgggcacgcttggctgccacagggcaactgcttggccttttcatcccccagtgtcggcatcagttttacagggaacattctgtggctctttcaaggagatgcctccagagccccatttgcagtcatataagttgtgttgtagtacccggggctatggatctcatgaagttatttgtaatattctaacagaaatgaaaagtcttaaagcctcaagtgacttgaaggcactatgtgaagagaaggtttactaaagtgatctggatgtaatataatctggctgctgttttttgtaaaccagactcttggtgatcagcctcaagcagagggggctgcctacatcagctgggcatggagctgatagcagcatcagcaggttccctttgctaagggggctgctgggctggtggccccttcatcctttgggctccctgcatgttcctcagaggctccgaagaaggcagacggggctggccgtccatcacaggcagatttgaacagggaatctaatgtcagccccacaataagagcaggtttcttccaaatctgagagtcgaggatcccatcttgtatttactcagtaacagtcatccctttatgtatacacagaaaatcaagataatcgcaccaaagataagcatagaggtgagtgcagtgaggaacagtacttgtgtgaagagacagacttttgagatagctgtgtggagttgttctgggttcaaggggagtctgcagtgtggttaactgccctgccctgttgaaactagatatatcatttccagaggtcaccgtggtgtttgccaattatctcacagtgaatttgtcacctgtgttcctcacacttttttaaaaccaaaacaacaacaacaacaacaaaccaacaaaaacaatccaccaaaaccaagatttgctttcacgtctcatccaccctacaatcaaatgattggtttcttaggccgaggttagggttaggggcttcaaattctccttattaaacctcatttttgttagacttgatccatgattccagcctgctgatctgtttggctcctgaactctcatatattgcattgtctatgtttccgaagttgtagtggttaaggacacaggctttgggggtgagagagaatgggcataaatcccattccaccacttagtgggttgtgtggttttgggtaaaggcacaatgaagaatcttctggggcatttcacggagcagatgaatggtgtcttatggaacccatggcaggaggcagcagccttgggaaggtagaactcggacaactgagatcaaatacatctccttatctcatctcagcttcggtctgaacatttaagtcctttttcttttcttcctggaggctgactcttccatctgcatgataggcataacagtgtctctccaaagatgcccaattcctaatcctggaatctgtgactatgccatcttgcacagcaaaaaggatatgcttaatttaaggaccttgagctggggagattatcctgcattatttaggataatcacaagagtccttatatgggagacagggaggcaggaaagttggaatccaagaaggagatgtgacaatggaagcaaagccagagaagatgctacgctgctggcgttgaagatggaggaagggaccaagagctgagaaatgcaggtggcctctagaagcaggaagaggcaaggagacagagtctccctaaaatgaggaatgcagccctgttgccccttgattatttgaatcattttaagccactaaattgccaaaagattccttcccttaaaagtcttccagattctacccaccctcttgcagtaatgagctccccacctatctctgagccccatttggaggcagggttgttcctgctttcacatgtcctccatcactcttgtctccctcagtgcctggcacgggcccaacgtagagcatgttcttggtaaatgtctgtggaaccaaagcccccaagggaaagctgatgatgcctttcagaaatccagctgcatgattacagttctttgggctccttctgtagtagctctgccagaaaagggaacaaggttagtttctcctgattttttcccagcgaacctccagtgggattagagatggcggctgcttccctgagtttccctttgccggccgtgggatccctgctctggggcctccgtgttgtgaatgcacctcctctctgagactgaaccgctgtctctgtagtcctcaaatatcagaggttgggttgaaaaaacccacagaaatacagttttgaggccttctagttcttgagtgtactacaattgaaaaggtacttccacattgctgatcccttttagtccctgtggtagccccttgaagcagccaccctcttttcgatttgctcagtgttttttttttttttttttaaattgtaaggatgagtgtaacaacttctagcctctttacatgtagggttggaaaccgaccattcctttattttttgttcagagttgcaggttggtaacttgcccaaagtctcactgcttgtttaggcagaagaggtttctgttcccagtgctgttggaacctcagctcaccacctcttcaaagtcgtcaggaacattctcattttcctctaagatccctggctagacctttgcatcctgctcttccttctacttaagccagcatcctctcctgacccctctatccctgctgttaagatagccttcttggtgtcagggcctacagctgcctgcagccatcttgcttctgttttgaatttgtgttgctccaggaaggcctccagattggcatgctgctctcagaaggcacttggtatcacagtgtcctaggaacttgtctctactgctggggtgcacacacagatgctttagtcagtgctggagtgttggttacctggaaactgcatcctcagccttctttctcttcataatcctctacaggtggtccccaacctacaaaccagatgagttctaacagcttattttgcagttagttgattgtttggagttaggctgcatcttcctgaggattcagtgtcatgaatggtggttaggttctaggcccccaaccaacatctattccagagttcagctacaatagtagctgttgtatagctgaactctggagtcatgaagagaatggtctttggactcagacaggccttgatgacttctgattctgctctatctgggtgaccctgggcaagtgatttaaccactgagcctcagttgcttcacctgcaaaatggtgttaattaatacttacctggcggggttgctgaacagtgaatataaggtgtttaacatagtacttagcacttggtaaatgctcagtattatttattactgcactattacgtatctagtttgtttaatagcactaaatacctaattgtttatactgccctttcttcctttcctttcctttcttttctttctttctttcttacagagtcttacccaggctggagtgcagtggtgggatcttagctcactgcagcctccatctcctgggttcaagcaattctcatgcctcagcctcccgagtagctgggattacaggcgtgtgccaccacacccagctaatttttgtatttttagtagagatggggttttgccatgttggccaggctggtcttgaactcctggcctcaggtgatccacctgccttggcctcctaaaatgctgggattttaggcatgagccactgcacccagcctattgtgccatttctgtgggtaaactgactccaaggtcaaatgctacattagtcactcagaattgaaatagtgcttttttttttttttccttctggggatttcagattgctggggaaaaggagtctctctcgttcatttattcattcaattcataagcaattgcattatgccagatatactggggggaaaaggtgagcaaaagccaatatagcccctgttctcatggatgttacagatggatgatggagacaaatattaattaaaacaaaaatcatctaaatgtgaaaatacagctgctgtgaaggagaggtgatgggaaagggtctagggaggtgtttcctgggtatttgatggatctctggattggttctttgtcattgggtggcagacactgtcttcagctaagtggctcagagctttgacagcattgactttgcatacgaacaggggtggaggtggcttgagcctttgggggttggtagtagaagcagcagtccaagttgtctgagatgttggggacaccatcagggacacctaagtggcgggttaagggggaagcatttacaagagaggagtagctgggaagaggcattgctggggaggagaggaggcttcttgtctgtggatcagggatgctgggttctcaggtggtgcttattaaggagtgttttaacttggctaccccttgttttcagccaaaataacaccccagtccatatttcctgccactgtggcttcctatggctaaacaagcgtaatgaatatcttgttccatataattgcctccatctcatgcctcattttttggtactcatttcttgctctcaattcctttctgtttctctttttttctctcctattcggtttctcccgttctgctctgtgattaatcagttcggtttttcatccaattatcatgtctgtcttggagaagcatgtttcctggggaaggttggtctaccatggttgcccagctctctgcctgctccttcttccttctgtaagatggcagtttgctgtatttttagccctctagttctactctttggcttgtgggaaactgtccacagctcataaattatcaccacattgctcataatcacaccctaccttgtctagtcccctgagcttggagacttactgggcttctctttatgtacctgtgatgtgatgctgtgtgttcacgggcccagggagatgtttgccctgttcttcctggcagaagaagagcagtgttctgagacctgaccagcatgtgtgcccggtgacctattgaatgatgtgagtttctctgcgctggccgtccgacatgccagagctggcgggtgagtcgggagttggacatgcagccctggagtgaccacactgactgcgtcagtgggtttcactgcctggtgccttttttttttttgagacagagtcttgctctgtcgctcaggctggtgtgcagtggcgcaatctcggctcactgcaacctccgcctcccggattcaagcaattctccttcctgcctcagcctcctgagtaactgggattacaggcatgcgccaccacgcccggctaatttttgtatttttagtagagacggggtttcaccatgttggtcaggctggtctcaaattcctgaccttgtgatccacctgcctcggcctcccaaagtgctgacagtaaggcgtgagccaccgcgcctggcctcccttttcttgacattgctttaaaaaaaaccctttaattttagaatagctttagactgataaggaaattgcaaagatcatacagaaactacacccaatttcccctattatcaatatcatgcaattggtttgccataattaatgaaacatttttgataaattattattagctagagtccacactttatcccgattttcttagttttatttaatgtcctttttctgttgcctgatcccatccaggatactacatttagttgtcatgtcttggctgtgatgctttgagatattccttgtttttgatgaccttgacagttttgaagggtattggttgggtatttgctaggattggaatttgtctgatatttttctcatgattagactgcgattaggaagtcccattatggggcttctatgtgggaggaagaccacagagataaagcacccttctcatcaaaggacatatcaacatgatttatcactactgatattgatcttgataaagcatgtgcttggctcaatcagtgtctgccaggtttctccactgtgaagttattcttttccccctctttctatactctagcttctgtgaggaagtcactatgtgcagcccacacataagaagtgaggagttatgttccctgtcctctggggcaggttatctaaataaattatttggaattctgcatgggtgagttgtctgctcttccccatttatgtatttatttagttataagtgtggattcatggatatttattttatactttgagttatccaacactattttttgggccattgggagatcttttagttggctcctgtgtccctttgatataccttaatcattgtgggtaattttggttccttttttaagtacttgtttaatttctggcactgtaggatactccaggctcatcttgtatatttcctgccctagtcttagaagaataagccatttattcaaagaaccctgcttccttttattggagaacttgttggtattagagaccaagatctgggtgctaggtactcattgatactggagtactgttgtttctaggtgctctcagccaaaagagcaagaaaacatagatgtgtacactagcctgtgtatatagacatgtttataaatattcctatatgtaaccatctacaaatcaggtgaaacatgagttcatactgatgtctccactttcatcaattaaccacatgggtcattctaacctcctccccttgcatgtctataacttctcactccagcagtaagcagactcccaccacctggcatctatttacttaattgttcaattccactatacacatatagtggtttcggaatcgttaatgcattcctctatgggaaacaactttatcaactatagtaaaatacttatgtacagtacctttgcctttggtcttacagattccactcatttctggagttatttagttcagcatgtttttctatcacctccttctgtgaagttgtttcatataatttttaatgcagttagattctttttagtctgatgactcttgaaaagagataaatgagcaggaagataaagactcagccattagggaactaagttagaaaaagcttgtgaacaattcgttttctatctgctgaatgtttggtggctccatgctgctggatgatgatattgtactattttcccatccccttgcttttattcccatccatttgctatgggctgaatgtgtcctcacaaaattcatattagaggttaaaatcctaactcccaaggttacggtatttgaagatgggatctttgggaggtaattagggttagattaggtcatgaggatggggcccttaaaatgagattattggctttataagaagaggaagagtgagagagattatctgtgtgctcttaccaaggaaaggccgtgtgagaacatagcaagaagacagctacctgcaagccaggaagagagccctcaccaggaactgaattgactggcaccttggtcttggacttcttacctcaagaactgtgagaaatatatttctgttgtttaagccactcagtctgtggtattttgtcatagcagcccaagctgactgatacaccattatatatagaaaaagtatagacatccctgtgctgtggagaggctcttaaaccaaatttcctaattcgttttctacccttaaacaccgaaaggaaccctctttcctcctggcttaggagatcctgggcttaggagatctgttcaggtaatgttcttggtggtgcatttagatgtaagagctccaggttaagggtctgacaagacacttttggctaaaacaagcgttaggattgggagaatgtttctcagtggaaacagtataatcacctaactgaaggaaaaaatggcccctttccccaaatattctgagcctgctttagagcaggagagcccacttttacagcaggaaacaccctgagaaggaagtagagaatggtgacgtcagtggccctggatctgggtcccgtccctgctcttcagtatgcagagctgtcaggcgtcgtgtgctcctgtgtagagtgtcaggggtcgtgtgctcctgtgtggacagggacagcagcagggtcctgcctgagatcatgaatatggatgtgagtgattgttcccaggcctaagtgaaaggctttcttgaggcagatttttctctgggatgctgattgtgagtttttaatgtctcccctttcgttattcagtgttcttggcttctttagattgatcatcatgtcttctgcctacaaatatctgctcatattttacaagcagagaagtgactggagctgtaaccagcctagctgaccaaatgaagtccatgtggggccctgtcatttatatgggtgattaaaacaaaaacaaaaaacccttaaaccctgccagagggtaatttttcatggtctgccttttatgtttcttccttttttctcttcagtttttttctcctttccttgcagttattttttttttttcttttattgcctgtttcatttcacaacctggcactattctggtagaaatgtctgcttcctgccaccctcaggaagtcagagaacagggtaaatttgtccagggcttcaccccatgatttctaatggtgtgactcaaggctcccatgggagagatctacccaggaaaataaattgtgtgttggtttttaatacaagaaccttcataaactgagctcctaggagaaaatgaagacatttaaatactcttctctttttgcagtttgctctgtggtcatcagttaaccacccaaatggaagtgcatgtgttaatgttcaacagtgggttaatgtctggaggatggttttggacagcatagttcggagcaggttaatgtttaatgtaaaagtacttagatgagtacttggtacatagtaagagtgtttaagagttaattacattattattattattgcaaactaaaaattgctcccaggttgcatgttgtgagatagtaaggcgaaggtgaggcacctagtgtcagtattggctttaggtggaagaaaataaactggaattgctattgttgcattactggtgtaagaaaagtggtgatggacatggaaatagatcccagagcagaggtttgggcctgaaaatttggaactaggaagtttgaaagtgactcatctaagggaaggcaggggtgtgttagatggtccccaaaagcctttttgccttgagaatgtgattttatgtaagttcccctccacctggagtagtttgggggtagaaggtaggcatgaatggctatgggggttctgtagaggagagggagaagaagtgactctttttgtctggtttggattctcttatcaatgtttttgccggcattcccaggataaggaggtatttccatatgcttctgcaactggtttttgttaaacacagaccatacctcttcagctgatcgtgtcacacccttaggggctcagctgaactcagacaacaggcaacagccagaggaaggaaaaaagtaatagtccataaaattaggtaatggtcctgctcagaaatatttgagcataaataccaggttatatctttttatttgtacccccaacccccatggctgtaaacacatccctggagagaggaaataaatgtagcagatttcatactgggctgaaggggaagagtgtgggatgggtatctgttttatgagacagccttttttttaacgttaatttctgcatgattaacatcccttgaaagagttatttttcctccattcttttgttagcccattctggtccagcttccatgccttccactctgacatcaaagttcttgctaaggtcatgttccatctgcatcccgtcttgtgcaatgatgctccagtctttgcctgcttaatggtagcctttggcttacctgacccctccttccttcttgcatccccagcttctctgggcttctgggatgccaggctctccagatttcctcgcatccccctggtcgctccttctcagttgtctgtgtctgcttctcctcttttccctgtcttcttagtgttggcctgctagagcatagatcctcattctgaatgtgggaaaagcagatgatgattcattggatctcgggtggaatccacgattctgcatctctcatgtgctgccaggcgatgctgttgctgcggggctgcagagccaccgcagctcggtgctggagctccatcctcgcttctccatctatgtgacttcctagctgagctcctccagtccccggctttaagtcacacctcgaatcttattggtgacttctcgccccacttgggtcaaaacccagagttatattcaggcccacgacaccctgtgggtttggctcctgcccactcctctgcccttagctgctctgccctccgcgtctcccactgggctctggccaagtctgccttcccactgattcttcgatttgtctagcacgtttctccttcctgagctctaaacttgttgttctctctacctggcactcacacggcttagatctcatcttctctttcaaagcaaatattcccttcccagcgagggcttccttaactgtctatctagaatggaccttcactaccaccaccatcacctcgctgtcacctaccccagttcattttcttaccatgctatgtgagtttcttattcatcctcactctccctaccagagtgtgggttctgtgggaaaaaggaccttgtctccccatctaactgctgtagaagagtgactagcatagtaataggatcttggtaagaacttgttagtaattacataaagcattagtatcagcatgtcccagatgagctgatgagcacagatactaccacgccattccagtgtctgtgtttttaatggtttgggtatcgggttatattattgtaagtatcatgaactagtggaaagaaccaagatggacagaacacataaacgatgcccttacaccccatgaagacccaacagttttatggcaaactagagaaatgaaggtttcatagttgtttgaataaaaaaaggtggtagaaaattgaggcatctcattgtacaaggtaggtaacatctgtgcaatgaaatcatgacttgcactattgaagtccctgttcacaccatataaggtgatacagtttcagcaaaatgatcatcctacatattaatgttgtgaattggaattatattggctttgtaattgcatttgtatttaatgtgcagatgttttggtattgatggtaatataagaactataatcgttttatatttgtacattttatgagaaacattaagtgaacactaagaatcgttgagatttttttttctttagaggcatctttacattatacaggcttgtgaaagactaaaataggaactaagcaagattgaaggtgtggctgaggacagggaaaggaaaaagttttaaattccaaaactgcttgtaggaagctatttttaacaaaataagaataataggctgggcgtggtggctcgtgcttatagtcccacctacttgggagcctgaggcaggaggatcccttgagcccaggagttggaggttgcagtgagctatgatctcaccagtgcattcccacctgggtgatggagcaataccctgtctcaaaaataaaaataagaaaaaaataaaaagacgctgagtgggctatcaaattttagcatgctttcaagagagtgaaattttaaaatatctacattcaggccaggtgcactggctcacgccttgtaatctcagcactttgggaggccaaggtgggcggatcacttgaggtcaggagtttgagatcagcctggccaacatggtgaaaccatctctactaaaaatacaaaaattagccaggcatggtggcatgtgcctgtagtcccagctacttgggaggctgaggtgggagaatcgcttgaacctgggagatagagattgcaatgagctgaggctgtgccactgcactctagcctgggtgacagagcaagagcctgtctcaaaaaaaaaaaaaaaaaaatccgcattcatatgaatacacaagttgtactgacaaaccctaaaaggttaaaatatattatcctttttttgtttatataattaaaacttcaattttggattaccagtctaatttctggttattgaaaaatgtaaattgtgaaacttttcttgctggagacatctatatattataaaatatttaaatataaaaataatggagtaatggagtagatggcctttactcaccaattctagggcctggcttaggaaggtatgtaggcagggacccccctcccccgccacaattctaacttgtgccccaggccctcctcctttcttctggctcctggagatcagagaggaagggattctgcacttaagaaatggcgctaagaagaagaagacacattctttttttttttgagacagggtcttgctctgtcacccagactggagtacaggggcatgatctcggctcactgcaacctctgcctcccaggttcaagggattctcctgcctcagcctcctgagtagctgggattacaggtgcacactgctatgcctggctaatttttgtatttttagtagagacagggtttcaccatgttgaacaggctggtcttgaactcctgacctcaagtgatccacctgcctaggcctcccaaagcgctgggattacaggcatgagccaccacaccaggccacattttttttttttttttaaagacaggttctctctctgttgcccaggctggattatagtagtgcaatcatggctcactgcagcctcaacctcccaggctcaggtgatcctcccacctcagcttcctgaatagctgagactacaggcatgtgtctccatgcttggctattttttttttttttttttgtattttttgtagagacaaggttttgccatgttgcccaggctggtcttgaactcctggggtaaagtgatccgcctgcctcagcctcccaaagtgttgggattacagggatgagatacagctactggccaggagacacattcatgctttgaaaggagacatgaatggtccttctccctcacacatttcctttgagtgtatgtgtttgtttctacccagttcatttccacatataatttgaggctaacagagccatctatatagatctgtgatgccagggagcctggggcagaagatgaaggctggaatggggtgagggtgctttaggaaggagagagggagctaagggccacagcactgcttgcagtgtctaaatgaatggccgttctgcaagtacctgaggggctggtgagagcaaggcacagcgtgtttggggtgactttaggatttgggtttgggtagtcccccttcccctgctgcccatctgagagaattctggggaggaaggtcttactggggcatgaggtccctggtgtcatcaactttgcaggtaacagctgtcttgaacaacaacagagaacctgaatttatacatgtagcaagctgctaggtttctaaaaatatttcagaaggtttattttgattttatttttaaacattttgggtgcctacacagtgttatcttccatgtttttaatagccacactatacaatacagagtaggtttctgtggacaaatacaggtgcctatcatttatagcacagtctctctgggacccgtgcaaacaactgactcatgcgtttatgagactgggttggtttgtgaatcgatgacgcccagggagctgggaaggctgcatggcatggacgcttccccagtggctctggattttgcaatcatttggctaaatttgctcatgatgcacattccctcacccctttccctgatgaggacaaagatggctaattttccctgattggatctgttgttttgagtgaccgagaagaaagagatactttgctgaaagcacaacatattccgagggagaatactgagctttggaattcactttgcagacatctgcgaggatgttccgggagccaggcttgttatagctggcattgctggaattccacacccccccatgcctcccttaagagatacttgataaccccagggcctaatttctacttttggaacatacataccttgtgaagtggaggctggaggtgggaaggaaagcccccttgaggctgtggatctggttctcatgttttaaacagttttaaatattggggctggagatgcctgaaggatgggtatttgttatggaaaaccttgacttttttttttttcttttacattgttcacattttaaaacaaagttcagagagctgtgtacattgagcatgctttattagttcattcatttatgtgtgaaacactgttctggatgccagaaatgtggcaaggaggaaggcctggccgaggagtgacacttccactgagctctgacagatgagagcttgtcttggtggcacaccagtgccgcgggacatggtgacatgctgtggtccacagccctccagtgaccatgtgagcataattaaatacaaactgtgggaggcagaaaagtgaaaatgtggtctctgctcaagaaagagtgcaggtcttagagacaaagtctgggtctaaatcttggtgctgcccctggcccaggtgtaaggcctcagaggaaattacctgccagagtttacacatctctaaagtggagagaagaggtgctgtgaggatctcatcagacaagatggtacaaagaaatcaccggggctggcctcgtggagggatgatgtgtgtgtctgactcagaatcagtagaaaaagcttaaaatgtggttgctgggacaaaactaatctaccagagaagccgtggctggagagcctgtgttgagctgtgtggtgctggtctgtgctggaatgccaaggaagaggcaggagctgcctccagtaggtgagcctcgaagaaagaacaggattttcataggtgaagggagacagatttttactggaggaaaaaaaaatgtctaaagtaaaggtcataaaaacagactgtgggccgggcgtagtggctcatgcctgtattcccagcacttttggaggccgaggtgggtggatcatgaggtcaggagatcgagaccatcctggccaacatggtgaaaccctgtctgtactaaaaatacaaaaattagctgggtgtggcgacatgtgcctgtaatcccagctactccggaggctgaggcaggagaattgcttgaacccaggaggcagaggttgcagtgagccgagattgcgccactgcactccagcctggcgacagaactaggctccatctcaaaacaacaacagcaataaaaaaaaaaaaagtgcagctgcacagtttaagaacagaagcttcttttgttgggtacttgcaaaaatattcccttcctcttggtagcgtggtctaatggtattaatgccaacagtgtgaacctgagcataaggtatgccctgagtttgagtagcttttcagtgctgagttgactacacaattaccagtgacaacactgagaaatctaagaagactccacttgacttggggggtgggtaatttatttcttggacattttggcttcagtgtaggtttaggtaagtatcatatgtcagggatggcaagtgcattttattttgtgtctgcactaaccaaccaattggtagtgactgcaggggtgcagtgatgaggaggattctgaagccagatttgcgcttagagagaaaacgataataaccctttattgatataatttggacttaggcttcgtagaggaaactgtagcacaaacggtgtggatctgttatctctggttgggaggttttctatgtacatgacagtatgaagatgttcatttattcacccaacaaatatttattaaatctccgctatggacatagcattgtactttagattcttagccctctggcttcttcattagttaataaattatttcaggatattggtggttaatgctgcttggttaattagtgggggtttttagtctttttctcataagtgtttcaaaacattttatgaacaaagccagctttcttgtgcccataaatgctacattgaaatctttctcagatccctcttattttttgagacagggtctctcagtctatcacccaggctggcatggggtggcatgatcatagctccctgcagccttgacctctctgggctcagctgatcctcctatctcagccgcctgagtagctgggactacaggtgcgcaccaccacactcagctaatttttgtatttttcatagagatggggtctccctgtgttgcccaggctggtctgagactcttgggctcaagtgacccacctgcctcagcctcccaaagtgctggggtgactggcgtgagccactgcccggctgatcttcgtcatttcatttagcatacaatatgtgattttcctaattactttatgaagtcatcactgacagtctgactttagagacaggaaaacagagaaattaaagaacttctccagagccaatattggacttgagccgcatgtcagaaatatttcctgcttctgcatctcggagtcaggtgccattacttgtcttcagaaccttaaactttcgtagcttagctctgccctggtaggagaaactttcagaaatcattttaagcctcaagaggtgaaaaggatgaatgacttatctaacactttttttgggacatgaattctgtatttttttcagtaaccatgaagaatataaaatacgaaccactgaatttattaaagtaatacaaattaaaaagtaaaagttaaattgataacatatggacaccgtaaattaagtggtgatatatgtgctaatcagttaagagaagtgggcaagggaagtgggacccatccacagggaaacgaggcgggtagacttccagggggaagtgggggcttcttgggggagagccacttggtgcccatgctctcagggccaggccatgtggatcagatgagttgagtcccagtgactccacattttcttttttgagatggagtctcactctgttgcccaggctggagtgcagtggtgcaatcttggctcactgcaacctccacccccagggttcaagtgattctccctgcctcagcctcccaagtagctgggattataggtgaccgccaccatggccggctcatgttttatatttttagtaaagatgggattttgctatgttggccaggctggtatcgaattcctggccgcaggtgatcaacctgcctcagcctcccaaagtgctgggattacaggcgtgagccagtgcgcctggccaactccagattttcagactcctggttgattctcctaggtctccaaccctagtaaaaggagcctttttacaggcttttcttttttgccatcttcctttttgtacaaggtgggtttagggggaagctgtagcactcaatgttataagtttattttttccccccaaatagaaaagttttagttgtcaggttcatttgaagacattcgaaccatcctgaactgtgtgaaacagagagcaactctgctttcatttccaaacctcaagtttatttttgaaattgttttcccagggagttctgaagggttgactgtatacaaagacacttcctttaaaatctgaagagtttggtcagtttcctacatttgcactacaaaacacgtagagagaaaacataaagctcagtttaggtaaggctgcctctttctgtcatgttagggaatacattgaaactaatatgtgttttgctaatcttggctttccacaccctgatctttcaatttcatctggttgaggttctagtgtgaatatccccatacaaaattctgtcttcccactagttccacagacacatcctttaggagtaaatgtgttaaccactgtttagcaagcttgtccaacctgcggcccgtgggctgcctgtggcccaggatggctttgaatgcgcccaaagcaaattcgtaaacattcttaaaacattttgagttttttttgtaattttttttttaaacctcatcagctatcattagtgttagtgcattttatgtgtggcccaagacaattggtcttcttccaatgtggcccagggaagccaaaagattggccaccccggatttagaggttttagctcatgtttatcatcagcctggtagtatcttctctttaaatgaggcagtcacaggatcccactcaggggaaattactttttggttggtgggtcaattcttatttcctagaattaagctcaagactgcactgagactcatcacctctctacccactgtattagatgctcttttaagtgatttgtatggtaaaatagaattacttgttcaaagcaaacatacctagagtctctgccccatgctaggtactatgccgattgcttgggccagcctggcttgactgatggggactcttgtccttggaggcaagggccagccacagcataaaggtgaaggtttcagattgcctggttgcatttcctccgtagccacagggcccctggaatggctggtgaatatgcatgcaggtcctggaggtgccactgagaattagagttgtggggcggggatgtgtggaccagcattacgtgactaatctccatgctcagctgataacatgtgatggcccagagagaggaaatgtttctatctggcatatgttcatagttcttccaagagctaagccctttgttcttacaaacacactcgctgatctcgctaactaaagcaattatcatcatttagcagtcttttcataaagtattatttccactccaaaacaccacttttatttgccaagtgccacaatgttgcatcctggcgattgatcagcgtttactgccaaattatgtaagcctttggttaggcttagtccccgacggcgcaagcgtgtctgtggtgtgcattaggattgtaaacgtggcccagtgcctggaagtggagaacagctgtccctaaattcattaattaattcagtgtttacactttgattgggaaggaaatccacatttgcttaagacaccagtgcccagctgagaaatgttgttccatgaaattattggattgaggtttgttgtcaaggaaatgtaaattgtggatgtttcatgaaatttaaatatgtggattaattgaccaacagggagctaagattgtaataagccaaggtggctttattcaaagattgaaatgtaattagtgttgactgtagtaggaatagctatttgaatggaccataaatcctgcacaagaattttactaataaaagaggaaatattttcattgaaaagtcagtgtcagcataagaactgatttttcttacaacacttattggtgagtagaataaccccatttagtaaataccacacacaaaaaatttcttctgtttaaaaagattattagaaactttaacaaatatgaagacttctagagatgcagaataaaatatgccaatgctgctcagaaaaaaggggttaagacacacctggttattttggtgtcagccctcacgcatcacttcattagtctaaggcaagctcgctgtacttgtccttagtattgagttgttttatgatattagtagccttgtcaaaccagataagtttagaagttcttctccttttcaaaattccactcaaatggtagtaaggggagaaaaaatgtttaaacctgcaagaggcaaaaaatggcagtggaggctttggtggcaactcctgcaatgatgcaggggtgatccccgggctggctgagggttagacccctccacccaaagtgcccacattgctgaaatgaggtgctttgcctgcagaaccacagagaggctcagaagtgggaaggcattgttaccatagtaggccagagagattggccaaatatagggagttattaaaaccagcataattagaccctacaccctgtccctgtctcccttccccaccccagcagcagcctggaggtctgttctctggagaaatggaactggaatggtgttggggtgttggtgggggtgactaaaaagagagactgatgacagctgggagcttggtcactcttctgctctgtccatgatggcagcagccaggcgtgtgcagccccagcaatgaagtggaagactttccttgagaaattgaacaactccagaaaaaaatgcccccagataactgaaatgtatgggttcttcagtggaatacttttttctttcacattaattgacactcaccaactaatagtcttctccacacttgcagagccaccaatctgctttggtccttcattcttaaataggatcaggcagtcagggttcatcaggtgtattaccaaagccttcaatatgaaaagtaggggccaaaacaggaaaagaacaaccttgcagaagatggtgttgttgcagaaagcagagaaaacgtgtttttagaagaaagttacagttttccttgcagagagaagttatttcatatccaaaataataataacatttatgaaagaggagcaattagagaacaagaaagagctattgagtattacaaattaaatactggaatttaaaaaatgttgaagttgtatctctgaaaagtagagtaaaaaagatggagttaaaaagcaggagagaaaagaaatatgaaaaattaaaatgtgatctaaaaaattcaacattgctattatagtagatgcagaaaccaagaacaaaataaaatagtaatctgaacattatcacagaaagaatgcaaaaatattttatagaactaaagacatgaatttccaaattgaaagaatatatatattatgtgctcatgttttataaaagagtccactttccccaattttataaaacccacccctgggtatgccattatgaaatttcagaataccagtgataaaaggtcctaaaagctttaaggggaacgtaaacaggtcacacacaaaggaaagggtacaatgagcttcagaattcttaaaaacatccttggaagctagaagataatgaagtttgcaaagctttaaaaaatacgatggaaattatttctaacctggcttctatgtccagctagaccaccaatcaaaagtaagcatagaataaagacatttttcaaaatacaaggagtcaaattttttttccataggactttttcttagaaaactactggaagtgtcttctatcagaccaattgggtaaactaacaaagaggaagacatgaaacccagaaaataatataacacaaaaggaagagagcaatgagaccctaatatagggtaggaggagggaagactgtaaaaaagaggtcaccaaattacctgatattttgatcatttggaaattaataccgataagcatctcacagatgtaatgtagttgagggaaagatttaaggataggtgtatagaaaagacaagtaaaacagtaatcgatcattaacgctagaaaagtaaaaattttataagaaaagttctgtaagaccatagtatataattttttagtgaatatttatattgtcataataatgtaaatagttgactcttgattttattattggtaggttagccaagtgagagacttgtatgtatggtgtggtatccaccctatgtagaaccaataagttaaggaatcacagtcaggaatattgtttagcaaaagggaggtaagtattagaagaaatagctgaaatttgcaggtttttttgtttttttttttttcctcctgggcagtgtgttcaggatcagggaagggaagctgaagaatgtaggttttcacttattttactttgattaaaaaataaattatttaaaaatactagtataactgaaaatgaaagttgacaatgaaatatttggaattggtgagataatgataaatattacagatgaatgtacctctctgagttgttcctatctttaaagtggtaaatgatagtagctaaaatgtttgagatttaaaagaattatcaccaagcaaaactgacaacactatgctactggtaggaaactgaatatattcagaaagccccaagacagaacagagagacaaaacaagtaaagatgtgctagagccaaacaacataattattaaggttgtacagatggatagattttgaatgttatcccttaaaatggagactacacctagtacctgtgaagcattgacaaacattatccgtatatttgctcacagagggaagctcaatatatttaaaaaggaagaaatggtagagacttcattttctgaccacaatacaggtagagattagcaacatttacaaataaagaccctccaaacaaaaacagcacagcaacaaaatactacatatgcaacaactttctcagaatcaaatcttgggtcaaagcagaaatcaaaaccccaaagagaaactatctagaaaatagtaatagaaacattactgtggtggaaactgtttactgcctttctaaagtccattctcctctctctttttactaacagaacattgattttgttgcatgttgatgaccagcttaagtaccctattttccagtctcccttgcggctgggggtggccatatgattaagttctcactaataagatataagggattattgttaggtggggattccaggaaagctatttaaaaagaaggttgagtcacttggcctaagcttttgggctatgtgatgctggatcagctatcttgtaatcataatcataagctatctttaatcacatgttaaagacagatgagtggaaagatagaaggggtgctccttatcccagggtctctttcagtcctagacttcctatctctggggaaaagttcctgtcttaagctgctatgtggggagtctattagtaggaactgacataatttttaagtgacatagttacaaaccacaatttatgtgattaaagaatgaaaataaacaagtaaagcgtccaagtcaaggagtcagaaatagaacaacaaaataaaacaaaggaaagtggaaggaaataataaaaatcaaactagaactcagtaaagttgaaaattaaagaaaaaaatgcttgataaatccaggagctagttctttagggaaacaatttaaaaaaatacatacacatatatattctaccagtgtaatcaagaaatagaagaaaacacaacattagataataaatgatttatcctacccaaattctgcaaataaatttgaaaattggatggaatagatgattttcttggaaaatgtgctagtagattgactctagaatagaaagaaaactcaaaaagtctctcaaaagtggaaaaaaaaaaagacaactgttatttgtgaccagttgctactgttcttcctggagtccctttgccattgctgttttgcaaagtgttagaagtgaatttctggtgaggaacctcggagtgtgaggcagggtgagcatcctgcttggtgagctctctgcagtcatctggcaaggttggccacacaccagaaaggcaacggcaactattcttggcatcaggacccatcacaaaacacagagccctgagtgttcttcattttttaaataatattttccagatcaatatgctattgaacttttttgctaagaagaaaagattgaaaatgatttataatcatttaatttcactgtcagtctcacaaacaactgattccttatggtaaaagtgttggaaacattatattcaaatagtagtgttaaagattttgcagcaagattgtgggtaaaaaaggctgaaagtgttttgagaggaaaatgaactgcagagtaacaaagaaaaatggtgagcgtcagaattccttagctcttaattattttcatggaaaagtacctagttctcaaatgctggtaactggaacatcctattggttaaaaataaacagcataaagtttcaggaaaccaactaaacagcaaaaaaaaaaaaaaaaaaaaaaaaaaaaaaggcaaccagaacagcccaaaacagaataacaaagtcagaataatgaagctacgccaaaagtgtcaggtcattacacgggttgtctgccctcaggccagggttcaaacccagtggtgacaaactcagtggccacgtgggctgaagggcatccagaaagtcctgctgggtcaccagagggctgcccttcagcacttggttctgaggtgtctttgctgtttaaaatgtcttgttttctttgaactttgaagtttccccttcctaattatttcagtcttcatttaaacagatgtaattctaacctaatgtcctctttttaccccatctctccctggtagctggaacagtgaaccatggagctgtatttcggtgaatatcaacatgtgcagcaggaatatggggtccatctgagactcgcaagtgatgatacccaaaaatcaaggagttcccagaactccaaggcaggctcctacggtgtcagtattcgggtccagggaattgatggtcacccctatattgtcctgaataacacagaacggtgcctagcaggcacatcgttttctgaaaatgggccaccctttccacctccagtgataaataacctgcctctacattccagcaatggttctgtgccaaaggagaacagtgaagaacttcagcttccagaaaacccatacgcccagcctagcccaataagaaacctgaaacagcccctgctccatgagggcaagaatggagttctagatcgcaaagacgggtctgtgaagccatctcacctgctgaactttcagaggcatccagagcttttgcaaccctatgaccctgaaaagaatgagttgaatttacaaaatcaccagccttctgagagtaattggctaaaaacgttgacagaagaaggcatcaacaataagaagccttggacttgctttcccaaacctagcaattcccagcctaccagtccctccttggaagacccggccaaatctggtgtgacagctattcgtttatgcagctccgtggtcatagaggaccccaaaaagcagacctcagtgtgtgtaaacgttcagagctgcaccaaggagagggtgggagaggaggcccttttcactagcgggaggcccctgactgcccacagcccacatgcccaccctgaaaccaagaaaaccaggccagatgttcttcccttccggcgacaggattcagcgggacccgtcctggatggagctcggtcccggaggtcctcctcgtcatccacaactcccacgtcagccaactctttgtacaggtttttactggatgatcaggaatgtgccatccatgccgacaacgtcaatcgtcatgaaaacagaaggtatattcccttcctgccaggaactggacgggatattgatacaggatcaattcctggtgtggatcagttaattgaaaaatttgatcaaaaacctgggcttcagagaagaggaaggtctgggaagcgaaacagaattaatacagatgacaggaaaagatccagaagcgtggatagcgcctttccttttggcctccaagggaactcggagtacctgattgaattcagtaggaacttgggcaagtcaagcgaacacctcctccggccttcccaggtgtgcccgcagcggccactgtctcaggagcgccgtgggaaacagagcgtgggccgcacctttgcaaagctgcagggagcagcgcacggggcttcatgtgcccactccaggcctccccagccgaacatagatgggaaagttctggaaaccgaaggtagtcaggaaagtacagtgatccgtgcgccctcccttggtgcacagagtaaaaaggaggaggaggtgaaaacagccaccgctacgctgatgttacagaaccgggcaacagcaacttcgcctgattctggtgccaagaaaatttccgtgaagacatttccttcggcctcaaatactcaggtaacactagtgcgattcctgtttggttttttttctcttccttctaaataatgtaatgatgtacttatgctgcaggaggccataggaattacacatcctcaatcttgtatcaggaatcacacagctgatctgtttcaggatccagttgtgtcctactgacgatgtcctactgccaattgtatagttttctgggttctttgaagttcagctggattcccattgtgatctctctgtaaagtaacttggcagacgctacagagaggctcaattgttctgtttgtgtatgcatgaaatctgaaagtatgcagaatttgtttctacacagaggctgaatagttaggtttgtgtaggtatattaattttcctcataaaattgagtgactgggttaatttctagcctgaaaaattaggttaattttcatttaggttaattgtcaagtgagaatctaagtggcacatttagtgttttgatagtaacaataaaaaataatgatattgataaaatggtaaaaaaaaaaaaaaagtagctaagtgctaggcactgtttgttatatattacaggattgcaccaaccctgtgcaggtagtacctattaacctcaatttacaggtgagaaaattgaggcgaggagaagttaagtaacttccccaagattatgaagctggtaaatgttgtaactggctctaagaaggatgctcactggaggaattgtttggtgtttggaagcctctgggaacttcatcctcatggtctaacaacaggccttatgttccaggccacaccggatctcttaaagggccagcaagagctcactcagcaaaccaatgaggagacagctaagcagattctctacaattacctcaaagaagggttagtgattttccctctgaaagagcaaagtattgttgtttctggtgggactcttaatttccttttccgaggctttaatggttaccttcctttcttgccctgtgccagccgttggagggttaaaactcaatggctggggttttcgtgacggcatttgtcttgtgtggtatggggtgggggctttgggaggggtgtgtaggaaaggacaccatactttaaaaattaaaatgaatacatttttaaagtgaccctttactatttcaaaagcaaattcaaagataggaggagtttctactcttcaggtttgaatggagtccgccatcaccttgagttcttccgtgcaatgtggtagtcctttagaagttacaaataaaaacacctcccctccccagagttaacattggccaagagcccctgcttccattatttttaaagcatgtgtgagtcatttaaaagcagtgctttccatgcttatcttggtggttgaggtggaataatcagggtttcagcccttacttagatactaactgtgctggaacttgagcaaggaatttgaggtttctgtttcagttctctcaacagatgtgattaagaggaaggacaaaaaaaaaaaaaaaagctttacagcctacatgactgaaaaccagccacttggcaaatcctcattggtatcaaaatactgtatatttttgtattgtgccttacaattatttgtcagttttagagctaacaacatagtaaggctcaaaatataaaacaggggatcttttgaaagggggaaaaaaaaagtaacctgaaagattaatctagctaagaactggttattagtatctccctgtggaagactttaccatgttaagattaaggtagaagaaatcttgacttttaaaattcattattttttttttattttttgggacagagtctcactctgtcatccaggctggaatgcggtggcatgatcttggctcactgcaacccccacctcccaggttcaagagattctcctgcctcagccacctgagtagctgggattataggtgtgcgccaccatgtctggctaatttttgtatttttagtagagacacagtttcatcatattggcaaggataatctcaaactcctgacctcaagtgatccaccagcatctgcctcccaaagtgctgagatgacagacgtgagccaccgcacctggccaaaattcattaaattcttttatgtatgtattttttggcacatgatttattgagacattggtaagacagactttagtgggaggtgcctgttgaaggaagtttattttaaatctttttcttctaattgctgacggtgtggtagaagttaataaaacttagtatctccgtgttacctgtgaaagcccagacaaagggctgccatgctgataatcttggcttaggggttttatttttttaaacataggttaaacaaattaagatcattgtagatcattcttagtgtaagattcagatgtacagcatgtttgtgtgtgtgagagagatatacacatacgcacttcaaagaaaaggagaattctttttggaatggacatgagcatttgaatcaaacaacaaattactaaatgttcactgggtgtcttctccaagcttactgaggatgtgtttatgtgcctctcacatatttgcaagtgggaaccctgtcccaaattgagtggtaacacatcatttatttgaaaaaaaaaaaaaaaaaaaaagacaccatccatcctactctcacactgattttgtctgaggctttaattaattcacagctcctgcaaattatctccttaaaggacctgttgggtgtgtgtcatgacatataaattgttctgagaccagtggttgtgtccctcattgttttctctgctgtccctttttcagaagcactgataatgacgatgctactaaaaggaaagtcaacttggtctttgagaaaatccagaccttaaagtctcgagcagctgggagcgcccaaggaaataaccaagtaaatggaagttttgtattttgtagagtgcatttagcatggaatgtggtaaacaacttgctgtttcttcagtctgtatgtttgtttatagcagtaagtgggaagttgcctgagtagtgaggagtactcttcatgttttacatgttgcagcaacattttattgagacagagtctctgtcaccctggctggagtgtagtggtatgatcttggctcactgcaacctctgcctcctgagctcaagccatcctcctacctcagcctcccaagcagctggaactacaggcatgtgccaccacacccggctaatttttgtgtttttagtagggtgagggtttcaccatgttgctcaggctggtctcgaacgtctgggctcaagcaatccactcacgttggcctcccaaagtgctaggattacaggcgtaagccaccatgcttggcctttcccagccttttttccagaaaagtttaaagatattttatttaaaaatacatagactataacaggatgatacaaacagatggcgagatttagaagaggaaaataagaataggaagactagcattgtcataggcaaacatggaaggtaagtgtgaacaggcttggacccaagctctggagcttcaggtgtgaaagagaatgggactagagactggtgacactgatcagctgtggtgcaggggacaggaaagagcccagtggtgccaagttagtttttaaataactgcctgtctgattgattgtgctgaatttgagtggggacatagagatttttttggttaaggaaggagccctctcacatttgataaacaactactctatgtcagacacacctggtgccctggaaggaagccactcgtaagagagtacggctaaacactcgttcctcaatcttccaccgccttgtgtggaactcatttcttgcttgtccatcttcctttcccctcccaggggagttctgcatgggaaggaaagaggaagacacctggaggcaggtaacaggaaacttgtctgtagcttctttctaacttgggaagcgtacatacaggggataattttaggcgtcaacctaccatctttactacttgttattcccccagcactcagctaacccatgactgctgctgtggcctcaaatagaacaatgccgtacacacacatacgcaattcccactggggaatctttacaccatagtccttgcgtattacaccatagtccttgcatatacatagccttgaggagctctacatagttcttaaagtcagtccagtatttgtttgctaaaactctgaagtccaaattatcaacacgattcttgtttttttgtatacctgcatacaggctatgcagggagtgcgggttggaatctcaccggctgttacagagcaatataaagggtcttgaacacaggggctttgggtataacttagctaacagatgagtcttcaacaaatatcctttttatattgttttattggggtataacttatataaagtaaattacacaaattgtatctgtacagttcattgaatttttaacatagttttgcatccatgcaaatctcaaccagatcaagatgcagaacactcccatcacccaggtttcctgggtttcttcccccatcagttacaccccattcttctggaggtaatcatatcctgacttctatcacctagagtcgttttgcctttcttgacttttatataaattttcacaatatgtattcttgtgtgtgtagctgcatttcctcaacattatatcatcaagattcattagtgttgcatgtactcgtagttttttttggtatcgaaatgtaattttccattgtatctgtataacatagtgtgtattcttggtgtacatttctggtttggggctattaggaataaagctactgtgaacattattgtacttgtttggggaggggagtaaacacattcactcatttctcttgagaatatacctagaagtaaaattgctgagttgtgagttaggcatgtgtttaactcgtaaattatacctgtttgttcttagagtgagcgcagtctttggccttgatgttgagattgtccttgtgggtcacagactaggggtgaacagcctgaactgggtaagtcagggtagcccttctagggacagtgacactaatggtgccccaagagatcatagaattatttgtgagaagaagggaagctggggtgttctaagttaagtgactagcacagacaaatataaagaggcatgggttgccatgttagagggaatttagtgtagtgggaacacagagccaggatgggctgaggaagagcctggtagcaaggacattggaagttggaagttatgtaagaagtttccatttcgggctgggaaggggatgggttaccattgttggattttaaacagatgtgaataccattgtgtttgtgaaagtttattccttttgtggcttttggaaagaggtaagattagaggaagagagaccaatgaaaagctaatgcctgtctaggtgtggtccctcacacctgtaaccccggcactttgggaggctgtggagggagggtttcttgaggccaagagtttgagaccagcctgggcaatgtagtgagaccctgtctctagaaaaattaaaaaattagccaggcgaggtggcacatgcctgtagccccagctactcaggaagctgaggcagaagtcacttgagaccaggaggtggaggctgcagtgagctatgattgtgccactgtactccagcctgggtgacagaatgagtcattgtctcttaaaaacaacaacaaaagaagctgccaaatcaagagatgatgagaaaatgaaccaagacttttagacttcaggttcctattacagctccatgactgtttaattgccacgttttcctactcctcttccctccctcttaggtttggaatctgattacttgctggcaaaggttttagagttttatctttgcggtgtcacttaagtgattaggagagaatgtaagaaccctctcccttagggacggagaccatactggaaaacagcaaagcaggtagagattttgtatgggaaagaacaatgtataatttccctcactgggttggatttctgtttctaaaatggattgttattttgcctaagaaaattggaagttgtgtgtttgtgtttctaatcatcttcacaggagtaggtagggaagtacctcattccaagtttatcacacacaacttgcacctggattcagggatgtgtgagccaagatgccgccgtttctagctttgattcctacttttatttcttcccctcagctatttgtagttttctaaccactttactgtaggattttagccaaatccttttgagagaatcatcatgttattttcatggaagaagaagaagaaaaaaagatccattaatattcatactcagatcagagagataatattttgtaatagactctcttcaatcagatccctcttcattatggaaatgtaacatctaaaaggagaaagccaatttagctaacatacacttatttactacttgcatacaggctatgcagagagggatggaatctcactggcggtgactcagcaataatctctagtgtaatgtagattacactgtaacaaatatatgtataaagggtcttgggaacacagaggcaggggctttgggtataacttagcaaacagataagtcttcaacaaatatctgtttttatattgttttattggggtataacttatataaagtaaattacacaaattccatctatacagttcattgaatttttaacataggtttgcttccatgcaaataccatctagatcaagatatagaacactcccatcacccaggtttcctgggtttcctgtgttccttccccataaattgtcccccttccttctgggggtgatcatatcgtgacttctatcacctagagtagttttgcctttcttgaattttacatacataaaattttacaatatgtattataataagtattctcgtgtgtccggcttcatttcctcaacattatatcagcaggattcattaatgttgcatatactggtagctattttgtattgaaatgtagttttctgttgtaatcagtcaacatagtgtatactcttagtggtcatttctggtatttagctgctaggtgtaatgccaaactgaacattactttttttttttttttttttgtaaacacactcactcatttctcttgagaatatatctgagagtataatttgtgggttgtaaattaggtgtacttttaactgttaaatgttcccaaatgattttacacagtgattgaaacaatttacactcctggtagtgcagcatgccagttccagtggctatatatcctctgtaatacttagactcttttccattactttggtctacttgtctctccttacactactatcgtacggtttaaatactgccactttagtaagccttcagatctggtagctttattcttctccgagattatcttagctattctaggtcttttgcctttccatataaacttttatcagcttgtcagcttccaccaagaaaagcctctaggaattttgattgggattataccaaatgcatagataaatttggtggaactgacgtcttaatattattggtgttcttatttgtgaacatgaactttgtccccacttatttatgtcttagcatctctcagcagcgttccgtcatttttgttagagaggtctcgcacatctttcatttagatgtagtccctttccagtgctgttcattcctttctgtacttctgtgtttccatctcggactggtttccttcagcctggagaactattttttgaatatcctctagtacttttcgtgggcattgtttgagaatagctgtcattcactctcagttttcaggaactctagtgtggcaagtattgttttgcttcatgaatttaaagacgttattcgtcttttgacctcagttggctccattggaaagccagccatcattcttagtgttattctcttgaaagtgatgtgtcttttccctctgggtgcttttaataatttatctttattgtcaattgttagattttgactatgacgtgcctaagagtggtttttcttttatttatttttcttggggttcaatgagctctcgacttgataggttcatcagatttgaaaaattcttggctattatttatttgaatattgcttctttcacattcggtctctcccagctcttctcagactccaattacatgtatcttagaaattttgatggtgttcctcatatctcttgtgctctattctctctcttttcgtgtgtgtgtgtgtgtgtgtgtgtgtgtgtgtgtgtgtgtatgttgtatgtttggggcatcagatattctggatattttctattgacctttcaaattcattagtcttgttttctggctacgtcaatcttactttaagactttctcttttaagatgtctttaaaagaatgtttttcttcatccttcatttaaaggatggttcttttaagaacttttctttggccaggtgcagtggttcatgcctgtaatcctgggagtttgggaggccgaggtgggaggattgtttgaggccaggagtttgagaccagcctgagcaacatagtgagatcccatctctacaaaaaccatatttaaaaattgccaggcatggtggctcatgcttgtagtcataactgctcaggaggctgaggtaggaggatcacttgagcttagaagtttgagattacagtgagctgtgatccagtgagttcttaactttcagatattgtgtactgctgttttagagtgtctacttggttatatttttatagaatctatctctggaacttgattaaaaaaaaagggccaggcatggtggttcatgcctgtaatcccagaactttgggaggccaaggtgggtggatcacctgagatcgggagttccagatcatcctggtcaacatggtgaaaccctgtctctactaaaaatacaaaattaaccaggtgtgatggtgcgcacctgtaaccccagctatttgggaggctgaggcaggagaattgtttgaacccagaagatagaggttgcagtgagccaagatctggccaatgcactccagcctggatgacagagcaagactctgtctcaaaagaaaaaaaaaacaaaaaccctttgtccataattgtttctattttaaaaatattagttatagttaatttgtagtccttatctgttaactttaacatctgggtcatctctatgtctgttgtttattttatttagttactggttagttcttcctacttctttgcatgtctaaggatttttttttttaattgtatgctagaccgagtgggtgatgagttatagatgttctggaatgtgttatctccccctgaagaatgttaagttttgttttgacagacagttaaattacttacagattaccttgattctatatggttggttgttctaggcattattagggagtgtctatttaagtttttgcccttactcttaagacatgacccatgttcctttcttggatttcaaatgaatgccagaatgtccaccaaggtttctctattttggttgagttggaaccctagtgtctccctagcattgggcaacctgtgaagtttctgttgggttctttgcctcctaataggtcttctctgcagtcctcttgaactcttgctctgctcatatacagcttaggatatcatccaagaatccagggagtatttattgtaggttcttggaacttcttctgtggacctctctcctctctcataccctgaccttgaaatccctgttgcttactatctctaaactctaatctctatttctttcatcagtgagttgccactctggacacttttctcacttaaattaacaaaccttatttttcagaatagttttaggttctcagtgaaattgagtggaaagtgcagacagttcccgtttactgtcctgtccccacatacgccctccaccactgttagcatcctatagcatggagcgcacctctcacaatcaggggacctacactggcacatcattatcactcaaagacgtccatagtttacgttagtgttcactcttggtgttgcacattctacaggcttctgacaaatgaacaatgacatgtatctatcatttagtatcataaagaatagtttcactgccctaaaaatcctgtgtgttctgcctgtttgttcctttctctcccctaacctctggcaacccgtaatctttttatggtttccaaggttttattttttctggagtgttctgtagttggaatcacacagtatatcaccttttcagtttggctcatttcccttagtagtgtgcattttttcccatgcgttttgatggattggtagttcatttcattttagtattgagtattaatattccattgtctgatataccacaatttatacattcaccttttaagggcatcttgattgcttccaagttttgttagttatgaataaggctgctttaaacgttcacgtacaggtttttgtgtggacatgagacttcaactaatttgggtaaacacccagagggcagcttctgggttgtatggtaagagcatgtttagttttgtaggaaacaaccataccattttctaaattatctgtatcatgttgcattcccacaagcaaagaatgagtttctgttactccacatccttgccaccatttggtgttgccagtgttttgaattttggccatcctaattcgtatatattggtatctcgttggtttgtctgtttgttttttgagatggagtcttgccctgtcacccagtctggagtgcagtagcatgatcttggctcactgcaacctccacttcgtgggttcaagcgattcttctgcctcagcctcctgagtagctgggactacagacgtgtgccactacgcccggctaatttttgtatttttagcagagatggggtttcaccacgttggccaggctggtctcagactcctgacctcaggtgatcgttctgcctcggcctcccaaagtactgggattactgcatgagccgccccacccagcctcattgttgttttaatttgcaatttcctaatgacattgtctgtgcttataaaattttattgtgctgtggtttggaaatggagtcatggagaacccagggtgaatgtggggctacctcctgtcttttcctttgtaaggatcataactctgtgttgcttgcttttcagtgcctgtcaacaattgttttatatatttttgtctagctttcatagtttttgctgggagggtaaatctgatatttgctactctatcatggcaaaaccagaattctaacaatcatttactgagatttgattaaatttatgagatacattgggttctgtagatacagaggtgcataaaacctggtccctgccccataaaagttcataatctcctgatgtagtaattctcaaaccactcttaagaaacactaaagctaaactgtattctgccattaaaatagaaaaaatgactgtctttacttacaaaaagattttgttgctgattttttgctaaccattgatttccatgctctggaatatagaatttattatggagaggctttttaagttttattatcctaaatttaatgcattgctattttataatattctacagaatacattacggacttctaacaaatatgccatgtatgcaagttttagtcatattggactagtgttgatatacctgatgaaacaatacctgtgattggtaaatgctgtagaataaagttcactggagtcccaaggcaggcagtaacattaactctgcccaccaagtcagggaaggttccctgaaggggttgatgtttgaattgggtcttaaaatgtttagtgttatgcctcatctgttactgcactgattatatttggagggggaagataattaaaataaagcaccctgaacatttaaattagtatatctttgcaattaattataggcttgtaattccacatctgaagtcaaagatctattggaacagaaaagcaagttgaccatagaagtggctgaacttcagagacagcttcaactggaagtcaaggtatctggtttttcctttatgttattttttccatttctgtcttggttgataaagaatattttacatgcattgggataaccagagtgaaagccaattttttttcccccaaaagaaacattcctctaatcactgaataaattcctgtgtatttggctgctgctgtccaaagaatttttttttttaatgtaaccaaagcctatagagactgtttgcttagacagagtaaaagaaaccctgttggatttaggcaggccaatgggaaactaaatgtatataaaacatctgaactaaatcatagaaatagcagaatgaggtttggctgtgtttgtgttttcttttacaagtattacagttcattaaatataaatgtttgatgttctttctagttaagaactcctgtgccttaattatatagtttgattaagttgtttaataatgtaagtgcaaagatatggagtctgcttgttgagaagtaggcttctgtggggttacgttaatgtacagtggaggctctttaaaatcacactgattcctgttagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagtaagttctgggctgagagcctgttgcccttcccaggttctctatgacatgtagctagaaactttctgtccatttaatactacccagccttccaaatatttataaaggcagctggcttttccttttcttcctcttatctttgtaaaattatgaagctggcgacacatgtagactgataaacaaaaaggttagtaattcttaacattctttgtgcaccttgaagtatacgttacaaagtttcagtccttaaagtggacctcctagcaggtaagtgggaagcagggagcactgagcgctgatactgaaagacagagttcaaggagcctgggcccagcttctaaaaagcatgtgttacgtggcccccgtgagctctcagcctgtgcattttatcctcgatggtgctggtgtttgtgatgggtgcttatacctcctctgagtctacagagaaggaaagttaggtccaagatgcccctgccattgtgttgtattaaaagctgtggcaaaggaatcgaaaaccaaggtctaagaataaacagtgctatgacgttctgtggacacgacagaagccttaagtggaaagtcaagtgggaatgaaatctagggggaagttcaagaaaaagaggacattatataataaaagcatttgattgtccttgcagttttgatggtggtgttttgcgtttaaaacaatcatagatgctaattgcagaaaagagtttagtaagaaaaaaatcagaaaatatagggtatagtaaaagttttacaaaataaaaaggtatagtagttgtgagtttggttcaggacagagttttgtaaacttttttttcatcaggtggtgattattttagggtttgtgggtcatatagtctgttgcacatactcagctctgccattgtgtcgtgaaatgaaatggctgctcataaatgaatgagcatgaccatgttccagtaaaactttacactaacaggcagtgggctgaactggcccacagaccataatttgccaactctcctggtctagaacactgggatagtagacagtggaaggatggggtggctttagtgggaaatttttctgtttcatttctttatcttctgcatccaaattctagtaccctaccatctccttttggggagaaaatgtctccgtataaccatacccactttgttggtttgagttctcatttatcctcttgtaagcaattagaccatagcctaagttcttctcagccaccttttcaggttggtgatcccttgctcagtgcagaacagagaatggggaggctccttggggctttagagacttgtgtaaccctctgaagatcagaaatcagactggatggaaataagcagagcccagaagagcctgtctaatgggcttccttccctgccaggctattccaggtgaagatggaacgggagcagcatcagactgagatcagggatctccaggaccagctctcagaaatgcacgatgaactggacagtgcaaagcgatcggaggacagggagaagggagctctgattgaggtaagcagggctgtggggtcaggtgataagacaggccccacctgcctggaaagatggagtggctagggtttgtggactgcaagccactttctgatgtgcacacctgctccacctgtgctcttatgatctgtgagtcagtggatgcgcttgattctctcctctcagcttggcatttgctaattattatgggtttttattatgtattctctcttctctagattattatcttgttgaggtattagattcacatgtatgaaattattagcaagaatgttggttttcaatatgtacatttttgggagagggaataagtataattgagggtcagaaaaagacaggacttttatctctgcacccatttaggtgtttgatgtttgctgtaacattatcatcacctgtattctagcatagttttggaacctacttctttataagtgtggtttgtaggaatagcccaacaaagagatgataaacaatttagaacaaagccaaaaaaattaaaagtcaaaacataaaggtactgtgttaatatttaattttctacttcctccctctttgggcttaggtgttttctctctcccttacttggggctagaagcttctggctctgaagtccctggaacactctttaagtctcagttgtctactgttctgtcactcctttcctcctccagttttgaaataattcctcaggagagattttaggtcctactttttagaacttagcctttcttcacccgatgacctggcaggagctcagagatgagtgactctggtcacccagcccaggagttctcatgaatccatttttcacattggcagaggagggtgattgcctcttctccatatatgaccatctctctttccctattcagaccttttctcctgagaagccctcagcattgttccttaccaactgggattcctctttttatcaaatgattccttaaaaaccaccacattcttggtataatactgcttctcatggtgctgttttctctcagggctcagagttacaaagacaagaagatatatgtatttatcactgaaataatattaaaacaacataaaacgaaaattgaaaaaagggggagggggggacgtacacatactttcctaatacctgagcagccatttttatttctataatctctgtttgcctccctatctattgatagctttcatctacccatgtatatataatataaggacaatcataatgtccctacagttttgatacctgcttttaaaagttaagatatcaaaaatgttctttcttattatactttatgctctttgtatttaatttttaagaagataaaccacaatatatttaaccattctcctacattttttttcccttttttgtaattttgaaacaaagattgtggggaacattttttacatttatacttttactactttaaaaattgtttctaagaataagtttccagaaatgatgtcaatgaacaatttatggctttcaataaaagtgtagcttcatgaacaaatttaaatagaagataaaacattgtcatattcttgattccttgtgtgaacattttattggttctaaaagggaaagatgttatcttagctcttgggaagtctctgaagttgctgattttccgcagtaactgacagctgtcactgtgagttgccccctgatatcccctgtccttttagtttctctattttaactcacttgacgttgcacatattttgtatctttcttctgctagccagctaattcaagagcaatcacttttgcttctttccgcatttcacatctagcacagtgccaagcaacagagcaaatgaataaataatttttcgtatttaaattacttttaaaatgtcaccattttttaaaaaagggaataattctgaaatgaactgcatacttcttttcctctttaaacatgccatactgcatatctattaactgaacatcattagtttattgatttatttatactgatgatgggataacgatatgagactgttttggtgatgtgttcaggcagaggctgataatgcgagatacaggagtgggcaatagcacatattttcttaaacctgttcgtgatgttgctggcttacaggtagtttgtctctttcccacaacaggaactgtatcatttactgctgcctttctgcaagatgagttagagtgtaattagtctccctaggccaaagtgggtttctcttgctccagaaaatcaccctctgtttttatcagtttcctttgacttgtcagcaacacttaaactatgatctacggtttctacgtcactagtaaaatagaccctgtctccttgtcactttcaatttattcttcatatcttaataaaaagtggcctgggggaatttgataacagagtatagttgtggccaagtttcccatggcagttagcttggaacaaactcttaacacaatgagcattaaacacttatgcttttgaatgtttgaaaaaggttgaaggcccaagttttgcaagtcctgcataatggaccagattttgcatgaaatatcttttaatatgtcactttttgttaaataacatcagacccctgtatgcagtcagtaaagtaacattaagaaggaataggctgctctgtctatggagcagccattcttttgtttcttctctaataaactggctttcacttaaaaaaaaaaataaataaaacagtttaaaaaaaaaaagaagggagaaatagtagaaaacactttcttagagtaaaccataaaattgaccaacaaagggttgactttgttattcttagttaaatagatgattctgaaattttttttttttcagctcaagttacaaaaatgattatagaacaggtttccaccacttctctgtcaggaatgcattaccttccattccaagggtgacaggtcaacgtgagacagctcgctaagtgccacgatggtggggttttctaattatcaaatgtctgctttgatgggagcctgcggtgctgagagatgggcctcactccagcagagtcttgtggtgttttatccctggcatttgccaagatacaggtacttcagtctcattaaaatagtctggttataaaattgtagtggtttgaggagagattgtgttcagaaattatgtctctaaaacttcttttgtaatgatattattgaacattctacaaatttttataaaaaaggcagccaaaaataccatgattctcaccagccgtgtgatgcttccttggccatcctggaacaaaaaaatgacagaattctttgtcagctaccgttgctataaaaccttttatttatgctttcagtgagcatgggccagagatagggaccctgtggaacttctgggaagcacttatgcaaaagagggtctagactggtgtcttcctcattttgatgtggcacgctcatgcacaggtggtgtgtgaagtagagctttttgtgagcaaatacattgccgttctcgacatcctggtgcctgtttctcagtgcgcatggtcgtggggtggccacttgctgctgctgcagaacagctggtctcatagtgtgttcctttttctctcagatctccttctacctgtctcttcaggctctggttgcttttctttgctttagtttaagaaggtggacctccttaaagggccttccagccaaacacagtgctctgttttgttggcatctgtactaggctgttttcatgctgctgataaagacatacctgagactgggcaacttacacaagaaagggatttaatgtactcacagttccatgtggccagggaggcctcataatcgtggcagagggtgaaaggcacctctcacatggtggcaaacaagaggcgtgagagccaagtgacaggggtttccgcttataaaatcatcagatctcctgagacttactcactaccacaagaacagtatgggggaagccacccccatggttccattatctcccactgggctcctccctcaacatgagggaattatgggagctacatacaattcaagatgagatttgggtggggacgcagccaaaccataatagcatctagtggatgaactccagtgtgactgcttgcttctcagccttcttgagtatgtggttttgtggtcaggtctgtactgaccatagtgaagggaaagggcattaggacccatctgggtcccattcttgactctactgcttataaggctgtgtggtcttaggcatgttagaatctcagagcttcgttcgtttatgaagaatagtaatcttcatctccttgagtatccatctctctggattgttagaaatgctcagcacagttcttatgatgtataaggaccagacacagtcaacttttctagctctcgccactcccagacagccagttttctcttgttttctttaactggattccatagagaggcaagttgacctctaatggatgtatacttacattttgaagtttatgtatttttctctcccttctttgattgaaataattaagccccgaggtgatggagtgaagtttatgaaacatcgtgtaccttttagtctctactctggaaaacttcaagtgctactaagtgatatggcgaggtgtaatctgattggatttgtgctgcacagtccacttaagcaacagataacagcatgtcgttgcagaatggaccataaaaacctcagtcttgacatgcattggcggcagcacacaaaaggcaacacaaaacatagagatatgctggaaaacataagtgtggggagaggaactgtcttatcatccaaacaattgagaaacgtgtgagagtaaaagcaggaaacaggggtcagaatcacagggcctgcactaaagatgctggcaggaggttccaggaagccctggggggtagccggaagcaacagtaattcaggagagactctgatcttccttaagaaggggctgggcagcggcagcagggcgtcctctttgataaatacgaggacagggtataatttcataagatctctgtgtttggtgctttgaaagagccagagccggcctcgttacctgcatgggtctcttgacatttcttctgagcttgtcaatgcctgctagttagattcttgatgggcaaaatcttagtctgtgcaatgcagccccaccctgggattgtagcggttcccctggttcaatggaggtgcatgtcctagagaaaatgaaagagatctcgttgtcggttatacttaaatcaataaaatgtttcttccctcatcagagacacaattctggaatggaaagtagcttatcatctctgaagccttgggtcccccggtggcaaccatgcctctgattacccaggggttccaagaaaacaggtcgtgttcttatgcagaagccacaagtgaaataactgatgagttcagaattctgacatctccagacacctgctgtactgcacttgtttatttatatctgaacagataagtgctcccaatattaatctatgcatcaaaaatataataaatcagatctgtatccttctttcaacaaggataagtaggcgagtcaaatgcagatgagaaaaatgattaaaatatatagaatgtaaaataaaaagtgttaagtactgtgagaagaacagctagagtgagatgggtattcaagagggatattcaaggaagacctcttggaggaggtcttaccgtatctgggtcttcaaagattttctgaaaggcagggagagatgggcctgagaagggagaagggcactccggactgaagatgctgcgtggattgccatagaggctgtaggtgagagcctggatgcggggagcagctgagtggttatcgtaaaccacctgcacaggaggtgaggagggctttacccagggaggtgacagaaaggattgaagatgttgcagaactaactttttggttatgagagactaggacgagagaaagtcaaagtcctgccaagtttctgagcttgagtgctgagggggcaggtggtgcttttcacaagagcaaagaacaaaggaagaaggaaggaaggagcatgatgaattctcttgaaattgtaatcttactgaatctgaggtgccacaggacatccagatgggttcatctagcaggtctttgaatgtgttagtgcaggtttgaactcagagaagggtaagaggtaaaggtttaggagtcatttacatagaattaatagttggaaaaacaaaaatgagcttgctaaaagagaataaagaatgcaaagttgcaatcttggagatcatcatagattttgggaagagggagtgaaaagccagaaaagattatcaaagaagaaacagcctgagggaagaaaacaggagtctgtgttatcttggcactacaagaaagaagggcatcttagagagacaggaagggaggatgaaagaggggtaaagaaaattgacaactgggaaaaggccatcggatatgagtaaaggtcacaatgaccttgcaggggactgtcttggtagagcagggacaaaaatcatatagcaagagattaaggagtgaatgggcagttgtgaagtagaggcagtgaacagaaattatgctttcagacattttggtggtgaagtttggcaggtagccaagattcaagagtatgggtaggaacaaaatggcagaaagaaaagacaactgtattagtccattctcacactgatgtaaagatactacctgagactgggtaatttataaacaaaggaggtttaattgactcacagttccgcatggctggggaggcctcaggaaacttcatggcagaaggggaagcaggcaccttcttcacaaggcaacaggagagagagtgagcaaagtggggaaagccccttataaaaccatcatatctcatgagaactcactatcacaagagcaacatggggaaaactatccacgtgatccaatcatctcccacagtgtcccccccttgacaagtgggaattatgggaattataactcaagatgagatttgggtgaggacatagagccaaaccatgtcaataactgatggagtgaagactgggagcaggctggcaggggacagtgcgttctctgtggagggactctgggtggaagaaggcctggagtgcagagaggggttgaggtggagagggagccaagatgcccacatctctctggctgagggaagagcaaaggtgtctgtgagggcgagtcctgagctggaaaactgagaaggtctgggacaaaaatgctggagggaaaggaatgccgagcctttggcaggacacactgggctcaggtaatgtgatttatagtggagcctgttgccccagctttgtgaccttcctcattaatacctggcagttaagaaggggaaaatatgaatattgtgctctgctcagatgggcaaatgagatagaagaaaaacaggcaaagttgtcctgagtacgaggaatgtggatgaagggtttgaccacactcagggtcccaggggatatgaagcaaggtaggcaagctggcgtgcccccgtgaagcaacagcacacacagggcaagagcaagggcaacagatcactgcacagaagtgaaatgagatggaagatacagacgtgttccccaaagcagtgaaatttacattagtttcccctttctccctcaaattcaatcaaatctccaagaagcagaggcagaggaatccaagggaatgatggcctctgagaaatgcagggggagaggaagaaatggtctaaacaggtgtgcgggatgtggaaggagagagtggcaaggccaggtgagatggctgtgcacatggggactgaactggaggggagatacagggcctctcaacaagatgtttcattgtcaccttctcccttcgtgtttcctctctctaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaaggtgagggatggggcaggagaatctggcttgtgaacagatgaaagggtaagaccctctctcccacaccactgcaaatccccttcattccttttaattagagagtgaatctcaattcatcagatcatggacacagagcttattaacaaagaataagctcaatggtcctgctattgaccttttaaagtctataaactgaaacgttggtagggacattggttaaatcctgttgcagagggggagatgaagaagctgcatatgaacacttgaggttctgcagccccttgcagagtggagggatgtactctcccaggcgttcctaacggtcagaggccgagggcattgtgtgaccaagttaatgggcagaagtgcagacgggacccagattcctggaatccttcatcccccaccctagtctgttccttttgattttgtgtagccttttgttggacaattcaggttcttttctcagcacagttacaagagggttaattggctgaattgccgaaacccttccaagataatttttctcttaattgaattcttggctcctacaaatagattcaaaattatgctgaagtcttttggggcagacgtcatactggctgttgaagaagagaaaaacagtattttgaaggggaaaatggtttgaaatgtcatgccatctttagggaaagaggggaattacagattataaaattttcagagactctgcaatatataggttaaaaatgatgaagaaagaattcttgatattgtttattctgtgatgattacagtgacagctcagagttagtaggccctctctcccctaagccctatggtgattcactgattttcaattatggcacagtaattgcaaatgacaagaaatgaaagatgggtttgtttgttataacaataaaaagtctgggaaatagactgtttggggttattacaacttggagaccgtttttaaaagcctcttgttgatttccctgtcttatttttttttagatttgactgaatttgagggagaaaagcgaaaccgatttaatttttattgctttgaggggacatgcctgttatttgcatctcatttcatttctgtgcaccagcctggtatccttgtgatctatctttatgtgctattgcttcatcaggtacatgccaataggctactgagttaaaatttttctcctttggacccatatctttatcacccttaaatcttgcctcaaaacttgacttaatgtggtgtattctgggtggctcctttaagggcagttgagaatagtgttgggggatatgtttgtagtgatttaagtataaggaaaatcaaacttgtgcctcacatggggtgggggctatttattggaagcttccaggttctctactgtcagagatatgtaagtgaggaaaggatacatggtaggtgaaaggatatctttgttgtatggaattgagatcatcagtagagacttatgttactgcattttgtcctgttcaaatgtctgcattatatattaactcatagtattttcattatgccatttcaagagcgacaactacattgacccatatcagtctgtaaaaacgaaacaggcgaagtagtcaagacgtgtatcactggcagagaatggacagtttccaggcaccgggaagctaacacaaaggggttcgccttagtacccactggggtgtgggccagcaagggctgtttgttccaggttgttttctatactgctgccagcaactttccttacaaaaccaaatctgatcgtgtcagcctttgcttaagtaacttgcttgactccccattgccccagatttaagctgaaaattgttagcatggtagggaagaagtcccttctctgcctaacccatctccagaaaactctgtgtctttcagacctctcacctcttcatacgtgtagagtgacttgctcctgctttgccatctgaacaggctgttgtcctcctgcaagaattcccccaaatgtcctctcttttatgaacatgccctagatacctatactccctttggtggagttagttgcaccttccttcaccttccttagggtttctgcggaaccctggccattcttctactgtagtttgtatcataccctattataatttctcatcttgtctgcttcctccattagactctgcacttcttaggcatagggggcacttttgtcctttttttttttcctgagagggagtgacaaactctagtacctctggggccagacagggagcataaatgagtaaagcactgagtctgttattgggatgataggagggtatggtggggactgtgacaagctggctggagggcatgtcctttgctggagcggtcagtggcttctctgctccagcttagagttgccagtgagagaatgctgggcccatgttgctagatctttcatttttttcaagaagccagatatctggatgtttctgtgagatctcccaacttttaagcatatcttcaaattacaaaataaataaagaaataaataaaataacatagaccaatacaccccatatgcaagtcaagagcctgtgctcttagcctcttgagctcagcatggtgcctgggacatagtcacatccgtgcggtgtctggcaagtgaaagttagtttaggacaaatttcctttctgactgggttttcagtccctgccatgtagttcctgttgaattttttcagtggtgatgtgggaggtctttttgggaactctagtattattctttgaatttctgtgccttgcttttgaatttctctgcggtttcttttcctttcctttcctttcctttcctttcctttcctttcctttcctttcctttcctttccttctttctttctttctctttccttcttttttttttttgagatggagtcttgctctgtcaccctggttggagtacaatggcacagtcttggctcactgcagcctacacctcccaggttcaagcagttctcctgcctcagcctcccaagtagctgggattacaggcatgtgccaccacgcctggctagtttttttgtatttttagtagagatgggctttcgtcgtgttgaccaggctggtctcgaacacctggcctcaagtgatctgcccacctcggcctcccaaagtgctgggattacagatgtgagccactgtgcgcggcttccttgcagtttcttaaagaggatcctgattgtgttttttcaccatattagcttttgcttctgaaggtggctgcttaacaaatgtgatagagtcatattttatgggggacaaatgtgtcaatttagtagatggatgctgtttttggttatattatttatgtcttggtattatagaatagaacattaagattattaaatatttggaggagagtgaattaaatataatttttaaatctggtaaataatgtttcttaaatatgtgctcttacacttagatttttcctgccccagggggagaacccacccaccaaccactatggctaaaaactgactttttttttttttttttttttttttaagatggagtctcactctgttgcccaggctggagtgaagtaaaatgatctcgtctcattgcaacctccacctcctgggttcaagtgattctcctgccccagcttcctgagtagctgggattacaggcatgcgccaccacacctgactaatttttgtatttttagtagagaccgggtttcaccatgttggccaagctggtctcaaacccctgacctcaggggatccgtcagcttcaacctccccaaaaaaaaaggacatttctttaagaaattttattgcattaaaaagtttattacttcaataggtcttatgaagcagcccaaccttctgtcatcagtttttcttattcttaccactgccccagtgtcaaaaccccctaaagtgctattttatcgttgtaaaataaccagcactttatcctagcttgagcactaaaggttttacgttactagaacatttggtgaaaaatgtcaaattatatttcgaatgttgtacaggtattccaaacagataactctgtaatagtgtattttgtaaacccatcagccatatcttttaaagaacagtttgattgctcagtggatggaattcatgaatgcctatgttatgtggggtttcctcacccagcagaatgaattgcatctcactggcagagcggtggaggtttgggttataatgtgcactatttaagttctcttcttatagagaaatggatcttcgtagtctgttaggagagtatatctaccaaacattcttttaaaggactaagcccttaagcaacttatttcataacatgcttttttctctgtttctggtcattttacactttttttagttttaaaaaggaaatgtcttcttcttccttgggttcgtggccatggctggaaccctttagaggaaatgggcgctcaatagggatgtgaatgactgccatctgggagtaaaattaaccttgttcacagccgttggcttattttttccaaacctaacccttcctatctgcaactcttgtgcaaaatagaagtacagacagtatagtttcttgaagtttctcagaaagtaggttcagctcaaattccagctcttccaggaacttccctcgctgccttttggaccttacagtttctagagacctggtattgttggcaattttgctccgggttttatcttccctgccgtactaggtactgtcatcatcttctacttggtaacaccattgtgcttggtacttaatagatgtttagtaaatgtttgtgggttagatgaatgaatagacaaaaagggagatgtctttagagtcctcaacaatctgaagaccaaccattagactgttttggcttttaatttataaattcaaattacttctcatgaaaatgaacaaatcttgtttgttaggagcagtatcatgatgttaatgttaatcttcgaaggagtaattttgcatctaagagttgcaagtattttgatgctgataaaacagccacttttatttttgtgccagataatatgacttttgggccattaggcactttcagagtgtccaacatacagcagttatgcaacaaatatctcccaagggaatggatgagggagaagaggagggaggttgaagacatgtgagatactcttgccatccttcatttctccgtttgcattatttttaaatacagcaccttacaaactgatttactgagcaactgccaagtacagggcatcgtgctaagttcgtgaggactatacatataaatcaggtggaatttacccttccaggagattgaaggggagatatgtaactctcaagctgattatagacaagagtaaatgacccaggtgaagtggagataaaatcatataggaatccctataggagaccccatggctgtgcttaggaggaggactgctggcaatcacgaaagattttagggaggggacagtatttgagttggattttgagtgatgtttgggcatgcgggctgaggacattttgggtactgagtacagcatgagcaataccttgtaggtgggaaagtgagatgtctgggctgggctttgtggagaaaatgaagttaaggtggctacagattcagagacttaaggggcgggtgcagagatccaatgagtggaccgtgctcggatcccaactgaaacaaactgactgtaaaaaacaaaaatagctaaaatcattgggaacgttttaacactctatattaatgatattaagaaactaaacaatttttaaggggtgataatagtgctattgtttttaagagtctctgtcttttttttttttttttttttgagatggagtctgactcttgttgcccaggctggagtgcaatggtgtgatcttgactcactgcaacctctgcctcctgggttcaaatgattcttgtgcctcatcctcctgagtagctgggattacaggcgcctgccaccacaccccgctgatttttacgtttttagtagagatggggtttcaccatgttggccaggctagtctagaactcctgacctcagataattcacccgccttggcctggcgaagtactgggattacaggcatgagccaccatggccggctaagtctctgagttttaaagaaacatactgaggtttttataggctgtctgaaatttgcttcaaaataatccactttgttgggggaagtcagtggggtatggatgaaacaagatcagccatgcattggtgtgtgttaaagctgggtaatgggtaggtgagagttaattacctatcctctctacttgttgcaaatgtgtgaagttttttcttcctttttttctttctttttcttttcttttctttttcttttttttttttttttttttttttgagacagagtctggctctgtcacctaggctggagtgcagtggcacgatctcagctcacttcaacctccgcctcctgggttcaagccatcctcccacctcagcctcccaaggaactaggactacagctgcacgccaccacacctggctagtttttgtaaagacagggttttaccacgttgctcaggctggtcttgaactcctgagctcaggccatctgctcacgtcagcctcccaaaatgttggggttataggtgtgacccactgcacccagcattgaagttttctttggtaaaaagtttgcgtgtgtgtgtgtgtgtgtgtgtgtgtgtgtgttaaagaataaacaaaaagagttaaaataggaaaggtggggtggggtgagattatggagactatttttagttggtagtcagtgagggagcaatgatgtttcttttattagggactgatatgatttggctatgtccccacctaaatctcgtcttgaattgtactctcataattcccacatgttgtgggagggactggtgggagataactgaatcatgggggtggtttcccccatactgttctcatggtagtgaataagtcccacgaaatctgatggttttatcagggatttccgcttttgcgccttcctcattctctctttgcctgctgccatccaagacgggacttttcctcctcgccttccaccatgattgtgaggcttccctagccacgtggaactgtaagtccaattaaacccctttcttttgtaaattgcccagtcttgggtatgtctttatcagcagtgtgaaaatggactaatacagagacctaatgtggggacattacttggtggtggtgtgacctgaggctgcagctggaatggttagaagtagagagtggggaggaatgagcaggtagtaggggctgactgaggagaccccgcagggagcatgaattggggtgaggaggaagaagagagacagctgacctgagcaggcatcgtctctgggtgcctggaagggggctgtactgggaatggaaaggctaatgagttcatcttgaggtcctgggagccctctgtgtgaacaatgagtgaggagcagggctgccctatccatctgggagtcgttggacggagtgtgagcgagtgacagagagagaaagaagcgaagggggccgagggcctgaggaggaagagaagacacagacacagagacctgaagagaagcagccacatccagtgacaggaaagccaggggaagggcagttcatttgacttagttaacagtctattgggggagtttctaaaagaaggctatttttgcattagacatgtccatactgagtttctgtacttttgtcttgtctgttcctcatactgtaaattctttctgcccatattttatattgtctaacccttataagaattttattcaaattcaataatgttgaaacttttctcccccttcaccaccaccctccaattttggctgtgtgtgtgtattttacccagcaatttggaaatgtcactgagtcttacagaaatgaatatatgttttggtaccgtgttcccacgtcatttctagttttgtcccttccctctttcctgccaatgtctgaagaggttcttccaaagcataaggtcagcagagggtcaaatggtaaaaccagtgctaatctcaggatcagtggaatcgcttcccttaagacatggctaattcagtgtaaaatctcatttctgtcttctccaagggagccaggttagctagggaaacagcaaaaattcctcatttcctctgcattttaacttcaaataatcaacttaccctgaatgacggctactgagagctggagaagtggtggggtttgcaatcaggtgcccaggaaaaggaaaatatctcttttccacagactcaagcctgcctagagtgacatggaactttccataggcaaaagtgaaatgggaagattcaaggctaaaaaaagatctctttttttttgtctctctttttttttttttttgcctgccccagaaatggctcttttaatagttgtataactcttctgcatcttgtattgattaaaaagtatataaataagaggtctagagtggtgtcctgggatgttccttttgaacccatcacaggcccagtgccccattctgtggctgtgatcccaggtgcctcccatgtcctgagagtcagtggctgtcatgaaaaaactctggggggctgggtaatggacagatctcttagcgggcctccatgagggataaacagagcatctctgcaagtcactcctggtgttttacctgagctgcctagagtcacttgctgtgggttaggctgtagaagacaaagatatgctggtttatctttagatatgcggattcatttgccatcaaatgcctgagtgtgttttctgtgccagcgcggtgctagtcaccaagaatataaaggcaagcaagctgtggtctctagctttgaggatcttatgtggtcttgtgggcagaaagatgtgcaagtaaaatgacaaagttatggttgctgtggttgaggtatgtgcagagtaggagattaggagaggtttattgctttaggtggcaaaattcaggtgagaaatagcatgtcagttctgtgagttgacaccctaagtgctttttatgtaccaaatacttaagaattagaaagaaagaaacgttcctcttcgaagaacctctctaggagctttgggacgttggtgtacctcgaacttgctgactttgtacccaacttcttttagtgaaactcaagagttaacaattagaattgctaggaagacaaagaaaaaatattgatttggctggtgagttaaaatacatttcacttattcagtaaatcagcttccagttacagttcagatttccagagcgtaggagctcataaactatttctgaggagagcctctacctttcctggctaggatgacagaataaagggcttctctttccaggtctaccattagggcttttggcgagtagatttagcagctgctattctgtagagaggattttggctttagcctcacagtgcaggaagaactgatggagaattccattaggaggatccctcacatggagaggtaggacactgggtaatttttaatgaccctaccttggtgcttcatgaacatgtttaagcaggctggcattttctagcagttccaataaggagcagaaggtagggctgatacccagggcacctcgatgactcaaaatcacagcaaattcacaggcagcgtgcggagaaagtgacaagacttagttgggtagagaaggaggtaatgcgctggaagcacagctgaggagcttggtcgcgtggtcaggctgcctatgcctagccttctgggggggcctcctgctcaccgatggagtgaggagggcccttgcctgtttcccacctgcgatgaacagtgatgaggaaaataggctcaaaccactcagatttcgtgttcaatagtcagtgtcaatgtctaactgttgggaatggattgttgatacagtttttggaatatccatccaataaatagttcatttatggtcattaattaagcaaatatctaaggagcattttatttatgtcaggcactgcgctgggttgtaggaataacatggagaaaaggggtgagaaggacgttattcagataatcacatggataaatgtgtgattttctgggtgtggttgtgcaccctgtagtcctagctaccagggtgtgtgaggcaggaagatcacttgcgcccaggagtttgagtccagttgggtaagagagcaagacccccatctcagaaaaaagaaaaaaatatatacatgtgtaattcagatgtgataaatgctttgaagttcagggagggagaaaaagtttccttgaggaaaacgatgatggaaatctgaaggatgaatgggaattaactagatttttaaaaatccagagactggtccaagcagaggaaatagcatgtgcaagggggcttgcagcagaaaggagtgtggtttgttcaagctgttaaaccatggcaagtgaggctgggctgtgaagggtggttgaaagtctggtatgagaggaagtagaagcagatagggaacagctcatgcagcctgtatggagcatccgaaggacagatttttagagagagagacagacagacaagcaggtgtgtgtgtagtgtttttgtgggggagtgtgaatgtttgacacagacagattacttccatggaaaagtgcctgctctgggcttgaccagtgaggtgggaggccctgggatgattcgttcatgctgacacttaggatggaggcacgggatctttgaggtctcttccacaatttcattctatttttaaagggattattacctgtccctgtctctcctgactcctgtggagaaagggatgggaataggattatgtagggccccattttccttatgagtttttgctccttgctaagtgccagtctgctgaatttataacatgtgtctttgggcaggtggatgagagatgatagggcttatagctgaaggcagaagtttggtatgctgacggagaaggtttgtaggaggaaagtttttatttgtttcttgcctaataaggcttttataatgggtcagcggtgggaatacatttaaacacttacagaagcagagaaagtaacgtagtggggtgcttgcctatctccccatgtggagtggatgttctgaaatctctgagccatccatggacactgcccagagtctggaagtgtgagtaacaaaggagctatggctactcactgatggccctacaccagatgcatttccagatgtggatatggtcaagccacaagaattgggtggtgcagtgagtggggctattataaatagcctgggacagtcacagccaccataatattgcaaacagttgaatccttaacatctaaaggaaaaaagctttattattggaaatcctattcaatctatgttatactctctctgaccctctaaattctgcctgatggatatttttctaaagacttgccaagatcattaagtagatttttacttggtggaaaaatttggcgttatgatttgatcactttaagcagaaaatggaatatgtcataaactctaaattcattagacaagaaccagtatggaaacaggaatacctacagtggcaaagttaatcagagtgcataaggcatttacagtagcccgttggcccccagtgacctgagccttctgggcctcttgctccattatagtcccttcccatgtcgaaaaggtctgatttgtgtaactaataggatattatggaaatgatggagtgtgacttccgttgcttgatcataaaggacatgtggcttcctccttgctttctcatggatctcttgctgtggaggaagccagctgccatgttgtaagtgcacttaagcagcctgcgaaaaaccccatgtggcaaaggactgaagccacctgtcaacagccatgtgagtgtgccatcttggaagtagatcctctggccccagtcaagccttcagatgactataaccttgactaacatcttgactgcagcctcatcagaaaccctgagccagaactgcctgattgagtcacttcttcttcttcttcttcttcttcttttttttttttttttttttttttttctgagacagagtctcactctgttgcccaggctggagtgcagtggtgtgatcttggctcagttgcaacctctccctcccgggttcaagcgattctcctgcctcagcctcctgcgtagctgggactacaggtgtgtgccaccacgcctggctaatttttgtatttttggtagagacggggtttcaccatattggccaggctggtctcgaactcttaacctcaggtgattcacccaccttggtctcccaaagttctgggattacaggtgtaagccaccgtgcccagcctttgagtcactgcttgattccttaccctcagaaactttgtgaggtaatgtttgtcactttaggctgctaagttttgggacaatttgttatgcgggaataaacaactgatagaacattttgacaaaccatctctttgaagctgcattttctgatagccactggctctagcagaacccacagcatcctgccatgcccttggtttagtccttgttatgctggactatatctcttaggtgatatgtcatgctcctcatcttgaaggaggggtgtcttgtccttcatatcgtcagtactttgcagaatgccctgtatttgctgtatgagtgaatcagaatgtgtagaggtaaataaaggacacccgcatagtttaaggacaggtcagggttttaaacccagctttgtcattgacttcatagaattctcctagtctttctctgtttttatttcctctcttgtaaagggatactatttgtgttataaaaaacatacataatatattgctatacatgcatatgtgcttgtgcacatatggattatttcaagagggagataactagtcaatagtggttacttctggggatatgtagggggatggagtaagaggaaaactttcaaaaaacagtgtgtaaacctttcatatcttttgaatttattccatgtacagtgaaataagagtattgatctgcacctctcctaaggcaggtcaagaagaagtcctaagtttagtgaagtatttttaattttttgtcactgggggcccctgcctctgccttgaccttgaccttcaccttctgtctgctacccaggtctgtggcttccacatccacagcagctcagttccatcctctgacctcctttctcacagttgctgccctggttcaggcctcagcagccatctccctatttccccaactgtgttgcccccttctgaccacaccacctgccgcaggttggccaccctcacaagtccctggtggcttcccttcagttacagagtcctgcctggtctccaaggcctgcactccaccacctggctcccacctgcctttgcaaccctggccctcactgttgtccctggtgagcttggtgccagccacactaaaggattccctgtcacctccacagaagagtgtgccctgttactccgtattagccacctctgggactttgctttgcaatcctgacctgcaagaaaggacagtccccacaacagagacatatctgacccaaaatgtcaatcatgtcactctgagaaactgggatctatgtatatacaagtgtggtgtgtgtgtgtgtgtgtgtgtgtgtgtgtgtgtgtgtgtgtgttttcttttcttctctttttacataaatgcctgctgtgcaaccccaagcctagttaatgagcaatagatggagtgactgaatacttttgacacaccacatctctgatcccaaagaatcttcttcttgcagtggggaaaataatcctcccagggctgtacgtattccagcctcagactgtcttttctgacctgctgtcctgtgctctctcactggattctctgcgtgtgccctagtggtctccctgcttgctttcttctttcccccggctcatattagcctgtctgtccccaacatccttcaccagcccccgagctatggtctccgccatttaaaatcgtgccatccttcatggctcaggtcagatgacatctccttcttgggtccacccagcagctgctgttctttctctttgaaatccccagggtcttttgtccctcgggtggcatttattgtgttttgctttgcctgtagtttttgtttgtttactcaacacatcaagcatcatgcgaaatctggggtgcagagatggacaaggtggcctctgctctcaactcttccccagcctagtagagacagacaagaaagctgacagccagttcggtgtggggcatgagaagctggcatatggcacggaaagcagaagttcggaaaagggtgactttgctccgtgtaggcaggccagggcgggttcctaagagggagtgaggcttgggtgagtcttgggggcagtgggaattagcaaggtgacttatgggtgggcaaggacattctagacgcagggaacttcttgaaccaaagtatgtcttgttctcctctgagacttgaacacctctttaggggtaaccattttccttattcatttttatgccttttatagttttaccttagacagctaatagttttgtttgcattcatgtatttattcattcaacaaatattcttgagtgcttatttacttgaggtactggatagatgtaaatggatttaggcaaatagttggtgacagaagaattcagtagaaaccatcagagtagtaggcggcctctgaagtgattagatgtggtttagtgagttttagctacagagtaagtcatgtgttcacggtgaccacacgttagaattctggaaatgtgggccagaacaagtccaagttagatgcaatggaaaaatccctctgtccgagtcatctctagggaacagaacttgtttgaaccagcattattagtttagtttcatgaaagacaaaataaagggcaaggtgtttgctccacagggtgactgcagcagttttcacagtaatgaataaagtaatgctgttttgtcagcagtgagtaggagttggggactgggagaagcttgttccattcctcaggaaattccaaagtcatgcacgggccttatccttggggaacttacagatgaaggagagaatatggccaagcacacatatttctccttttaacacttcccttctttttctttctttttgttttatttgttaaatttctgcacatgtttctcaagtgtgtggtctagtgggaaggaatactggcagtctctgggtttagggaaacattgagtccccttacagttagaaataaaaggctggacgtgcttcaaagactttttgaaataaggctggggacaaagaagtcaagcaaataaatgatagagtccagagaaggtggcattagagatagatctgaaagcattcagggagacgtggtgcaggaggatgggaaaatcttgttttttccatccctgaattgtccaagagcccaaagacatctactctgcaaagtgtttgctggatgacagtgcaacgaagacttagatgctagcaaacttcgttggaaaacactgggttcttcatgtatttggagcaagaaccaaggcattagtaaactttggaaaataggcagtgaggttgtccgatagagtccatctggggaagtattttgagccagttgggtttataactatgaccctaaacttgagtccagcatatgccaagtccaaaggaaaggtatgttctttggacccctcatgctctctgatttacagggacctctttctgcctggtcaaggcatttcatgactctaagcctatgactttttgtgagaagaagccttccatggctcctttgctgcttggttttggggttttggaggcaccaggatgccaggctcctaccctgtgtgcagtgcttccttctccccgtcccattgtgaactgtttcccttgcaggttcaactcattgccacttcctgtagctgtcttagtgacccttcaggccagaagcagatgcctgtgctgtgtaccatgcccctcctgctgctgaactggagagaaaacgtggctggcaggtggtgaactctctggctgattcaggcccagtggagaaggagggttaataatttactttgcccctgtgtagccactggtgttgaccttgtcaaaacactagtagaaattaattagagtctggcctgtcatttaactaacaggatagtaaggccccaaaataacttcttgttttgaggttaatcctgtctctgagtttacggctgacattcctgtacatccggccctgtttgcatccagcagccaggaccgtgggctcatggtgttcatggggctcacaaagagggcacacaaggtcaggggcctgtctctccatgggagccgctcattgtggtaggaggacaaaggccacagtgatcaagatgctctgtaggagaggcggcagaacaacatgtgggcctggtagatattgcaggtgaagagcctccccatcccccaagcttctttcattttaaattcacagcttttgtttcttgagaagttccgaatcttttgcatctggtgctgcgagaaggttcacctggttaaacatcctcaagtcaacagcacagctccttctggaaggcactttaactggatgggatcctctcactgtagacattgctacctccctttcctgaaataaagcctgctccagagcagtgattgtcttgtggtgtgttgtggaaagctgttaatagcttaaaaggtctcattagctgctagataggcctagactgtgaaaggatacatggtgacccaagggtagattctttttttgagagtctcgcactgtcacccaggctgtagtgcagtggcataatcatggctcgctgctgcctcgacctcccaggctcaagtcatccttccagctcagcctacagagtagctgggactacaagtgagtgtcactacctctggctactttttgtattttttttagagatggggttttgccgtgttgctcatgttggtatcgaactcctgggctcaagtggttctcccacctctgcctcccaaagtgctgggatagcaggtgtgagctacagctcctggcccagattcttaccttattagggagtatctaaattaatctgtttattgatctcttaagtagaatctgattaattgtccatcaatagctagctgcaaagcactgcagaagcccacttgccactctccttcccccagctctccaggaaggtgcaaggagttgtttgagatggttctgacatccagcttttgggtccctggtttattgccttttccagtacattggctggcacctttatccagccaacaaatacacgctctgtaaacatgcatgtacttttggagaaggcagttggaccaaggtgagggtgtggaggatgggagtgaaaaacagagtaagccagaaaaaggggtcatgggaaaggaagggcaggagctagagggaagaggcctggggactgactagtgcccagcaatagaaacaatcagcattagaaatgggcaaaggggctgggcatggtggctcatgcctataatcctagcactttgggaggccaaggcgggcagatctcctgaggtcaggggctcaagaccagcctggccaacactgtgaaaccctgtctctactaaaaatacaaaaattagctgggcatggtggtgcatgcttgtaatcctagctagttgggaggctgaggcaggagaatcgcttaaacgcagtaggtggaggttgcagtgagccgagattgtgccactgcacttcagcctgggtgatggaatgagactccttctcaagaaacaaaaaacaaaacaaaatgaaacaggcagagcagtttgaagaaacttctcaagaaacaaaaaacaaaacaaaacaggcagagcagtttgaagtatgatgggaatgaggtacaggggaggcaggaaggagaaaagtgcaaagggatagtgagaagatgggaggtggtgtggagaggaagcagggaagctggtagcaccaagaagtgaaagaggagtttgagctaaatatctagaggataaagggggaaaagatgagtctgaaaggtatgagagggtgacagcaaaggacagaggagaagccgtgagctacatattatgccaggtgagatttctgctccaggaattttggctcacggttatcccaaagagctgtggcagcaagtgttggttttattgcagtattagcagtatgtggttactaaataagtgacttttgaaataaagtgtgaactgtgagactctagaagaggataaatgaaacttttatcacctgagatgggtaatttttatacctcttatttctagggtctctctatccacagcattgagcatgggtatgaaaatatgcattgaggccaggagctcacgcctgtaatcttagcactttgggaggtcgaggtgggtggatcacctgaggtcaggagtttgagacccgcctggccaacatagtaaaaccctgtctctacttaaaatacaaagaaatttgttgggtgtggtggtgtacatttgtaatcccagctacttgggatggtgaggcaggagaattgcttgaactcaggaggcggaggttgcagtgagctgagatcctgccattgcactccagcctggacaacagagtgagactctgtctcaaaaaaagaaaaaaagaaagaaaatatgcattgaatgtaatactttaaaaagttacaaccatcatttgtctgtgggggaaaataccatagtccagttagttgtacctgtctctagtggtctttgggcaggagtttgaagagatcattggaaagacatcagaagaatttaaatgacccatatcccgtctttcagaatgaaactaatattcattaaaaaaaattgtatgctctggctgagaatttatacagccttctaaagaggagacaggtatgcttttggtttccagtgatcagtctgtgaacttggggcattactcagtggatctggaaccttcttactctcaccagttggtttaggccatcccccttcctcttgaaaccaactttgtttgatatgtcattgtagattttctattatttcccccaaatcattccttaatgaacagtacaccttaaatgccttctctttgtatccagaaattatcagctcaaccaataaatagtatgtttgttagtcaagccagtgatccaggaaagacctggggttttttttttttttttttttttaaagatgggcaaagtttaaaaaagaatttttaaaaaatcaaacgttttgagatagttataaatttatatgcaattgtaaaaaaaaatacagctagatgccatataccctttatcctgtttcccccaaatgtaatgtattgcaaactatagtacaatagcatgaccaggatactgacattgatacagctgagatatagaacatttacatcactccccgcattcttcatgttgtccttttatagccatgccatctcgctttccctcccatccctccttgacccaactagtgtacttctctctggtttttaaattttatcatttccaggatggtatatagatggaatcatacagaatgtaaccttttggaattggcttttttctctcagcattgttctctggagattcctccaagctgctgcatgtatcaacaggttctttcctttttattgctcagtggtattctatagtatagatgcaccacagtttgttcaaccattcactcattgaaggacttatgggatgtttcttgttttgtactattataataaagcttctatgaacacagctttttgtgtgaatatgttttaatttttttctgggataaataggagtgtgaatatgttttaatttttttcttggataaatatctaggagtgtgaatgtgatttaatttttttctgagataaatatctaggagtgcaattgctaggatgaatggtaattacatgtttagcttttaaagaacctgcaaaactactctccagaatggctgcaccattttgcattcccaacagcaatgtatgagtgacccagtttctctgaattgttcccagcatttggcattgtcaatatgttgtattttagccattctgataggtatatgtgatattatattgtggttttacgcagttttctaatggccaatcatgttgaatgtcatttcatgtgctcttttgccacgtatatcctctttggtgaaatatctattcatgtcttttgcccatttcctaattggattgtttggggtttgttttttttttaaactgttgagttttcaaaattttttatgtattctagatatgagcactttgtcaaatatgtggtttgtaaagacattcttccaatctctagtaaaacaaaacaaaacaaaacaaaacaaaaaacctttttaacaaggtctttgaaaggtacaagtctttagttttgatgaagtccaatttagtttttccttctatggattgtgcttttggtgtcaagtctaagaattattttcctaccttagatcccagagattttcttctgtgtttttgttttctaaaggtttcttagttttgcattttacatttaagctcacagtccattttgagttaaattttgtgtaaggtggaagtttagtttgaggtttatttattttgcctgtgaatatccagttgctccagcgccatttgttgagagggttattcttcctgcaataattgcttttgaacctctgtaaaagtgggttgggcatttttgtgttaatttctgggctctctattctgtttcattgacctgtgtgtctatccctctaccagtatcacatagttttgatgactgtggctatattatgtcttaaaatctggtagactgaatcttccactttattcttttttaaaattgttttagctattctagttactttaccttttcttttcttttctctcttttttttttttgagatggagtttcactcttgttgcccagactggagtgcaatggcatgatctctgctcactgcaacctctgccttccggattcaagcaattcttctgcctcaacctcccaagtagctgggattacaggcagccgccacctcgcctggctaatttttttgtatttttaatagagacagggcttcaccacattgcccaggctgatcttgaactcctgacctcaggtggtccgcccaccgcggcctcctaaagtgctgggattataggagtgagccactgcgcctggcctaccttttcatataaatgttagaattaccttgtctgtatctatacaaattttgctgaagttttgataggttgagtatgactatgttgagtattccagtccatgaacatggtctaagtaaatctccatttatttagatgttcactgctttcatcatttgattttgtattttcaagcatacaagtcctgtatgtgttgtgctaaacttatacctaagggtttaatgtttttgagtgattataaatggtatatttttacattttagtatccttctgttcattgctagtatacagaaatgcagttgtatgtttttatttatgtttattttatatcaggacctttatttctttaccttgctgaaatcacatattctacaaagttttctttttttttttttttttgtgacagggaggtggtagattccttgggattttttatatagacaatcatgtcatctgcaaacagggacagttttatttcttgctttctgatgctttctgatctatataccttttgctacttatttcctgccttattacgcaggctagaagctccaatactatgttgaatcagagtggtgggagcaggtatcccagccttagtctcagtcttagggggaggtattcagtttcttactattaaatataatgttaattatagatcttttgtgaattggatgctctttagttgagaatgttcctctctattcataatttgtttggagcttaaagaaagtttaaatcatgaatggattttgagttttgttaaatgctttctctgcatttattgatatgatcatgtgatttttccctcctgattttaaactatcaaaccagcctagcattcctggaataaacttcacttgatcctactgtataattcttttaaaaattgctgacttttatttgcttgtattttgttaaggattcttgtgtctatattaatgaaatatattggcttatagtccttttttcatgttttcctttcttttaggatactatttggattttgatattgaataatactgacatcattaaatgagctgagaaggatttcttcctcttctattttctggaagagattgtgtagaattgatgtttattcttttttgaacactaggtagaattctccactgaaaccagttagacctggacatttcttttgggggagttttaaaatatgaattcagtttccttaatagttatgaggctattcaaattattatatttaatatcgcataagttgtggtagtttgtactttttaaggaattggtctatttcatctaagttgtcagatgtgtgttgagttgtttatagatgtctgcagggtctgtggtaatatatcttgtttaatttctgatattggtaatttgtattttatcctttttttctttgtcagtcttaccagaagtttgtcaatcttactgattttttttgttaacatttgattagtggtttttagattttttattttttattttactttaagttctgggatacatgtgctgaatgtgcaggtttgttacataggtatacatgtgccatggtggtttgctgcacctatcaaaccatcatctaggttttaagccccgcatgcattaggtatttcttctaatgagcttcctccccttaccccccaatccactgacaggccccggtgtgtgatgttcccctccctgtgttctcattgttcaactcccacttatgagtgagaacatgcagtgtttggttttctgttcctgtgttagtttgctgaggatgatagtttccagcttcatccatgtccctgcaaaggatatgaactcattcttttaaaagaatcagtttctcgtttcattgggtttttttttttctattttttttatgttttcagtttcattgatttctgttctttattatttctttccttctgcttgctttgggtttatattgctcttccttttccagattcttgaggtaggagcttcgattattgaattcagacttccttttttctagtatcaacatttaatgccatatattttattttaatttccattcaggtcagtgtgtgtttaaaacaaaattttcttgaggcttgctctttgacccatggattacttagaagtgtgttgtttaatttctaagtgcttgggtgtttgcctgttgtctagttcgagtccattttggttagaaaaccagtctgtatgatttcagtccttttacatttgttgaggtttgttttatggctcaggatatggtttatcttggtatatattcttgaaaagattgtatattttgctagaaagagatttcaaaaatagtaaatatgaatcaacctgaaggataaaaataaatgatttttctttcctttggcaatagaaatattgttactagttggacaagttatctttattcacagcctgagttatacaaaaaataggaatacatcctttttggtggtttacaaatctaattatattttcatgttaaaagtaagtggtggaggatatgtgaagtgtcatagtatttgccacagaggctttttcccattcaaattgtaattgtgtggaattttttattttgtagttgctttagtaaaaacaaatgatagaaaaagcttgctttaaattaaattgaacaatgcataagagtatagagtagaagaaaatatattttggatcatacttttgacaccacctttttcctctctcacaatacatttggaggatcttttcagatagacgtacatagaatgtcctgtatgccattctttgatggcagcagcacagctctccagatgctgatttaaaaggagtttagccacgtgccatttctttcttctggtgcccagtctcactaacctctcctaatagtctagcattggcccctagagaaattcaaaggtctgccaaggtaagtcagcaaaccagtcaagggccaggaagtcaggaatgtgtgagtagctgagtcaggggtctggaatcagaagtgagggtgagtcaggagcagggcccgggctgactcaggcaggctgaggtggtgacctgtggaatcagctgccttactggtgctccagggcaggggcaggctcaccatgctgaggcctgaaacttcacttctttcagggatcagctaatagatgtggtcaaggaatttggtcccagtcaaccttccctgcttcttctgtgttaggtcatctgtcagaaaatgttaaccaaactttagggccacatgactttgtttctctttgtggaaatgggaatgatatcactgcaaagagtcagggaagaggtcgtggggggaaaggaagagggggtcaaataaatcagcgagaaagagagaaacagttggaaagccagacagatactgggcgcttctgcaagagttataaactgttcttatcaccaaatctggtccattctgtcactcacatgagtccgtccagtcttcctctctcttattcccaaaattttagccttttaactgaagtccctcctcacagctgtggattgattggagagaatgagtgagaacagcttgtcaagggtgaccttcagcttttacgttaggtgactggtgaatattggaggcattgagaaggaacagaggaggtccatgtcttggagtggtaagtgggatgaggacttccattttgtgcatgttgaatctgaccgtgttgagtttgaggcatctgtgggacacccaaagaggggtatctggcacaagagaaaggctaggctgaagctactgattttggttgggcccaacagctgcttgcaatagttgcatgctcctgagggggaggctgtttgcattctgtccttgttttacatttccattgggagtggtgttttagaacttcttacagatgtcacaataattgtagacctggccctaccagccatgcttgaggtattatgtagattatctacttctttgctgctagttttcccagcccagttcaactatttcctgatgcaaatgaagcttctaagtgtacaaacttaaaatacctttattaccagtgcaaccacactaaactctaattgcccagcaactagaaagactaggagtagacagtttattgtatgtgtgcattttgatggagggaagagatgaatatttgcaaattcatattatgaagaacaagagtacttctccttgggagatgggtttttccaagatggtaaatgagttgcaaagaacaactttttctttcttttcttgagcttattcaactttttttttaaagcttattttgacttcagccaacattacttattttcaggtatacagagtcaaaaaaaggtaaaagaggaggattggtttattgctgtttttctgggcaaaagtgatacttagtgggaccatttggccagtactgacatactgggttaggatacatatttttctcaaaagcattttgaggaattcttaagggttggcattctctgatattggtaataatataagtgtcattggttgttaccaaatgaatctatatactcagattttccttttgttcaggttattttatattttaaaaagatccatgttgaggcagatatttatacagaaccaagtgattagaattgtgatgagttgctagctttgtagattgtgctgttattgagaactttgcctttactggttttttacttctcttaatgtacagatctgagaaacagagttgctgtaaaagttcaaatgctgccagataggctaagtggggagaaaaaaacctttagattacctctctcaaagagagtcaccaatattctacagtctctggatatagttttcgagtatacagagggtacaaggttttgcatggacggacgttttcatttctttggcgtgtatacctgggagtagagttgctgggtcataaaataactgaggaattcccaaaatgttttccaaagtgacagaaccatttctcattcccctagtaatgcctgagggtcttcatttctccacatcctctcccacacttgttattatctgccttttttatgatagccatcttcgtgggtgtgaaatggtatttcatcgtggctttgatttgcatttctctgataactaatgatatcaagtatcttttcatgtgcttattggccgtttgtatgtcttctttggagagctatctgttcagattctctgcctattttaaaattgggttgtctttttattactgagttgtaatggttctttatatattctggatatcagtctcttagtacatatttaatttgcaaaattttctccccttcttcagattgtcttttcactttttaaatgctatcctttgaagcgcaaagatttttaattttcatgatgtccagtttactcttttttctgttggtacttgtgttgtatctaagaaaccatttcctcatccaaggtcatgaagaccttctcttcttctgcagtcgagtgagaagtgagcagaactggtgtagggactgcttctactgaagggggtgcaagagagaagacttagccatgtcatccttgatcataaaggtgatcaacactgagaaagcccaagggtacactggtcccttcagtcaagctgcattagttgacgggatcctttacatttcaggagagctaggcatgaacctttcgagtgcacagcttgtgccaagagtgggtaacagaagaagctaaacaggcccttaagaacatgggtgatattttgaaagctgcaggctgtgacttcactaatgtggcaaaaacaactgtttggctagctgacacaaatgacttccgggctgtcaatgtaatctacaaacagtattttaagagtggtttttctactagagctgcttaccatgttgctgctttacccaaaggaggccaggttgaaattgaagcagtagctgttcaaggacctctcacaacagcctgtctataagtgggcccagtgctgtctagtccggaatttttaacgtcttcattgtcacagttgatataacatcttaattaacatcttgatttttataattgatgaaaagtgtaagtttgactaaagtatccaaagttatggaaatactatataatagaattaaacatgaattgaaggttagatggtgaatccagttactgatgttacaaattacacttatgcacacccatatcactgaatgtaggaaagagatactcattacatagttactcaaataacagggaaataacatgtaggaaagatgagttgttgttcctgagaaataatcaagagcatacctaattccaataaattgagtgatgtcatatatttagttatcatgtcaggtatgtgattctggtaattctgcttttactagtttaaaattaaaatatttaaatttgaatggtaggggtaaagaaatagaaaatggaccaaaactttatatagataatatttttctaatggatagaaaatagacatgcagatttaagctttactctttttctaagaatttaatagttttagctcttacatttaagtctatgactcattttgaattaaattttgaacatagtatgaggtaggagtctattttattcttttgcatgtagatattagttgtcccatcactgttggttgaagagacgattcttgcctcattgaattgtcttagcactattctgttcctcttaagttttattttccaggctccctaccattcaagtggtttcccagacattagttttggtgctgaagcttggatattaaagcatctgctcaaaagagactgtttagaccagaagtgactgagatactactaactattaagttcaagttaggattactgccattgtaggtagatgagaggttgtgagagaaattagagagattgtgaggaaaattaagctgttactagaaaaataaaaacagtagcgttttctctggatgtctggaggttggggaagcatattttcaaccctgctttgtgtgcagccttactgatggtaacttggtcacctggagagatttcgtgacagacacaatttctctactgtagactggacttttacacatggacaacagtagttacttgaaatagtgaaaaaaaatgaaaataagcaataaaaatcaggaattctcatagtggctgtgttactctgctattaaaaagctgtgtaacctcaggcaactgctccaaccttgctttatcttatattaaatggggatactggatttatgacctctggctctctctggcattaaagttctatgacgttgatgcatttgaagatgatgttaacgtgggcaggctttgatgtttagaaaccacattataaaaacctacctagcagtgccagaaagtaaggaagtgctccaaacacacacacacacgcacgcacgcgtgcgtgtgcactcacattgatgaggtatggcacagggacacaggaacgaaatacagaagctgccggtggccaaagtcacaaaataaggtagtattggattatgaccccaaaataaaataaatgctcatggtgttcacactgatgtaacaagtaaatgaatacataaatggggaataatagaggactctaccttctggaagagttccaaataatttatttagatatattgccttcaagtaggtaggggctcacaccccattcttgaagttgggctgcacatagtgaattccttccagagtgtacaggatgaagtgggggagaaaagagtcactttttctggtggactggggagtcagtagagaaacctgataaacattacgtcagccacgtgatcaatttcagcatcaatcacattgatagtatctacccttgatatgatatgctgaaaatgacactttaccttcatggtctttctaccccaaacatcagacaaattccaattgaggaacatcctgcaaatataccttgcgcagtactcctcaaactgttacagtcatcaaaaccagggagtctgaggagccgtcacagccaagaggagcctgaggagctatgatgaccgaatgtgatggagtatcctgagtgggatcaagagtcagaaaaggatgttaggtaaaaactaaggaaagctgaataaagtatggactttggttaataataatagatcaggattagttcattcattatgacacatgtaccatgttcgtgtaagatgcagtaacaggggaagccgagtgtgggatgaaagggaattttgtattattttagcagtttttctataatctaaagcttttctatagataatttttcgtttagaaaaacctacctgggggaatattctaacacccagtttggtgcctcttctgtgaagtcatcctcaagcagcctccttcccacagtgccactgctttctccgtggcaccagttgcatctctgttctgccactggcactgcagttaacttcctctcttgtctgccctgcaaggctgtgagctcttcattcatctttatgcacagcttctggcacacaagacgcactcacatgtttgttagctgatacaatgaaagaatgagccctagaacatatgtttcctgaatccactacatgtaccactttttgctttgagtccctgtactcgaagatgctcacattgtagctaagaggcagaatagtaacgggataatgatgcccatgatgtaggaagaacagatgaatctccgttatagaagagttccaaataatttaggaagagaaagaaatgcctactctctctactttagagaacagcataagttttgcaatgagaatgtgtcagaaaagtgctttaaaaatatgttcatcccaagaaagatgcaaatagtactgggaccaactcccctcctcctcctccttcctgcaaacatacctggcccagtatatgtaactcctgaaactgttacggtcatcaaaaccagggaaagtctgaggagctgtcacagccaagaggagcctgaggagcaatgatgactgaatgtaatgtggtatcctgaatgggatcaagagctggaaaaggacgttaggtaaaaactaaggaaagctcacttccagatatttccagtcagagactttattacttcatttaaggcttttagtctttgaaatcctcaggtatgatgacttatctggaggcatacacttgatttatcaactaaagccttaggtttctcactctggtgaaggcagaacctggagacctggcaataggaggcacatcttaagggaggttagaggatctgatcagttcattgatcctagaaattgacattcaaaagatgaggtgggcctaacttgattcatttcctcagaggcatcacacacatttcaggattacactccaatcctacctaataacagtgtacagattaaggagtgctaggttctcatttgcaaggaaactttgtgagcaatagatttgcaactttgtttatacattgacatttttcataggttgaatctgagaatacttacaaaagcacatagagtaaaataaaaaagatatttctaaaagatcataggaaatataaatgtaaatagaatcaattctggggatagtgaggacaaatagaacccagctgtgtagtccaataatcttgaaggtgaattagagatgtagtcctgagacttctggcaaagtgaaaaaggaaacacgatcaacttcatgacttttgttgtccataaggaaaaaaaaaacccaaaacatttcctcaggggaattaaagcttctcttgacatataatgctggaagttatacccaagtttccttgctagcctggggacctggggacccatgagcagagagaggaggtagatgctgagatccaggcatgcacactgtcatctctacatgcctcaggcccacacatcactgaagaagaaacaataattgtcccagagtcttgaatacgtcatcaggtatgggcattttatttccagattttacttccttactgtgaagtatgagataacatctgtccttctgcacgtgggataaggggacgagtctagctgctaaatgtgagtgtatgagtatgattctgaggtctggtttgataccaggagttaataagataaagaacataataaatacattagaccaatattagtactttagatagtgagtttatgatttcaaatttgcagtgaagttaatgctggtaaagttgaatcatattgatcctcttgcctttcttttgaagatattaaaatttaagtaagagctgaagaagatgatccttacaagtctgcagtcattcagaattactccacttgtgctctcttcttttgacagggttactaggcaaggagatttgggccacagacagattttggaaggagctttctagtgatggatgacaggactcttggtcctgtcatgttaacttgtttttcatgacataaagacacagaaagcatgcttatcaagactgtacgtgacccaaagcaggcagagacagcccaagtacaatatggcagaaccaagattcacaatgatctcaatggtcagaaacaagggattaaaaatcaacttgattaaactgaaaagagatacatgatatctgctgtttctttttctttccgttttggggattaactatagaatgaagacgcatgagttagtaggacttctggatgatcgtaagctccactccctggcagcagcacagatacactcatgtgtataaggaaacatgctatcaagttttagaaacctttgaagtaccatttagtggatttagtgagattgcatattctcagattcgatgctgttctttccatctgctatggttataataggtgcatagttactttccacaatcagaggttttcaacaaataaaaagtagttatggagctccaattgtatatatgacattggtccaggtactggagctaagaagataagcaagacatagtccagatccccaagagaaccaggcatctctcctaaatatgtgtagatgagggatggattcatgtaccacatgtgtaacccccagtacctagaagaatgagatggacaataagtgctaagagagagatttgaaaacactgattggggtatgaacctgaaaatcacttaaaaaataaatctgcaaagcaagggatgtaggctccaaagaccgtcatttttatatgcctgtgttcttgccatttaaaaagttttacatttataggttcaactagtgacttactattctcaaggtatagccatcaaatgaatatttctaactggatagtgtgtgagtggggaggggttgagaaggatctgtattctgaaatggaggccaagaagctttgtttatgatggaagtacagaggtggagttctcgttctcttctacatgtctctaggaccctcctgtggttctgttgaaatccaggctgtgaaagagtccacctctgccaccaccctttttctttgttccttttttctcctctgcacctggattcagcatttaacacccttcatttatgagcaacttataataaactactcatatgtgattaagccattaaaaatagaagtagaaaatgtaaaagcaggaggagggatggattttgttttgggaatcggcccaatcccatgaactttctgttctttctgtttggggctaaatggtcccgattcttcatttcagactaattgcaaactggtgtgcattacattttccatcccagaacaactggattatggctttctgttcattcctgaactctagccacttgcaatggtgcacagtgttcagctggcatctcatccagcagattttggccaagggtgttccctggaaactcgagtgtctaggcatgagctcagacactggcgtgtttgccatccctctaaatgtctccatgtgcttcatgtataattctaactgtaaagccagaaggtagctcctcttctctgcatgcagtagctttctcattgctcctgtcttagggatttatcactcattccttgtatgacaggaaccgtgaagattgttttcatcacctctactggaaatggcttgaatgaaggtcttttaaaaatctttctttacatccttctgggggctttatagggtagaggatcagttcatataacttggctataccctgtgggtccttaaaccatgatgcttcctgtagcttttacaggaagcatttcctgtgaaatctctgaaatagttttcacgtgtaacttagaaaccagctgtcagcaactcatttgcatggtatcatcagtatcctttttgctttctcagtcagctcatttaccaccatgccttccagttggtgttggtctcattaccagcatcttggtggattgtaagatgcagtgactctggaacctctgccagctctgagacctcgaggtggcattgagctgtcttgtgggaaggcctcccttctgtgtcaagtattcctcatggttattaccagcttgtttctttaaaatcaaatgtctcgtaaaatgtgaatttctggttttatacctgcaatgattcaaaaacagcctttgtttgcccctttgacctaggaacaccattaaggagagaaagaaaggatgacagtaaataatcagccctagggactctccgtctaggaaaatacaaaggtatagccactctactgttttcaagctctacatatgagagcactgatgaatgattttggggaggcacttataagcaccaagtaagggtgttaaatgaatccacattgtcttgggaggtgtttcacatgacttggagtgtgaccagccctattttccctgatgtagatagactttaataaagcattaggtcccagtgccattgtaaattttgttaataccaagtgaaggccaagggaattgggaagacatctattttcatgtgaaaacataactttggaagcacataaagcaactaattgacaaaaaaaaatgaaagcatatttccagaaggccaagaatgtcttggcaatccagataaatgctgtttgtaaaagcaaaactgataaccaggaatgactgtggaatggagcctcatgaactccaagataagataaatgagtgaaagacaggaggagggaagtgtgtgtttcctgggaaaatgttctcagggttattctaaagctcacttagacaggcttaccaaggcgacaaatacattaaaaacaaaacaaaaccctccaaacagccttagttccttacttgtagggccttaaaaccaaaacgtgactgtttctcagaaaatcatggtaatttttaacagaattacctattgagaagatcaagagttgtgcttgacctgatatttgggttgagccctgccttctactctaggggtccccagccctcaggccatggactggtataggtctgtgacctgttagggaccaggaacacaaaccctattgttaactgtgcatgcgagggatctaggttgcattctcgttatgagaatctgtagtaactaatgcctgatgatctcagatggaatggtttagtcctgaaaccatccctcccctcaacctccgccgatccatggaaaaattgtcttccccgaaactggtccctggtgccaaaaaggttggggactgctgctttactccattccaagtctgtcttgtaaaggaatgatcaagaaagaggttggtggcctttcgctagtagttggggtggtaggtggtatattgtagaggatgaaagcatgagccctggagtcagactcacatggaatcctggctgtgtgccttgagtcaggacacctcactggttggagcccctgtttcctaatcaataaaatcaggataattacagagcccagcacacagagcacagtgagggtgaaatgagcccatacattcaagacttggtagcacagtgtctggccaccaacagatgggtgctgatagactcagagaggggagaagagccaggggccaggcacagcaacagctctgtggttgctgagtccggcaatgctgagaaggatggcagttgcatccacgttgtgtggaagcagcacttcagcaatccaaacagagcagcagaccccaggaatgggagtctgacgcccccgaggccccacatcctgctgtgtttggcggtatggggatggctggggactgatatcccagctggtgcaggcccagggatcttctggcaggtctctgtaagtgcctggtgcatctggtgacttcaaacaaagggcaccagtgacagcgttggtccaacaggaaagaaggcctttggcaagagggcctctttgtttgctcctgtgtgtgtgcaccttgtctgccctgacaggcggaactcactgtttgttttgtggaacaaagaacaggcctcgttagattggagtgggaactgggggcaggtagggggagcagggtggggcgggtggtggcagggttcctgttgtgacagcacactccaggagaagcgtctggcatgtgtctcttggcctcagcaggggaaaaagaataaagacacattctcatgcttcaactttgatcctgcaaagtaaaagtctgcagacaagggtcttgagtggcctgaacctcttcactctctgcttcttatttaacataaataggaaaattattggagctagctgcttaccacagaatgaggtgaaagagagggctacagtttccagaaatgcagcagttccacaggaatggagggtgtgggtgggccaggcagaggggcaggccctgcggaatctggaaatggtggcttcagctcaggccacaggagctgagcatgtatgctgtgcagcagagatgcgggcttgcacccatgcacacacgggcggcggcctgtaggagtcctgcagggaagaagcccagctgttgtatagggaggcatttctttctcacattagtgggcacttccattttcctggtgccctcagtgtcacgctgagaagagtgtgaaagacattctctgtacacttgaggatcagaggtggggatggtctagatggaaaacagaattgagcagaaagcagcccgtccacaggtaccacactgtggcatgtgctgttttttttccatctgcactgcctttcccttccctctgtgtgtggcaccaagcactctgcagctttacccgtctcacccaaatagagttaaggctccctcacctcctcttcatagcattgggttcttgtctccactatagaatatatagtcttgtgttgtgctttgttttttcacatcagttgctcatacttaggttgattggggaaacagttttttttttttttttttttggagaccagggtctcaccctgttgcccaggctggagtgcagtagcttgatcatggctcactgcagcctcaatctcccgggctcaagcgattctcccacctcagcctctcaaggagcttttgtaatgacaaggttttgccatgttgcccaggctggtctcaaacccctgggcttaagtgatccatccaccttggcctcccaaagtgctgggattacaggtatgagcccctgtgcccaacctgtttttgtttgtttatttgttttttgtttgtttgttttttctttttttgagtatttacttgtggccagacactgtattaagcctatgagcaaaaatggatgcatgctgtctatcctaaaacgtttacagaaaacataagaaaaaaatcatacaagtaaataaaaatcgcacccatgacaaggcttatggaggagaggggctaggatttgacctcatttgtgtggtcagggaccatttccttgaggaggtgaggattggtagagaggaggcagagtcttcaggcagacacgcagaggccctggggtgggaggaagtatggtccaggaggaacttttttttaaaagccagtagaaggatggggtgggtgaggaggaggagtgtggtgtgagatggggctggaagggtacgtagatgatacagacattggggactgaattaaggagatttgttttttatttttgcgtttatccttaagagcgcaagaaggccactgaagcatttggtggagggtgacatgatctgatttgggattcaaaataatttctcctgccccagtgtgtggggatggattggaaagggcagaagaggggatgtgggtagaccagcttggagggtcttgctgttgcccaggaaggaaacgttggcagcttggagtcgcatggcagtggtagaggtggagaaaggaagaaagaactgagataaacttgggaactcatgaaataaagttaatggcttttttttttttttttttttttttggagacggagtctcactgtgtcacccaggctgtaatgcagtggtgtgatcttggctcactgcaacctctggcttccaggttcaagtgattctcctgccttgagtagctgggattacatgcttgtgccaccacacctggctaatttttgtatttttagtagaggcggggtttcaccatattggccaagctggtctgaaactcctgacctcaagtgatctgcctgtcttggcctcccaaagtgctgggattacaggcgtgagccaccgtacctggcctacatggcttttcttattatgtaacttctcagagtctttaatatgtgggttaatgtaaattgtgattctctgagaaaggactcgaccacaagaattttccacagtgtgaccgggccgcaaatcttttttcaaagaatcttccacaatatttcattccatagcatacttctggggaaatactgcattacataattgattcttttttgggtactttccacagatagttgtagatattataccaaggtctgtaattgggaatgggcctgacccagtacaaagaggaatgtgtttgacacagggtttgaattgaagccttgggcagatcagatggaataggtagactgaattcaatttaggaaggttttggaggccaggctgaggggagtttggatgcattttgttgtgtgttgggagtcgttctgggctctgagctgtgtcatggtggaagtaccatcttggctaggtcattctggaagatacctggtaaatgggttgggtggtgaggtgtgtattggagttgggcagccttgctttctagcagtgactggatgagaacctgggtgtggggagtgggaatggggagtgaatctttggggttgagaaggaagtgtgagatgttttccttcatacccttttcctttggtgggtggccactgtcaacagctgaaaacaagagaggctcttctgtgtttttctgaggccagataagcataaggagacccttgcggcccgtgggttcctgtgcagcactggcagagaggccgtgtgttgggaatggtgctgccattgtcagggagtgggagaggaattacttacgttaatagatgaagcccgaggaggaggttaagttggcatcaaggccatcaacttcccgccacggctgagatgtccctgtgtgactttgaacaggccacttaacctctccaggccccagtttgctcatctggaaaatgagaggctagaacgaacgtcaggcccctcctgagctggaattccagccatctcggggaactgaacattgttaattagggcaatcatttatcagggtcagcaagagcctgtgctcccagagaactatcagttttgtgaaaaatgtggattgagaatgaagactttgggaaaaaaaagcgtggagcgttcagttcacccattcctctgaaattcaggcatcttttctgaggcaaagatgtaacaaagtgaggccgactttagccaggacagactttttagcaatgcaaaggtagacagcatcctatgaatgaatgaatcggctaactgaatgcttattttaggaacagagggcgctaacattttatttttatgtgaggtgtttggaagttgaaggaattttctcacagagacattgttatgaattgaggctaggttctcaggccagctaacaatagttgatttagcccatgacactgctaaaatagtgtgtattaactataaagtatagaatacatgtgtggtgggagaatgcgtgtgtatgcttggggagtatcacagggtattaaatacctagacacataaaaacctctatcaagctgattaattcagtaaccttggatcgtgattgtgctatgtaccaggtgctgggctgggcacagagtgggatggaggccctgcccagaagggctcctggtgtggttttcagcctgtgggctctcaactctggctgcctgggttggctcctggctctgctgcttatacctatgagcccctaagcaagtgacttacctctcagtacctcagtttcctcacttagaagcaaaggattataacagttaatagcagtgcctccctcagcgggaagccgaagagaattcagtgagatgactcatggaaagcacatagctggtgtctggcatagactgagcactcagaaaatctagtgatgcctgcctaggcagagagccctgtcctcagggggtgcaaccagcaacttacctgcggcaatgtggggagttaggcttattgtccagttccccaggcatagcctggcatgggatgggctgagaggtggagacggggtgttggccatagagggagagaagaagtggggagcaggaggagggtaagggaaaagggtgttgtctgattttcccccagaagtcaaggtacaatttgccagcaaaagggatggggttggggcaagaggtgacctctaggagccatccgagagctgcacaggagccagagggttattggaggcccctagatggggaggaaagaggaaagggactggcagctaaggaagagatggaagcagcagtgggaccccagcagcagtgccctgactgccaccgtggatcctgcagcggcactcacaggggggaagttctgggaagggtcccatgggtgtctgtgtgtctagaggtggtggggacttcctttggttggtagtctttagttcaagccccaggttttatctctagcctctgtgtggggtctgactattctgttctctgggagaatgttcaggagcctagagcagttggtaatcaggatgctgataggcccaacttgcagggagcgttgttttgattttggcccccatgctttgagagaagacttagtacaacctgccagtgagtgaggaaggaccttggacagtttagcctaagaggaaaagaaagacaggatggtatgagggtgggttttaagtttttggaaggctctcgtttggaggaaggacacactaaaccatcctcagttggtctcagtgatattgtaggaatgcagacatcagctcagtgtgaaggaggagtttccatgcctgagagctgtgggaaaatggaaaggcttgttttgagaggcagtgtgtttccagctcccggggcagaggctgaatggctgcttatcttccacagatatgggggaaggtggaaggaagtgttagaaattcaaattagggtttcaacctgagaaagttggtgtcttaaataatgctgatgttctgtgactttatgaatgggtaagatgaatgaaatacaggcctgttttaatttatctggagaaatggaaactttggtaggtcagagagaggaaataacctttatctgccatgcagataattgcagagatggctatgaccttagagacctcagaccagtgtgctcatgagcctgtcttcaggcagtgattatttagatttcacttatgaacatgttgaactttctctgggactttaaactctttaaaaatggcactgtaccttgttcaagttgtatattcagtgactgtagataatcaatggtggatacttcaatccttaattggattctcttctctgacattttatagtcatggaaatgaggctcggagaagttgtgactgcctcaggtcacagaccgacccaggggctgccctgggaccaagacacccactcctgctcagcctccagtgttccttctatttagtccactttcagaggtcccagtgcagttggaatatgtcagtaccaggcatagcatttcattaagctaccgcctaaggacgcaccatgtgggatgcttttagcgtgtgactagggattttgtggcacatggcagattttcctagatgtgaagtctattactctgcagagcctcgctgtaacaccattaattgtcaaagccagggccaggcgggggctgccaggctctccagatcctcaatagttaggtcagtaggagccttggcaggggccttcctcctactcctgatgaggtggccccagggatgggccaagtctctgtgactcatacccaagagggcttctcaaaatcacgagtcacctgggttgatgtgggtatcttaggggtcaggctggggtccccaaggtcagagtaccctgccagatgcagtgcttgtggtccagtaaatgacagcaggtgacctggctaggggtggagggagtgggactctcatcagataggtcctggagggcaacctgaagctcagagtggaccagttgaggactgggcccccttgtgtgtggggcaggtgttgcagcttcatcagcctgcggtgttccagggctcgctcagggcaggctggctaaaggcttggagtggaaggggtgtgttattaatccattttcatgctgctgattaagacatacctgaagctgggaagaaaaagaggtttagttggacttagagttccacatggctggggaggcctcagaattatggcaggaggcaaaaggcacattttacatggggcggcagcaagagaaaatgaggaagatacagaagcggaaacctctaataaacccatcagatctcgtgagacttgttcactatcatgagactaggatgggaaagactggcccccatgattcaattaccttcccctgggtccctcccacaacacgtggggattctgggagatacaattcaaattgagatttggtggggacacagccaaatcatatcagggtggtatgggtattcacggttattgagcagctgccccctgtgccctgcgtggcattgtgctgagtacgctgggagtggcatggcattgctcttccagtttacagagcaggaaacagagcctccgggttcactgctgatcattgatgaaagcagggtgatgatgatgataatgatgatgagggttagcagaatcactcctgtctactcagtgcacagtgcacgcctggccacatgctatgtactttacacacattacatttcatcctcaccaccaccctgtatgtcaggtactatcattgccctttcaaagtggaggagattacagctcagtaaaaggtagttgacgggctcagagttgcatggttgatgggcggctgagccaggatttaaactcaagtctatctgactctgggagcccaggctctttccttgttacagccccacttgtccttgggaatgaagcttgtgatgaactccagattttgtttttaatggatgtgagccaggtgggctggatctgcaagtataatagtaggtctttacgtgatgtgataggctagatgatgttgcagtaataaacagcctccaaagctctgtagcttaacgaagaaaagcttatttcttgctcatgcttcacatccagtcatggcagggttggagttggttgctttgttcctgagtccccgggggacccaggtgttggtgatctctgcagtggggtaggaggaggatatggtagatcattaatgggctcttggagcttgtacctggacatgtcacctgccacttcttgcatttccttggccaaagctaatcacatggccactcctgacttcaagggggcagggaagcacattgcatgtgcctggaggagagaagaactggaaatattaggtgaacagcactaatgaccctcacagtgattcatggggcctgtttggtcagcaccccaagatggttcctttttaaaacagatgagggctggccctagagcagtcctggggaaggtcttggattagacttggttactccatccctcccactctgtctgtcccagctcttttgagggagggggtggcattttattctccatcagaaaaggagggaccgagtgagagtcttgccaacagcatggctgggaaacaattgctctaagaggacgggggccaaaaagtcaccacacctccttcaaggcctctgtatagaaggaaatctgtgatttatgctctgtaacttctgggtggtacacagtaattccttcctggacactgtttgctgtgtatatagcgactcatcctttgacatttcacaccattatctttcatttttcttgatccgtgcagtgaatggatccgtaacgccaccctgtttttaagaaagctgagctgtgatttagagaagttgttacttgcacaaaacctcacagtggtcaggtgactataccaggatcaggacgtttctattctggccccattccccttgccagtcagttagagctggctattgacccaggtagcctggccttgcaaggaggaaccagggcactctgggctttgtaggagcctggtctgctcagctctgtctcagggaacagcctactactttaaaggaggaaataataaaggtcactcttgtcaggtgtcttaaccctgtgggtaccagagtcagcctaaacgcttgtagcagtcttggcccaggctcttgcctaccgagaccatgtccttttctttctccagtccctgcttagcatcgctcctgtggccatggaagtgtggggcaaacggaaaagttgacagctttctatacggaaatttggtcttgtttggggctgcaaggaagcactaatgagaagcatccattggattgaaagttcttggcctcagcatttgtatttaagttctgaaaatggcatgatttttataattcaggagagaccctttcagcatttatggatatatggtagcaaaatgggaaagttgaaggatccgttttcacaaataacaagacttccgggcaggggtgcagggcagaactgtggactggagtaggcctgtgagcttccagattgagcctttggctgcttgtttatcttctttcttcaaaaatcctgttgaacctgttggacatgtgtgtgctgacagcaagctgatttgtaatcatttgtaaagccatgtggtctgtctgtgacagcgactctaactgggagtctaacgcttgcatttacccggttcccaccccccaatattttcctagtgacgcagagcgctggaagcagggcattgtctgggtggagtcccttccgccagccagcagctccttgaaggcgaacggcactgcaggggcatgttgggttctataaacagaacttttacatgctggtcacaaggttagcttagactgtggctctcatggtgagggaagtggtgtcttataaatatgatgtgaggctccttttatctcctggaaactggggaacattttgtaagaatttttctaaggaatggtgttaaaaaaacaaagcaaaggcacaatggaaggcctaaggctgtgtttcatagaagcccctgaaatgcagtcttggtgagtgtgtggatgtagctgaagcccccagctggcaggttcggggcctccttttcccttccctggctggctctggggaattttccctcaagctgctgcccccacttggaagaaactggtagcaactagcagaggtcacaagcaaggagtcagagaaccgggttcaagtcctgggtgtgtgactgttgtctacccaaccttaatgtattgtggtcattgactgaggtcttactatgtgtctgaaacattgctaggtgctttgcataatgtctcaattcatttttagaataatgagaaaactgaagtttcgagaagaacaagcaggaccaattcaggtctgctgactccaaggcctgcactctttttgttttcttttgtttttattaagataacattcatataacacaaaattcattttaagcattttacagtgtgcagttcagtggttttttatatattcacaatttgggtagccaccatcgctatctaattctagaacattttcatcaccctaaatgaagcccctttcatctgaattccccctttccctcatcctttgtcaaccactagtctactttctgtctgtatggatttgcctattctggacattttgtataaacagaatcataccatatgtcaagacctgaactatggagcatgttgtgtttcggaaaaatcaaatcacttaactgctctacatctatttagttgcagtgtgttgtggtcagaaggatttttatttccttgttgagtatctctgtaggtttattgtgtgtcaaatgcattctgtgagcaaatatgaggattttattgtcgtaacttttgtcttggacctatattttaattacaggccactctgagagtgaatcttaactagtttttttaaagggaagcatgttgacttatttcctaaggacattatgaagaaaaccagagacatttttaacctatgtaatcactgagttgccataggaaaaactgggtaattgaatatgattaaaagggagtatcttttaggtggttctataagcaagaaaattgccaccagggcaacagaaatacaggatgtaaataaaatcttcattaagcaaggtatatgtaaactctacaagtacggcaggttaatgaccataaggagagaatggccctcacctctggatgctgtggcagggacattgttacagatgatctggtttaaatggcagcatttgaaaataaaatgtaaacatgaggcagtaggagtagaacctctagtcatcttagctcactgaattccaggactacctaatgctgcctgacttcttcaagttcattctagaatcccagactgttagagctggccaggacattgaaacaagatagactgacccttttgtgttgcagaggggagaaagtgaaggcagatagaagttaaatgatttgtctgtcgtcatcatacatgaattgttagcgggatctggtctagaattcacatcttttaacaaaaagaaattgaatattgatctgtatgatttttggcattggaatcaactcttccttggaaatatttggtacctgggtgatgaataccctctacttctttgccacttcctttgccacatttatttccatctctcccatgcactatttatttgtgcccctccaccctccccccgccccacacacacacaaacaaaaagagcttatcactgtataaccaactgagttctgaactgtagatgtgttgggagagattggtgttggcaattttggtaaatacagtgagagaaaatttggaaattctgatgttcttcttggagcatgggatttaaaaatattttgcaatggctcaaccccatcttgcccaagaaatggtaagtaggcaaatcaaaaaggaggaaggaaggaacccatcactttacattactaaaataatttcaactttttaaagatttgtatctcttttttgattttctgatctgtttaggtattactgattataccttctttaaggatgtgaattgaactcagagggggcaagagcttgcagaaggaaggttgcaatgtgagctggctgcaaagcctgcagtagcgcacaagcggcctaacgccaaatcccaggcactgagaatcctaccaagaagcataaaggatttgaccagttaggagctcagctcaaatctctgcagaaaggccctgagagctgagaagggtccaatcagcctagacctcactactcgaaggggtatccacagacctgcatcattggcatcacctgggagcttgttagaaatgcagagtcctgggtcccactccagacttcctgagtcagaatgagcgttttaatgagatctctaggtaattcattaaaatttgagaagcccaagattagagaccttatgccagggaaattaacaaatgattgggagaagggatgaagtgtgctagttaagactaaaatatatgctgtttctgtacctgaatagttgacctttgctcaggtgagggggaagctgaagacacaatatgggggacttgctttcctaacacttcagagtgaggaagggacgcattattgtgacccgggccctattgtgcaagtgaaagcagacgtccacagacatgatggtgagaagacagtaatttcccagcagatgagctgacctaggggatgcttctagtacctctcagctgggatcctgcagccccaacacactggagcgtgggggtggccagcgagatggaactgacaccaacattccattctctggatgtcccggcctccacgcctcagctgttttcactcattcagcaaaaaagagagacagaaaggaaacaaaagccggctgtggcagaggccgtgttaattagtaaaacctgatatgtctgtgtactgggtcggcactaggacaagcaggaggctcttggcctatgtggttacttgttgtccatcaggagcgagcctgtccaaggtgtcgggtccgtgttcctacaaggagcgctcctcagcttcctgagtcaggcagaacatgcaaatggggccatttatggtgccatggggggtttggtactcatctcttgtttctccaggggccagtgtgaacacttctaaatgtgggtgttaacccatgaacatgtggaaaatgtgccagcctgcaggcaggtgattatttgcaatgaatggcttgatggcaaagagtgggatttcactttcttgcatatgtgtgatacaattgttatatttcttttttccttcttttaaaattggtaattggagcatatggctaaaagtcaactatttttaaagtaatggaaattttgcagttcagcatgttgaagcatgctgtttggctgttttagaagaatgtttttcttagatgccatcggtttaccacaccacccttgactgggaaatggggctaagattttaataaattagccaaccaagaaacctgacttacccttgaaataagatgggtgtcatcttctttgtgcagtgtagtcgccctggaaggactattagaagatctcaattctctgttttgagaagtctaggcttgatttttttagctggtaaaaaatgtgcaggtagtggcctgaagccaagtgtgacgatttggaaccacagccggtaagctgtgtgaagtccttcccttttgggaagcagatgtgagtttagtggacctaacagtaataacaagggctatgacgagagctgtaatcccatttaactagatatttacaataatgtactaggtgggcaacttcatcccccttcttcagataggaaactaaggctctgtgaggccaggtccagtggaaggcccagcaagaggcacagcctgggtttggatctgatctggctgacttcagagcctttgctgtttcctctaaacagacagagaagcatttttagaagtataaatgagaattccattctggaggtgatttatgtctgtgttaggatgggacatgtgtctgtgtgccgggtgggcaaggaggagagtgcttggcaaagtcacaggggaaaagtgacaccacttcctggaataccaagaacacagtatccttaatataaaaagagacatagtagaatgaaacatgctatggtgttgaatgaaaaatttacattcatttataatggaaaaacccaagccttgaaagcagttcttcgcagtcccttggatgtctctcatcaccccacactggacttctctgccttagggtttctggagtggaaaagttggggaagcactcgtgtagttgcaagtcctgggccatctgggccttttccactctcccagctatatgtggtgaaaaggaattgcttaactatgtaaactggcgtgggagagttggcgctatgctctgtttgtacagctgctcctggggctccggctccgctatctttcacggcccagaggtacccatgaaaagacaaaggaagggtttccagaggctggaggaggtgagaacttggccgaggacgtgggttgttttctgagttcctgtgaccattgatggtcagtcttttaaaagaaaatgtatatttatttttaaaaatggtaatacatgttgaatttccatggttcaaaatttaaaaattgccagagggtttgcaattgaaaacttccttctgctgttttccacatagccccagtttcctgcctcatagtcagtcattgttaccagtttctcatgtagccaactaaaaacatctttatccctcttaccttctttttatacacacagaagcatgctatatctactaatctgtcccatgcttcttcctcactttcttgttctttttttctcccagatgcacaagatactattgacctgatgtaatttatttaactagtacctaattggcctttagtagtgtgcaatcttttgctattaaggtactgcagtgaataatctcatttatatgtcattttgcacacatatgggataaaatgatagacgataagtttctgggtcaaaagaaatgtacattgtaattttgatggatactaccaaattgccatccaggagcctcgtaccagtttctagccccaccagcaatcgatgagaatacgtttcctcacattacacatactgtgttatcaaaccttttgatgtggctgcctcatagctgaaaaaataaccttggtgtaatttttagtgatgatccaatcttgaaaaatgatagaaaatggcacagttgttacttttgcctttgtggtgatgaatctggtgcggtgttttcaactttttggagtggcagaggaatcgactacctgtacaagtgagtaatagctaaaatattgaaatgcaaatccatgtaattcttttaaaacaagacatcacgtaggtggtaagatacggacaaatgaattattaaaaactgtgtgctttttggttttatttatgatggtgcttcctctctaatattgttataacatataggacttgggatcagagaatcgtagaaacataatgccagcaacttcaatgactttagcagtacttgtccccagggaacttccacttgagttgctctttaccagctctgtcttggtgcagttctgctgcctttgccacatccatgagacacaaagtctcatctggaaagatgatacatagatccaagcatcagatcacttcagagttgggagaactttgaaggtcctctctgccatgtttcttttcttcactgggaggtcatggagaagaacttacatgtagtacttgccttgaacaaaaggttaggatttttatttttatttttgattccattactactgcaagtgaattaggtatggtttcaggaaaggaaagtttgttctatgggctttatataaaaggtgagctggccatgtgggggtgtgggggcatgaaaatgggagaggacttttgggaagatttgctaacataggctcatgttaaattatttgtaagcataatgtgaagacatagagaaaaacatagtatcgctttacaaataatcaaaaaaggactaagtgtctcaatacacacaaggtctcctagagtcatactcagcccatgccactgaaagttaagattggaataaatccctgccagccataagctgagtgaagaacttgcatgccaagttctaaacatcacaattcagtccaggttcccttatctaacacgctagggtgctagttaggccccaatccaggttaaatcaggtctggttttcagtatcctcattcttcctgagatttccgggtgaatgaaagggtgctgaccacacatctaagtgttctttgctttactgaaagctttgggcagatggtcttgagcctcttcttcccctctctaacacctcagcaaacctccagaccacgggggtaaatgcatcatctctctccaccatccctactccagccccaggtttcctgtaacttttgtttaccctttttttttttaaacagctgtattaagatataattcatatagcatataattcatataattcaactattgaaattgtacagttcagtggttttagtattcacacagttgtacaaccatcaccacagtcaatgttagaacattttcctaacccctaaaaagaaattccatcgccattagcagtcactcctggccccttccccatatccctccctgtacctccctgtagcagcccagggcaatcactaatctattttctgtctccgtagatttgctattccagactttcatataaatgtcaatatgggtgtgtgtgtgtgtgtgtgtgtgtgtgtgtgtgtgtgtgtgtttgtgtgattggcttctttaggataatatgttcaaagttcatccatgttgtggtgtgtgtcagtatttcattcctttgaatggccaaataatattccattctatggatatgccacattttgtttacccattcactgtttgatggacatgtagattgcttgcacttattggatactgtgaataatgctgctataaacattcatgtacaagtttttctgtgaatatatgttttttcttttttttgagatggagtctcactcttgtcgcccagcctggagtgcaatggtgtgatcttggctcactgcaacctctgcctcctgggttcaagcgattctcctgcctcagcctcctgagtagctgggattacaggcacctgctaccatgcctggctaattttttgtatttttagtaaagatgcggtttcaccatgttggccaggctggtctcaaactcctgacctcaggtgatctgcccgcctcggcctcccaaagtgctgggattacaggcttgagtcactgtgcccggtcccttgtttttatttctcttagctatatagcaaggagtgaaattgctaggtcctaccgtaactctgtgtaacattttgaggaactggcaaactgttttccaaagtagctgcaccattttacattcctaccagcaatgtataagtggtctaattcctctaaactctccccaatacttgttattatctttcttttttattatagctatcctagtggatgtggagtggtatctcattatggttttaatttgcatttccctaatgactaatgatgttgaatatgttttcatatgcatgttggattttatatactgttcggatcctttccccattgtttatttatttattttttgagatggagtcttgctctgtcacccaagttggagtgcagtggtcccatctcggctcactgcaatctctgcctcccgagttcaaacaattctctcgcctcagcatcccaattagctgggattacaggtgtgcaccaccacacctggctgatttttgtatttttagtagagatggggttttatcatgttggccaggctggtcttgaacttctgaccacaagtgatccgcctgcctgggcctcttaaagtgcagagactatgacgtaacccaccgcacctggccccatttttaagtctttttgttactgagttaaagaatcatttatatattctggatatgagtccttcattagatatatgacttttatttcctttcattctggtcgttgtcttttgactttcttggtggcatcatttgcagcacaaaagttttaaattttgaagaagcttaatttatctgttcgttcttttgtcacttgtacttttggtgttgtagctaagtagcctttgcctaacccaaggtcacaaatacttgtttctgtgttttaagagttttatagttttagatcctacatttgggcctatgatccattttgagttaacttttgtgtatggtatgaggaagatgtctaacttcatttctttttcatgtggatatccagttgtagtggcaccatttgttgaaggctattctttcccccattgaattgtcttggcacccttgttgaaaagcagttggctatacatgtaggggtttatgtctgaactcccaattctgtttcattgatttatatgccttccctcatgccagtactgccctgtcttgataactgtaactttgtctcacatgttaataggagagttagggcagaagtgggcaatctagactttttctttccctggtctgaccagttactagattctttagatccttcctcaagttttcaaccacactttatttctcctctgtatatttttgtgacatgtcctcttgctggtttcattaggagacgatatcctgatagacctgagaagtctcagctgtctgacaccttagttttctcctagcaacgccagctaacttcattctaactcagttgcttggctccgatgggctttctctgttgtatagaattaaacctttgggccatgaaaggatgctctggttcctgaaattctctaactggttaggttcaggataataagcttactgtactgttaagagaagtaaagatctttccaacaggctatataagtgagcagttctagcagatacttctcccacatggtcggtgatacagcctttaaaagcctaaccttgtcctccctgggcctttcttttatcgcaggcgtctgtagcattgtgttgtaggcatgagatttgctgatattggcatctttgtagtagtggagaaatggaggacaggtaagagatctgcctggagaggtggaatgtggggcaggaccatttcccatcacttcaaattgctaaaccgaagaatacaaagcccctgtgacctctggaatcaacaataaccaccctgagattgtcattcctttctgttgtggattgtgtgcagcatacctagagcttacactgtgaactgtatcctaatttaagctaatttaaatttctgttttatattggacatgaaaaaaatctgtactccgaagctgcccttcctcaagagcttctattaaagaccctgggccgggtgtggtggctcacacctgtaatcccagcactttgggaggccgaggcagacagatgatgagctcaggagatcgagaccatcctggctaacatggtgaaaccccgtctctactaaaaatataaaaaaattagccaggcgtggtggcgggcgcctgtagtcccagctactcgggaggctgaagcaggagaatggtgtgaacccaggaggcggagcttgcagtgagccgacatcgcgccactgcactccagcctgggggacagagcgagactctgtctcaaaaaaaaaaaaaaaaaaaaaaagaaagaaaaagagaccctgcccatgcaaatggggcagggaagtggacatgtcagaaagcgagggttatgaggacaggttctggattcagcctgcccgaatgcagttcctcctaagtgatcttggacaagttacttaaactatccaagtgtcagtttcctcatatttaagatggcgataagaatagcacccgccttctggaattgttaaaaggtcgaaatcccgtgtaaagatcttaacacaggcaagggttggcaaactttttctatgaagagccagagagtcaacattttaggctttgtgacaccataggctttggggtttctgttgcaaccactcggccctgctgttgtagcttgaaagcagccacagacagtctgcaaatggaagggcgtggctatgttccaataacactgcgcttttcaaaacaggtgaggggctgggtttggcctgcaggctgtcgtttgccgacccctggctcagcacagggcctggctaagtgggcacaatgggtttttcataaatgccagccattcttccagcctggggacagctccttgacatcagtctccttgttcatttgctttgtgtttttaacagaatgtcgaggtcttggcgagcaggagcaacacttcagagcaagaccaggcggggactgaaatgcgcgtgaagcttctgcaggaggagaatgagaagctgcagggaagaagcgaagagctggagcggagagttgctcagcttcaaaggcagatcgaggacctgaaaggcgatgaagccaaggcgaaggaaacgctgaagaagtacgaggtgaggctcgctgggcccaggcccagctttggcagctgctgctccttctttcctgtgtaagtgatttcaaaagtggggaagggatttattgtcatgatgtagtaggaaaggtcaaggcaatagtgaatacatcctctctgcaagccatttctttgttcccctgggagtggcatgacagggaggccagggaacagggacggtgaggtcaggcgggaacacaggtctaggcacaggaatccccacacacccagataccagacatacccagccttccatggcttcacacaggcatccacctgaaagggctgtcttaacaccaccattagaccgattctcactcaagactatttattcttttttaactcattgttgatgtttttgaagtgacactgattttaacaagccaattatctggttggccagacctctagcagtgggaagctgtgactgagagatggcacactctcagcagtaggaaagggcagctgacaatgaaagaggagacacacgtggtcactgccttagtctgtcctgtgctgctatcatggaataccaccctggggtaattaaggaaaaatagaaatgtatttctcacagttctggaggctgagaagtctaatattaaggtgccagcctctagcgagggccgtccttctgtgttgaagtgtgaatggcatcacatggcagaagggcagaggtggagtggggaactgactggccagagggggccacacttgtccattgaccaggaacctactcctgtgatgacagtttgagcccattcataagggcagagccctcatggcctcatcaccccctaaaggtcccaccttttcatatcattacaatggcaattaaactttcaacacatgctttttgggggacacattcaaagcatagcagtcatccatcaggaccacctggataccttttataaaactgtgtgtgtgggggtccattcaatacctactgttttcagatctccaggaataaggccagatatttctattaaaaaaaaaaaaaaataccccagctgggcatggtggctcatgcctgtaattccagctacttgggaggctgagaggtgggagggaggatcacttgagcccaggagttcatgaccagccagagcaatatagtgagaccctgtctctaaaaaaataaaaaataaaaaatcacccgagataatgtggatgttcacacctgcctgagaactggaactgcagataaacacacgcatccaagaacacggctgttgtgtgccaccttgggtctgtgacaggtgcattgtgaccatagccactgccatatctatgggtgtcttcggtgttcatttaattccattgagtcagtttcataggtacagcacacatctaagtgcacactgacccagtgtttcattgtagggagaaatacgacagttagaggaggcccttgtgcacgccagaaaggaagaaaaagaagctgtgtcagccagaagggccctggagaatgaactggaggctgctcaggtaaacaccaagggctgttgtcattactccctcaagaagaatgcatagagacgcaacaccagagggatgtgtggagattgtccttggccctctctttccatgtagctccctttcacccataataaccactcagttatttgaactatccgtctagaccagcgattctcaactgggggggatttggtaatgcctgaagacaattttggttgtcacaactggagagatgctactggcgcctcgtgggtggaaaacagggatagggatgctgttaaacatcctatgaagcacaggacagcccccactgcaaagaatgatcaggccccaaatgtcagtaatgcgaaggcggagagccctccgtttagacgttaaagagcttgacagctttccaaagataaaatatgagtggtgtgagaaggccggcaggactggcctccgaggcggtgtggagtctgctttctggcagaagccaatttcctttctcctgtgggcaaatgcactctatagagtacattccttcaggatggctattcagagaggcaggaggaagtcatttccttgaaactggatagctatcgctattcaaaatcagtaggttcttagaaaattagattttcccatttgaagtacattctcaagaaaggcctgtactgccgttctgattgactttgcacagtgacctccgggtgatgcaggtgtgtccttctcctattggctctcgggatgctgcttaagtatctcaggtgagtttctgaggaggtagaagccagtgtttttgagagttgtctaagaggaaggttgttaaagttttccattccggacccacttgtagtcagggataggtgaagtgggggcattaaaagtgttaagagccgagtcaggttcagatttgtaaatgccttgttgcagctttcctggagggtgttcagcttcatctcctagagtatagaggagaggaaggattcccacaggtcagcctagcttggggactctcccccaaaatcagaagcctgtgccttctcctactcttgggacaaaactcgtgtttgcgtatagtaaagtcccaatttttcctgagttcaatgtctgactgccttcactttggattttttttatttctttaaatctagatcttcattacaaaatcttgtggggttgattttgtgtggatggcacttttgctgtgctgctgtttaaagcttaggttggttactgttacccaacctggctgccagagtgtggggtttaaatttgtgagctggttggggggcagaaagaaaggaaacatatttgtactctatagggataaacatctctaccttcatggtatgtccacaccaagtccccggtgcagctatgggtctctcagaacctttcctttggtcaaacaggaacttttcacacatacggaagtggttcccctgctgggtatctgcgctcatagtgaattcagtgcacagaacaggtgatggccttggggcctgaagatcttaatgtaatccccacccacccccatctgtggatctctagccttgtcttggaaattatccctgacatgttacttttgttgaggcctgttttcccagtggtgtggggatggtgagagtgcttcatgcagtgtgtggccgtgttagccactggcagtgcagctggcaagaattaaaaatgggcctgacagtttcactctctttacctgaattatctggtcttaaaaataatgccatgaaaaaagcaccatcgctctgaaatactttgttttctttaaaattggaaaccagatagtcagctccttttgtttggttactctttctatgcacctctcgtccttgaagctgacaactcaaagggaccttagtccttgaggaaagaaaaaagtaactggtgtttttctcagtctttgtgctattggtctattgcatcttcacgtatgataaatagatttctttacatagtagctgaagacgctggtaaatttatgtctgatttaccatgactcagttaaaaagtagcagaggggcataaagatgctgttcttggttagctcaatgccctaccgcttgcttcaggactgtgttgctgtctagggctactggaactgcacttaaggcaaggcatctatgtttctattttaaagtgccttctgcagatggggaagtaaagaagcctttgctggagaaaccacagttctttccttcaggaggggataacagtgcatacattattcctagggctttccctcccaccccattggacttttgagtattgagacaaccaaggaaaaagggcccaaggcttgcactgttgcagcccacagacactgagtggcagggactccaagaagaccaacttccttctggttaagctgcccattccttgacacccataggctcacctgcaacttgtttgtcattaatatgagccaattgggacctcaatcatagggtaaaatctgcgtctgttgacagataatggtccctgagctcaaggacactcaccctacatctacccgtgttgcgcctcagattctccaacctgatatattttccctaaattttcatctcattattcactgatgagcttgtattcctggcctcggaaatagagtctctgtagctacagagcgtttcactcctgatactgtccacatgaagggtcggaaaaatgcaaagttgccatgtttgctttttttcatgtgaatttgggacgttttctcagcagtgacctattggaacatatgtcttgaattatggaggaggaagaccgttgttctaaacagtgtttctaaaccttagtacatgttagaattatctggggagctttcaaatgcaaatgattatgggccccatgctaagaaaaattgtgattccatcagaaaaagctagaatctatattttaagtacagacaccccatccttgcttggtgattctaacataagaagccttgggatcacttttggggataggcattcatttttaatagctaagtgtttatcatatgcctaatagtgaacatacccagatagacagaaagtctctcccttgcctttacggagcttactaccttgcaaaagaggcaagcatataagaaataatttaaaaataatgtagcaaatctattcttctaggcaatgtgtgtgtgctggggtggcaggtgttggcaggccctaggcccagagtggtgagtctgtggtgtcttttgtggttcaggagaaagagccaggcagccctgcctgagccaagagtggagcagaaatgcatgcacgaaccacatggaggctgagtagagctgggttggcttgtctgctgcctggagcccttgggattggggtctaagaggaggagaaaggctgggggattcctttggggagggggttgagttggatcctgaaggttctacaggaagccattgggggccctctgtatttgttgttttcacagattgacgttttttgggacatgtgttttgagggttttgtcccataccatacctcactggttctataactcctcctcaccctttgccccaacactgctaaatcatcgatcaacagaaaccccaggtttgaccctgcttctggtgggtgcccagcagcagctgtgctggagcacactactgctaattcccccccacactgaacttctgattacctttctttttgccaccatcttttccccagcagcttttgttaaccttggttctctgcagcaattaacttcagcaggtcggccacgttggctgcttctcaaagtgcagccagcccaacagagcccagggaccggaaggccgctatgggtcgtgttttagccccacatcacatggttggcagagcagatctgttcctatgctctgcaaaccaggagagtccgaagtgatttggaatgttttcaagatcctgagttactgcctgtggcagcagcttgtaaactgttaagcactgtacaaatataaaccattgttcttgtgcagtcactgcagggacacaagactgggtaggccctgagctgtttctgtagtggcccagtcagccctcggtgcctgacaacgttttcgagatgatccagtctgtgtttgagtcaggttgctctgttccgagttgtgcgtcttcttattatccttgtacctatggccctaatgcttagccatttaaagaagccaccataactttcctataatattttaggattttattctggagttgcatgttgtttacataaagaacataagtctgtgtgactttgtgagatgagagcctcaggggaactaaggggagtattgcactcaagatagttgtattttatggtaggcactagtatttggtgctgattcaatcaacaaccacctacctggctagtattttatctgagtagtgtctcttccatttaacaccttctgttcatcaagttcaccaacctgtgtgtttccaaattcctttttgcctgtgtctgagtccaattcatggattttgttgatgacaactgcctttacccaaatggacctttgttctgtggggtagtgttctcttagcgattcatttttagttattctaactgtaagaaccatctgcatagcatagtaaatactggaacattaggtgtgatgctgtgtgtcacaggatataaattgccaagtaggtttagattgttgtaatgtataacttgacctcgaatttcaagcatgaacattcaggttttcagacaccatcctgaattcccaccaccagcagccttggccatgtatttctgtagcacgttgtttgtctgccccttcattcctgtggatgtttttgggtaagtcaactttcctatttggtccttgaatttcagaaccaacaatgcccttctatctctgacagctttattttgatcttcttcctcatcacggatttaacagatctgattgctttgcagtgtgactatgaagttccctgtgccacccgttcctgtggctacctggttagtaggtgacagcactgtcctttccctgccatttgcagggaaatctgagtcagactacccaggagcagaagcagttgtctgagaagctcaaagaggagagtgagcagaaggagcagctaagaaggttgaagaacgagatggagaatgagcggtggcacctgggcaaaaccattgagaaactgcagaaggaggtgaggggctggaggaggaaagaggaagtagggccagatgtctttgttggacccagtcccctctgagggtctggtgaaagcctgggaaacctgcagtaggtctaagcacaaaagtgtcagggatttgcagatcccaagaggcagctctttggatttgttgaaaagatagacactggtctagaaaacattaatgccagtaccctctggattctgggcaccagaatcacctcttaacagttagtagaagaaggctgtgtgtcagtgcagatggaaccaatgttgagtgaatcagaatcgacatctctgtgcagagtctctacctttgcatctctattgcttgtccaggagtgtgaaaggcagcttcagagctcagtagctgctgctctttctctttatgtctgccccaccatacccagaaggggtaaaggcacaaagctggcaggctttctgtattctgggagttgacacgagtgtctgctgttttctgacatgtattatgtaccaggcactttactaactattttgtttctaactagaattttatctgtatctgctgataaaattttatctgtatctgtggatactaattctgacaacaaccctgtaaggtagatatgatttcggtgtttccagtgtggacatggccagggcccagagaggttaacgacgtgccccagtcatgtactggtaagtggcacagcagccctaggaccctgaggctgtgtgcctggctccaaaggacgtgcctgctcactcctccatgctgcttccaagtcacaggtgcccacacctggctgactcaggatcaggtgctgggccatctttgagggggccatagaagaaagggagaagaggagatgtgctgtgtgttgaaatgggacccagaccctggtctcagagcatcccagggtgggctcacacccgtgtcacttcttctagatggcagacattgttgaggcctcccgtacctcaaccctggagctccagaaccagctggatgagtataaggagaaaaaccgcagggagctcgcagaaatgcaaagacagttgaaggagaaaacgctggaggcagaaaagtcccgactgacagccatgaaaatgcaggatgaggtaatgcctggccagataagttcttcctttatcccttattcaaagtatcctttgccctgaaagtcttctgtgagggacttgggggtagattcgtgagacagctttggtgcttgactcttcattcttcaccttctggatgggttccgtgggcaaatggcattctggagcacaaaggacccaccggcggactgtgaggctaaatggacacagctttaacctgaccattttcttgatgaatctataattttttgcctaaaatgtttagctgccatttatggagcagccatgatgtgcccagctgtgtccagatgatttatttatatgctttcatgttttaatttaatcctagaatagggattacagtaactgactgttttttggccattgatttttgaaaatacagacttttattggcatgagggtggcggacaagagtttcacaacaacaataatggcgagtaaaagaaatcctcaggaatttatgagtattgaaatgattaaaacattcgttttatatttaagaataattgagcaaagaaacccaaatgctagctcccttcaggcttggcctctcaagaactgagaaaaagaaaggggatgtttttgattgttttaatggaaagccggaggcttcaaaatgtaagcacagcctatgctgatttctagctatacctcttgccaactgggtcaccttgagcaacttaaccccagttttctgagcatatgtttctacctctttaaaaatataccaaatattagtgacttaattaaatgagttaatatgtgagactgtgtagcagcgagtctgtacatcccggacacttcataaatattaatttccttttctttaattttaggggcttatttttcatgaacagtgccgagagcaccaagattccacaggaaaacatttttttctttaaaaaacaaactttaatttctttgatgatcaaagaaaagtcacccatgagtcagtgctgaaactgtgtaaaagaacaatagatatttattgcaggcttctagaacactcttgaaaggcccctgataatggatcccctttggctcagggttatgtgatacaggactccaagtaagcagtgaaattagcgcactgacatcacagttctctttggtattaaaaaaaaaaaaatcacattcattactacagcacagaggcagaaggattcaggtatctgccagaacaccaacaagcacctggtctgatttgacttcagaagatcacagtgtcacaatgacccctgaaaagtacttcccgttgcgttttatataatgatttttatgatagaatccttgggttggaaagaaacatagagatcctctagttagataaggaaactgaggtccagagagactagttaaggccagatggagaccagtattgtttataaaagagcagtccttccaaaacaaaaaaaaaaaaggattccttgcaaggaaaataaagatggcccttcctggatttttctcactgatgcagccctgtgagacactgtttccatgtgagcaacagacatggacacctcatcattctgcagggaaactgcagtgagataccacccttgactaagttggtagagtgatggagttgtttaaaacaaaagtgaattaacaagccaaggtctctctggatccttaaaaaactcaggctcaactctgttcactgcccctctgcttgtgttttgattgagctggttgaagatcttggttaaaaaaaaaccccaaaagctacaggagtccgttctaagtgctgtaatagtggctgcctttgctttgagagaaataggcatttttcacccattctacctctgataagcatgatctttagagaatcgagacttagtgattaccattgttcagtttattttctacatctcttttagcaaagggtgattttaactacttaaaggtagcactaggaagttcaaaagttgtttgcttgcttatgattcaggatacattgttcacagacaccatgctagttaatctcttctgccggccctcgtcaaggactctgagtatgatggggcccttaccgggtgttaggagggacctgctgggtgtggaaggtggggctgtgctgagcagtggaggagggcacgctgggcattgggaagggggacaggaaggaaacgcaggctgcacatttgcctgtcattctttctgaccctcacactcatgttctttctgggtatcatctcatttgattctcataatagctttagaaggctgattttataattatcccaattttgtgaatgaggaaactgagtcatagagcgtttttgttttttgtttttttaacgctctggaatatagcacatcctctgtatccagaaaatgtcccatcactgttttccatggggtgattttcattctgtgctttcatgtactttctgtcatggtaaccactaaaaccagatgtgggtcttcatctggagatgtcatcttcaaggctaggctgttctcttagaaatgcccagtgctcctgtcagcctcccagagaagaacacatttcctcaagcttttccacgggttctccaaagctgtcctcaactactggggctttccaactcttctgtgccagacactgcagaagggtggcattctgtagcggagatggccattcactttcatatactctgaaggaaacagaccccctggtgtattattctattcatgagactagctctactcaatactagtaccaactccaagagggtaggacacttagaacaaagcagacagcctgcggcttcaccagatcagcccacacagatgtttaaggaagacctactgtgccctgagctggctggtctccccagggagcttctagagaagttcaagacactgactggcccttgtgaatcaagctgttttgtctgttgcgctttcttcaaagctgttagttgagtgccaccttgtggatggaaaaaacaacaacattataaattaagctagctaatcatgttcttctacaaagcagtggctttccctaatgtgcctgtgtatgttgttaggttttttgccagtaggttgctttgcggtcattaattcagttgtgtgttctttttcactgagttgaaacctcttttgaggtgacagtgatacaggtagacaataaattaccccctgggaaacatgtatttagttaaggggctctcgagaggttttaacatgacctagtaaaaacgacattttgcattcagctgagcacggtggctcatgcctgcaatcccaatactttgggagactgaggcgggcatcacctgagttgagaagttcgagaccagcctggccaccatggtgaagctccatctgtactaaaaatacaaaaattagctcagtgtggtggcatgcacctgtaatcccagctacttgggaggctgaggcaggagaattgtttgaactcaggagatggaggctgcagttagccaagatcgcaccactgcacaccagcctgggcaacaaagcaagactccatctcaaaaaaaaaagacaaaaaaaaactatatcttgcaacccaggaatacacgcatctgcacaaatatatgaatgtctagcacaaaagatttgcaaatcaatatttgctaatactctgctatttttttctgttctatttaattaaaaaatgctggtcaatatctaccaaatagaatttgtaacctaataggttgctgcctgtagctggaaaacctcctctttttacaaaaaggaaagtaaggcccagagggaggtaggacttgctcaaggtcttctgatctcccatattgtgggagtccagctgatcttccttttggtggggtcagcctgtgcactgtctgtggaggtctctatgctcttgatgcaccccagaaaaccatcccagctgtctctcctcctagatgcgtctgatggaggaagagttacgggactaccagagagctcaggatgaagcactcacaaaaaggcagcttctggagcagacgctgaaggacctggagtatgagctggaagccaagagtcacctcaaagatgaccgcagcaggctggtcaagcagatggaggtctgtgggccgtacagtgtgagctgggggacctgcagagagcgaggctgggccacgagagaagcagcctctttgctctcagctcagcctttgggaagtcttggatttttattctctcccacagctgggtgtagtgaggttatttcttgattgaaggaaggggccagtcatttatagactcaggacatcagagctagaaggaatgatggatataaattagtctaacattctcattgtcttgagaggaaatggaacagattctcagggacattaggtgattttgcctaagggcacagatagttccttttctgtttgttctttggggcagtgcttccagctaactagaaggaaccagactgctgcatgtccagagaggagcctcctaggaatcatcattcttcatttgccacaccacattctccattcttgcttcctgtttctggcccattttcccttagaggttattgggctttgccagagctcgcagcacactgtggctcaatttactgtggtatacatagtatgtacatagtccaagacagcatatcagaaagtgctgaatgcactcaccagatgggggtgatctagtcacaagctgaaaacaccacatattagaaaaatgtaaatgaagtaacagaatctaagtgtgaacagttcactgaggttgacaagaagaaccttagaatcactccatctgaacttttaaaaaagaataattcttaggagcaaaactaacccccagaaacacacacacacacacacacacacacacacacacacacacacacacacacgccccagtagaatttagagagagggagagacactgaaaaaatggaattgagagagacactaaaaaatagtctcagtcttttcagagaagttaaaattgtcaaagttttgataaaagacagtgctcaaggccatggagagatggcttaaattcaaaatcaatggaattcctgattcaactttgcaaataaacagaaataattttcaaaacgtccaggggacttagtagctgtttatatctagggagtgttgtttaagtcattgaagattttattagatgggcctcttttagagactagaataacctgattacagttttattgctcttttgttggactgctgtacattttgctaatgtcctggctctgatctctttaggggaggtaattctaaggcaagctaaggtcaacccacttaactagaaactgattattctagggccttaaacaacctggctcaaaacaagctaaagccccttcaggcagtggaggaagaacctttggagtaatggccctggccggcacccttaacactcctgctgggttctgtgcagtatggcttttaggcaagaagacagtcttataaagaggtgcttttagctggtgattgggttgttaggtcatttccactgctatatcctgactaaagagatcgtttcctttggccgacttaggtctagaaggagtggcatagctaagcttcatttgcccctttgcaatatttagctattttctcattaattacaaaatgaatggctctgaagaccctgctaccatgagatgcgcttgaggggtgtttcgtcccctaagaggcggcaagcaggaccgtcttgctgtgactacgtcttgcctgctccttcactagcacttaaattaattttcaagactcaagagctctcctaacgacggacattttctgtaaactcaggtggctgttgtatgtaaatgcagctcttgtggatcctgagtgatgtctgactatagtgagactggtcttggaggcatcaggaaccactgaataaacaggaggcttcggtgcagggcccagctccaatccaagttggccttagagatgcttggctcctgggtgagggttttctaacttccctataggttttgatcactacctgggggccgttcacagacagtcactcactcacaagaatcctgggtgttttattgtgataaatagaataatatttagggatagaggtgcccattgcttgtcaatccactttggcaattgcagagacaatatttatatacaaatgctgcaggttcacatttaaaacttggaatgccaattgctttttagcatttgtggctctgagtttacttagacctatgacagattggctggtgacaggagaaacacgtgctcaaggctgacaacccccagttgtaagtggggtggtttgtgttagaagcctcttttcttcatacacaaagctgctttgaaatgtttttctctgaacactcaattaggttagattaggagccaacaaagaaaccaccaattattattctgaagtgatgatgagtttaacagaattggttagcactgtcttttggttaatccaatgcaggtttgggagtgcatcgtgcaaatgcatgctgttccttagaaggcttagaaggctgctgtagattgactcctgcaaggctcttgcagacaaaagattgtccggagcgtcaagtgttttttccacattgtcttttaacaggcactggcttgggtagatctgtttaaagttattgattcacagggagaaacagagacttgacagaaacatgctcaaatatccttagtgtttgcattagggtttgggataatgttttttcttcttttatgtgttttctacataaacattttatgttacacattttacattacaagtcatgaaacacatagtttaagaaatatctgctttgggcaatgtaagaaatagatatattgtttttccaaactctaatggtagttagctctcatttgcccttaggattgtttctctgtgggggagcctttgctgttaatcccggtcagtgcaagttaagtcaactgtgtttgtgatttccttcttaggacaaggtgtctcaactggagatggaactggaagaagagagaaacaactcagatttgctgtctgagaggatcagtaggagcagggaacaggtactattctataggtgaatgatgcgtggattgtcctgtgtgaaaaaggaacatgaggggttaatcctggggcttcagttaagtccaggagagaaaaattcatgccatctagaaattgatggaagattgaatagtcatcaccatagtgagcttctaggagagactttgaccagattacttgtattttagattttaaattttactccttggtcagattatttcctgatctatacctagcatcatttcaaggtttttaggttttgatttcatctttttcattaagaaagtgccaatgctagtcaagaaagagtgaagggctttctaaatgttgatatacagttcgtctagcaccatttccaggctctaggcgtacaactgggtaagttgtcattaaaagcacattctatcattagaagtttctacatgtatccacaggtgtcttgtaaatgaagggctgagactagtgaatacaaattaattatctttgaaactgctgctgagtgttctgaatcctcttcccaaaatgcttccatattttatctgtcaagtggtttgggcatgcactggggacacagaaactagttaacagtacctctgtttcctcgtgatctcactgctctccccagatctcacttgccactcccagtctatctcaaagcccctctgaaccttcacttaattaaaaaatggaaacagaggtcaaaagcctttggataatactgcatgtattatctgcacttcgcttgagaaattagttccgtcatctataacacgagcataactctccccgattgtctcacagtgttgtcataaggatcaaatgtaagtgaaactccttccaaaactgcaaaaagcattcacttggaaagtactgttattgaacgtgaatgcttcataggtgtgtgtactgctaattaacttgtcaaggaaaaggctgcatcgtagagcctactttctgttgcacctaacatggtgctggctaccacattccacacacttgcttgttgaactaatgacccttagagcctcagccctaaaaggcacttttccctctatggccaatagattgttattcataaccacttgggaaacttccactttctgccttatgtttttgtcttctttttcaaatcttccctattccaaagggcactttcctctggtctcttctgcttattcacatggacttccctttcctcggttcagggtgaccaagaattggaagttccagagcttggggatagcaccttatgagcaggcagccctgctcaaagtagaacgtgaatccctggctgcttttccgtattcttttaggtccctgttgatagatttctttgcaaacaagtgggatactcatgctcctttgctcctgagagtgaagaaagttgcaacccagctgtgttccctccaccctcctcatggagagtgggttctgtctgcgtgttcccaggctatgatttatctggagctgcaacagcttatcaggccagagctgcacaggtttagagagggaccttcctgaaaatcagaggcccagatagagagctcaaccttgacatctcctctactgcccgccagggttgttactgaagactttgttttctaagttctctcactggaataaaagctgttttgtgatgagcccctgccagcctggctaagtagcgacgttccccccagacatgtcaggatccgctaaacattcacaatgacaaaggatgtgaccatggatttgttttgccagcgcttcttgtggcttatgctaagaggaatagtgggaaagcctgtcatcctatcagtaatgaggccgttacaacagaccttcagttccatgtttatatcagaaacaaaacacagacattgaaccagaacgtgtctgcttcccttagctcagctgacagcccaacactgacagaactgatcatgcagagatctggtcccagaattgctctggacacttctttttcctttcaactgagcacttggatcatggggaatagaactgctgtccatgatgtggtcaaggctaaaaatatttccactaagccaagaacttgatgtcagtttaggggggaagttaagggaaccaaggacttgaagtaagtccagggaggaagttaagggaactcacttggtctgctggggagagcagtgggctggcagtcccagtcctggctcctgcattagcctcatttacctctgggagagtcccagcctctctgagctcagtctctaaaatctatcaaaaggaagtcattgatccaggtgatctctgaaggctcttctgaattctaacattgcaatgctgcaagaaggtttcatacatccagaagcgtctgactcaccctttactttcccccaattctctccctgtatctgagttacatgcctaaaaagatgagttccaccaatgtctataacctctttccctaccagctctctttccctcttctgttttctttcttctcactgcatcatctgagatagggagggtatagcctggtgtttgttataagtggagaaattgagcacattcacatggacgtaggaattggtaagccaatgaaacagaaacgctgatgtctcctgattgtgttctgagagcttctcttctggcctttgctgcctcctgacttgtgagggagggcagagaaatgggtgggccaaatacccgcctccctggaaagcatctcattctcattcaaagttgaggttgagccaaggcttatttcctgcctcttgaaatgaaggctctctggggagggccttgggtatagacagatgggccctgattctgagctcttctggtccacttagattaacttctagggccgtgtgcctgtgctttcctgctgaaatcaaagccagaaaagggaaacttcaaaacgtaaggccgcttttcctctcccccatcaaatgctgaccttatgacatctccttaacaaggacatctcctaaaaacaggaaagggtgcttgttatcttgaacccaagtaataacatcggccctgccttcctagcaaactgctactaggcactgaaaagagaatgcatgggatattttagtttggtgatcttgttctctttaaattaaaaggttcaaacttaacagctttctccttaaactctgaattctcacaagctcctttgcggaatctttgcttcccccaaacatctcccactagtcttagtgatgggacttaagtgaataagccacaaaaaaggttttccagcaatattagtgaatggccaacccctctcatagactgttagatctggcaaggacctcagagtccaactctccccacttcactgtaatggatgagagatttgaggcccagagtcacctggtgatttgaccacagtcatgcaggcaattgactgcagagctgggcttaggtctcaatttccaaggcagtgctctatctacccgtgcctgcaaaatatgatgaatacctgctgtgtgcatggcattgcagtaaagctccaagaggaccagaaatggtccctgaccttgagttgctacagtttgtttgaggagatgggtcagacctaaaaaattgataactaacaatagaaaacagtggatactaaatgccaagtaaaagattcaagcagctaatgagggaaagaccattgttgcaagagtgagtgtggaagaattactggaaagagggtggggacctggggtcagctctaaagaaagggtaagacgtgaataaaccaaggggattgggaatgggattctagatagaaggaatggtgtgaacaaagactgggaggtagggacctatacagcattttgaggagcaatgaatggatgaatggatgagtgtgggtcaatcagatttccagtttccataggaaatgaaaggagataagtttgaagaggcagactgagggtgttgaatggctctattgtgaaggcagtgggcagccatcgaaggcgattgagcacaatagtgaagcatacactgtgttctagaagactcatgcgccaggggtgggggtgaggactggagaaggggcgactgagaggaggcctcaactgtgctgttaccagggcagaggacaaggaaggctgtgtaagatggtgtatttgaccctttccatgcctccattctttctttctcttatgcatacatttggcactcactaaatgctggccatgttgtttataagttcccagcctgtattagttcgttctcacactgctataaggacatacctgagactggataatttatagaggaaagaggtttaatggactcacagttcagcatggctggggaggcctcacaatcatggcagaaggcaaaggaggagcaaaggcatgtcttacatggcggcaggcaaaagagtgtgtgtaggggaactgccctttataaaaccattagatctcatgagacttattcactattatgagaacagcacaggaaaaacctacccccgtgattcagttacctcccactgggtccctcccacaacacgtggggattatgggagctataattcaagatgagatttgggtgaggacacagccaaaccatatcacagcctttctaagggcttcctttacatgctcaggacaatattattcagagtgatggattcaggaaatcctaattgagagagaaacgtttttcaaacctcttggatgtttggactttgttttcaagtctgactgctatgaaggagaagggatggatttggagttgataaaatgatatcttctttatgaaatagaagtaaggagtatctgttttctcacccaagtatagtcccatcatatacagaaaggtttctgattggcttataagttgaaagaagttgaagttgctggcgtttggtctgtttaaatccagagtaatcctttttcctttccgtcctccaaaaaccatgtttccatttatgacaattgccatccttaccaatgattccctaagtgctaggcactgtgctgggtgcctcactcactttcttgttgttttcagggctttcaaggtgaagtgactacatagggtcacacagtttgtaggaggtggagtcacagtttgactccaaagcctcttgcctattcccatcgtccctgaatgagactatgtcatggtcttaaagaccactccttcaaatgcatttgggtctccattcccaagttaaaagtggtgtttcttaaaatgggtgaggagttaagttcagctgatcctctcctgattctttatgagtgcaggattcaaatagccaaagagaggtccggcttcatatgctttaaattaaaggccaataggctgttgtgctggctcgataagcactgctgcaaatgcttcacagcagagctgggcctacatgggaaggcgttctcttggctatggagaccatgatgacccagcccagtggagagatgactcatcaagcccaggcagctggcaggcaggaaaaataccaactcgagctttgggtggcttcatggtctctccagggactgagcaaggctgccttgttgcctcggcaactgcaggattaaatgccagtgatagagttgtgggctcctacagtcactttcgggaactgctcctcagtcagcatcaggggtgccacccctgctaaatgggaccgtcgtctttgcagttgtgagtgaaagatcagaggggggttttcttcttctttttttttttaattgaaatgctcctaatctcagaactgccttttattgtatcagctgctcaaaaacccagtgtgtacagttgattaataacaattttccttttttgtggttattatttttaatgccagccaggagtgtgggcttgccgacctctttacagcccaatgataaacacaggtgatggggttcagtattgttattggccatcacaaatagctctggctttccattaacccaaaaggcagctacttacaattctgagagctggctcaggtcatgggtatctctgacataaaacccactggaatctgatactgtgatttctgatcaaaatgctcagggcttagcattctttcaatccagctgtgatatacttttgccttcagctcctgttctgtttttaatttgactggaaagtttttgtttgtgctatttaatgtagttgaagggtaaacaacatagaaagcactaagcttatataaagaaatactttcccagccttgagtttactcttctctggtccaggaggctggctcagccaagccataggtttttccctcctccccgccaccccccgccccagggcaggtgccagtgtgggctcagggtaagaatttgatttacgatattcccaagtcaaggggcctagtcctgggatcactgcactgaggacagctaacagcagggacacataggatacttctgggtttatgttgaaacccatccttcttggggcattgtccataataccacatagtatttcttgtataaggctccacatggtggatttactttagaatttcatgtcaggctgtcctttgaagaacaaaaggaagcctattatgtttgccaaaagcctgggtttgcaaagactgaaggaaatggactgcctgctcaggtcacagtaactgttaagttttatggctacacatttattccttcctgttcttcactctgatttattttacatttccattttaatagccatcttttaaggggctatggtgggggataaataattcctttttttgcccccctttggagagtcaccattatcctggggctctccaggggccctccagggaggtcttgaacctgtggggacccttggggatgctgccatgctaagtgctgctctgcacagggaagtctgtttcctggtgggatccagatttttcagacattggcactgagggtgcaagactgtggccagtggctgctgctttatgtggcaggatttgtcctgaacccccaggctgggcccagggctgcgtgaccacttggccatcctggaatccctccatgcgctctctgcactctgcctcactccaccatagacacgttctccttctgggctccacagtcccggtctaaactctccttgtgggtcttcttcctttattgagagtcctaggtcctacaggtttgcgaagacacaacggggaggggaaaaaagagtgtatgagtttttgtcagaaaacctaggttggaatcccaaagctgcttccacctaactctgactcagaagctgtttctggacctcccacctggaaactcagggtgataacatctgcctcggagagttcccgcccagcgcccagcttgaggggctcttgattcttggtgtttcccctctgggtctcctggccgggagcacagctgcagagcgatgcctgcctctgctctgctggccgtttattgtcttctggtatttttcaggcgcacactccacagcaactagatttctttgtctctctacaagccttcagtttttctttatcccttcacttttcggaaaataatctaccttccgtccctttcttgcctctaccttccctttgagctacaggctcctgccttccaccaagccctggaggatcctcttcctctccccacccacattctgaccccaagacagggctggatcctgtccctccacttgctgggtggctgctctcctgtgacactcccttctcgatgtccactggttgtgacttttctctcctctgtggcttctcattgacacctaacaataggtgtgggcatttcttgcacaccctcgtgccccctccagccctgggtcatagctgctgtcttagtcgctgctggattccagaggagaagtgtggtgtctattcccacctcttcacctccagcgcctcctctgagctttgcagtcaggctcacctctctgcagacccttccagaagcaaacttggttcttgtccagcctgtgtgctttaccggcagtccttgcccttcttgccttttgggatagatcctggattctccctgcctcccctgacatggggggttggaggggatccccagggcacagctgcagatcctccttattctttatatattgctccttggtgggctcacctgttctgtggcttccaccggcatcgcccagttggccccacatgcatcaccaggaggaatctaagcacagatggggatgttaacactgcctacctcattggtggtggccaggagtaaatgagataatactattcaaatccgcaggacttgctttcctaagcacaataaatctgtgagcagctgtcacagtatgattttgggtcctgtgtgactactctctgtcttcctctccacccaatccatcgattgcttaacctgccccctcacctccctcatatggctaattccttccaacactgcccttctctttcttacctcctactctgtgttactggtggtctgcccccttccggttttgaaagctgcattccctaccctgcccattgtattagcctgttctcatgctgctaataaagacatacctgagactgggcaatttataaatgtttagttgactcacagttcagcatagctggggaggccttatgatcatggctgaaggtgaatgagaagcacagtcatgtcttacatggcggcaggcaaaagagaccatgtgcaggggaatttccctttataaagccatcagatctcatgagaattattcactgtcacaagaacagcatgggaaagacccgcccccgtgattcagttacctcccactgggtccctcccatgacactggggattgtgggaactacaatttaagatgagatttgggtggggactcaggcaaaccatattacccttttttctaccctgtctatccctgatctcatttaggtttcagcttactgtctgtgtcctggaagcttttgctggccctctgaatctgggcagtcacccagtgcacccaccccagcacactgtcctttcctgtcatagtgacactgacctcttatgcagggctcgttcatttgtcccccactaggctatatggagagcgggcactttctgggtctctttgtcacaatgtcctgcataagacacatcatgtcgtttgaacagcgaacaaacccatcctatcgttctgagactacccttgcccagcacacaagcgtgtgcactcgcagacacatgcttgctctcattatgacaatgtgggttttccccaggggaaactcctaatggttgagagacggggtggctgctctgcctaaggatggaggcaggcgcctctggcttcctcagaagggtgccacacagtaccctgaagggtagaggaggcaccaggttgtgcttttattgtatcattggccagctcgggggcccttacagcgtgtctcattcaatcaagttccttgcttaggagcctgtatcccagaagttagatcaacaaggtcacaggtgagggacagacagagccagcaggacaagttaggccactgctgtttttctctgtaattgtttcccattgcagtggaaatttaaccatgtcctcagtgaagtgctgggccctgccctgggcacatgaacagaacggctgcccctgggaggcacgtctgtcctcagtcccgtggcccagctgttctgctgacctccatgtgtgaggtgtcagtggctggttcagaaaccaccttgggagcagggccgtgagcctgcattcattccccttgcactttgtgctggggtaacagtaacagcaattgttctggtgccctctttgcagtgtgtgattcgtgagggccctggggcccagcagagtgggagcgggcctgagttgggtggacgtgccctgcctgctggtcctggccactgctggcatttttcccttctctatgcaagatgccctaaggaggctggactgcccttctgtgcccggatgtttatgctacagctgcatttgaactctaggcctattggaatccttttcacttagatggtccagagacagagccatgaagtaatgggcagtgcaggggctcagcctgtctctagccctgctcctgaggttacttgcataaccgctgccgtaggcctcagtttcctctgctgaacattctgaacctccatgatttagatgcctgccagttaggaattttaaaatgtgagcattttctttggaccacctggtaccccctcacctaggggcagaggcccagcttccccctgtggtgttggaggcctttgtgtcccaaccctgcctgtcccaccagcatcatttagcccccttccccgttgcccactctgggccagtgacatcatgctgtgtgacacacctcggtcaggacaaggggagccagggagcaaatgcaagcctggcccaatgtgggatgtctcctctggccattcctgggaccccagttcttgctctccatgggggacagtgaggaaggggtgagcttatcttttactcactggggtgcttgtacaggtggcgaaattcaacttgaggccaggccaagtaagcctgtgtcagatgctctccaggccctggtgtctggggctgtgtgtgtacctcttagccacgttggatcctggaattcgttttcatccttaagaaggaaaaggtggttttattttactggcttagcttgattcttctggcttcttcaggctgccctctgctggacagttctggcaacagggtctggagcctccgcctcataactcattttactcttgcacaagccactgggaattgggagaagagatgctgatggtcaggcgatgggatttcttccctggtgctacacagcgaggctcctttcctgagcatagaggaaaccctcaggagtgttcagcctttgtcaggtcgtctgatgttgctcagcattcttactgacttttgtttctggcataaaaaaggagaaatctagcagtgtctgagatatgctcatggctctgggaagccgcttctggagtttgagcttataatgcagcagtcaggagcacaggtgaatgctagctcccccattcctcgttatgtacctcttggggaagttgagtgactgactcatcctggttcacctgggactgtcccagttcagcatggaaacagcctgagaacatcctcagtccaggcaaacttagacagtgggtcaccctgcaagttgattgacttttggaagccttagtatcctcagagagatactgttagctccttctgagggttgtttgtgagtgtcataggatcctacctgtggagtctaagcaggtgtgccaattttctagggctgctgtaacaaagtaacacaacctgggtgccttaaaacaacagaaatctattgtctcatggttctggaggccagaaatctgaaatcagagtgttaccagggccatgctgcctctgagaccagtagggaaatgattccttgcctcctcctagcttctggtggtttctggcaatctttggtaatcactggcttgtatacccatcaccccaatcctccatctccacttccctgtgtccatcttcacgtggccgtcttccctgtgtacgtgtttgtctctgcatccaaatttcccccttttaaaggacaccagccatactggattagggcccaccttaataatctcatttttaacttgattacctctctaaagtccccatctccaaataaggtcacggcagaggtactggggattagggcgtcaacatatctttttgaggggacacagttcaacccctaacagcagggctagctttgactcttactgttatttgtattaccagtattgcaatcatcaagaaaccaagaaagaactaagaaacagatcccgtaccccagagcagatggcacgaggggctgggtagggcaacccccttcataaagtggaggttgacattcagttccttgccaccatttcagtacaaaagatacaggaacagtccttctaacctctgggcttttgttctgcttgctgtagatggagcagttgaggaatgagctacttcaggagagagctgcgagacaagacttggagtgcgacaagatttccctggagaggcaggtgagggcagccagcctgtgagctgcccccccgtccatccgctaaccctcccccacttcactgctttgaactagaagcccttggaggtccctcctttacttggcatcccaagaactctggggggtaacagtccttttccagagttgtttttcccggtcatatgaaatctgcatggaagcttggcagctgagggaggaggaattgcatgtgttattttctagatcctgaagagggctaaattctaatgtaaagagaatgaaaaagaatccacgtcatcaaacacatgagtggctcagaaaacttcatcgggtcattatttctttttcatgatttctgttcatgttcttcactgcacaggactggcaaaggagcctatttctcctgtccccctgtaggtttatagggcaaggcaaagcccgtttgacatccgggagtcttaggacatggcaaaggtttcattcaggcttatgagggagtgtgatagaacttcttcttctggcctgcagctgagttcaggggttttccttggaaacatctctgtgttccccaggtctccaggccacaggccctggtgtggaaagcagcctcatcgcatgcagcgaccaaacaccaggttctgccccatattcttcgctgctctgcacagagcgtggcagacacatagcccctcacagtctccctgtgttgttccagaacaaggacttaaagagccggattatccacctggaaggttcctacaggtccagcaaagaggggctggttgtgcagatggaggccaggatcgcggagctggaggaccgcctggagagtgaggagaggtgagccgggcccacccactgcagtgcggaggccccagtgggcagtgacagtcccatcgcaatgtgttgtcacatttgggatctgtcctgatcctcgtagcctgtgaggaaggcagagcaactacacccttacttttattatttccattttataggtgggaaaacagagacccatcaaaataagtgacttgagtaaggtagcctggctggatactggtgtagctgggtaaaagtttaggacccccacttctcagtctatggtggtgccactgtacttgctgtcccttttcccgttctctaaataggacaggctgccttggaagctacagagtttgagccacgttagaggccagaaggctgactctgccctggcggccaggtgtatttaagcagaggctgactagccaccagtcagagatggggcaggtcctcccgcagtgtgtgggagggacatgggatcaagtgagcacactcctttccagcaactcagttctctgcagctaactctctaatggcagcccgagggccagcaccaggttcaacttgagcagccttccagcagtcgttctgactcacagcccctcaccttcctagaaggagcgtggtgtgccggcatttgacactttacattatctattgtgttagttggacttttggggagtcaggccagaacagcctggagtagacccaagacatctgcagtttgtgacttcttgccttacaaagtaaagctcagaaactccgggcaggtcgagccatggctcagccccttgctggctctgaagccttgggccagtcactccccttctcagagccccatttcctcacgtctctcacaagcagctttttctgctgtgaagttgtgtttccctgaccctaagccttgagctgaccaggcacccctggctggagcttcccctcctccacagcctaggctgggccccctgcagggatgggagtgagagggttcttggttctgtctcccctcttccagggatcgggccaatcttcagctcagcaaccggcggctggagcggaaagtgaaggagctggtgatgcaggtggatgatgagcacctgtcattgactgatcagaaggaccaggtggggagcctctgcgtgcatttgctcttagatgagattgcgtgtctcaggctgagggagcaagggaggcaaggcctccctgagcaggagtggagtgtgagtgggctgattcctccctttccacgcacccagtcacatcatcaaatgggggcttcttgcctacgtaattaggggatatcagcaaattctacaccctgagtttggctttaaagagtcaccctgtcttagtgcctgctctccatgtttcccaagagactggctgccccattgcccatgtcttggttgcctggggagatggtggctggacctggggtaagctgagcgctggggctgggccatcagccggcactcagcccacattctctcccggtgcagctgagcttgcgtttgaaagccatgaagcggcaggtggaggaggctgaggaggaaatcgacagactggaaagttctaaaaagaagctgcagagggagctggaggagcagatggacatgaatgagcatctgcaggggcagctcaactccatgaagaaggacttaaggtgggcaggtgtggaggccacagagggccgggtaatctccccacagttgagacaggctctgctttcagagcattcacactcctgttgtctcaagccagctcctcattgttgcttttggggttatcgtatcttagagatgaaggtggctgtgtccactttagtcaccttacatgggcagtagggtctcatgcatgtcattcttataccaatgccccaatgccagctgagctgggtagatatcatccctgttgatcataaggggaaacagaggcttagggcagataagactagctcacaccatcatggaggggcagttcctgggccatcctgggcttttttctgacttagggagaaataaggtgaagttctggtttgtatcctcaagaggactaggattccccaagcctggtttccaggagagagcagctctctgaagctgtctgccgtggtcctaaggatggggacgtggaatgcagggttggggactttgtgggttgctttttctgctctagggtctctccccggggtatgaggtaaggttcatgagattaggttcatggtaatccatagagctgagcctttcttggaggctggctgtgacgtggggctctttgctggctgcccgggtagttctcatcaatggacagaaggctccagcccattgagagtcctgtaaaacagggcctatcaggtcactggccccaaggttggcattagggtgcagcatttaagagggcaccaaaaatctcaataattaagatagataacattttaatgcaatatttaaaagataatgcatgcaatccatggtgaacaagataccaaaattttaaattaagacaagatcaataataacagcctggggaaatcaacaatactgatcctatcccagcctggcccaccccaccagcacaggctttccgtgccgaaatgggggcggtggactccctgtggctgaaggggccatcaggtggagacctgttacattcatgtgtttcttttctgtgccactcagtggggtgcagggacagcaacccaaaaccctccctttaagtccaaattagctatgggccccggcccagggccaggaaacatgccccttgtcatttcagcagactgaagaagctgccgagtaaagtgctggatgacatggatgacgacgatgacctcagcacggatgggggaagcctctatgaggcgcctgtgagctacacattctccaaggacagcaccgtcgccagccagatctgagtgctctcccgggctgtggaagtacctgtcattcctgcaggagctgcagccacccaaagtgggaggcagggaggggagcatctgtctgccactgagaccaatcacagcctctttgcacagcatgccagctcctcagtgttacattcctcgccagggtctctcagtgggtcttcgacagagagcttttgcagtttaaaatgttgggatgcctgaggaccaggagccaccacccactggggtgttgtgagagatacactttggtaggctgaggcccctgttccacagccactatttgcattgctgtccctgccccctcatcactccccctgccaagacaaagggtccagaaggctaggacttacttaatagcactgtgcagggaggaaaccatgtatagcttgtacatattttaaaccagaccttctcacgaactgctgctgttgggtttggaatgtgatggaggcttggtagggtggctggtttgtaaagttcatgcatctatattgagtattctttttttttttttttgagatggagtttcattcttgttgccgaggctggagtgcaatggcgcaaccttggctcactgcaacctctgcctccctggttcaagtgattctcctgcctcatcctcccaagaagctgagattacagatgaccaccaccactcctggctaattttttgtatttagtagagacggggtttcaccatgttggtcaggctggtcttgaactcctgacctcaggtgatccacctgcctcagcctcccaaagtgctgagattacaggcatgagccaccacgcccagccattgagtattcttttttaaaatatgaagctattagattttaagtgttgaggagcagaggtgagaagagagagagagagagaaagtcaaataaagtcaaagaccagtttggaaaccaaagttggaaaagaagaattgtagtggtcatggacagctaagactgagcatagcagttcacatggtctgggtaaacaagtcactggcacaggggaaagccagaaggttgcttgtgtctgtgactgcagctatggccttgtttgcttagtttatctggaattctgttataatttctgaactgttctgagacctgttcccagtcactgattgcaatttcttttacacaggttgggtagggagagttgtaggtaaggccttaaacaaatgaggccgtttctggaaggatagggctgtgtggtcatgtcccacagcaagcttttgggatcgggggaataagagggtatgggggaaaggttcatagacttaggtgtgagaatgaggtgggaggtgtctggtaaggtcatgggggaagggagatgagagaggagataggcagatgtgggtatggggcccagtgtgagaaggaagacagagaagttcttgaaagctgggggatgtgtgggcaagaggtggattgagcaggatctcagggttatgtcgaggaagggaagaaagaaacagaagtcaggcagaggcgtgtctgtgcaaactggaggactccttccaacttcctggaacaaagcgacatcgccagcagcaggctggcagggagtggttgaggtctgggggccaggccacatggctggagaggaatttcagggagcatagcatcgggaggatgctacatatccagggactccctcctggccttcctgtgtcacttcacaatgtgacagtccccaggcatgcccacaggccaggcccagtcacagctgggcttccacaggtcagaatatgggacaggacatggtcagggagaggaccctgtgagttggtgacatatatgtggcagagatggtagtgttcagctgcttcagcagtgtccccaaccatcccaatagggtgggggcctgtgggccagaggactccatgacagtagccatggagtcccacctgtgccaggtcagagcccacccggcaggtttcagagtggtcagcccagtttaagggtgggagtctggagccagacagccaagccccttccacatctacagggtcactgtcatcctcaccacagccaggggtgattctcacctctgcctgcttatgtggggtgtggccgattcctccctttagtcattcattcatttagcacatatttattgggcatcggtgatgtgtcaggcacagtccttggcacacagaatacagcagtgaattaaacaggcaaaaattcctcccctcctggagctcagtgtcaggaaagggggtgataaatgacaatcaaatcgacatggaggttgagcacctctgtactcagccctctgtctgtccttctgaggacgcaacaagcctggttccctagagctcactttgaccctcaatatgttcataatttccctgctgcttctcccatcgttagacatctgccagtaagcctgctgagagaagcctcagcccactcatacctagagacgctgctggggaaggtcagcacacccaagaactttgggagtgtgtgtctgttttggtttgtgagaaagtagctgcccctcattctggccagttctttccagtagccatggggctggctacaagaagcaaaactgcccatgcaaagagaacacaggtcacttttcaaaacacttgcatcattaccctaaaaataggctgttatgcgttttgacaattgcgctatcctacactctgagggagttggcaacgcatgcggtatagtggagtgggaagagttgagactgaaagttaagagaagggttttcaagtcccggctcatctcaccccagtgactttgacagtgtgctcactctcagagccatggattacctggaacaaagtgcagattagtgcccacggtcctttccaggtataacatgctatcgttctttaattttattatatatacatacttttcttctgttttttgctttaagaactaaccccgatcaagagtattttctttagctagcttaaaaagaaaacatatattttatgtaaaaacacatacatggccaaatgcaatactgaagagacaatcatcctgtatcttttatggtttttcctgcttctgagtgtcgttctacaatgcccgttgacttattccattgcgtctctgctttagggtatggtttggtcgctttggttgtcatgagaaagagacattctccttgcagctacctccatgtgagtgaattcctggataaagcaagatttcctttcaataaacgctgtcacccaatgggaattttgactct

SEQ ID NO: 1036 - DNA, 174223 bp, Homo sapiens; identical to SEQ ID NO: 1035

SEQ ID NO: 1037 - DNA, 25745 bp, Homo sapiens
taagataaaatgcattttaatagtttgaagtgccatgaggtgtctgcatggcactgcagcctgggtgagggaggacagggtcatcatacaaagtaggcggccagggctgacatcttgtccttgggccgtctggggttgggcttcccagggggcctcctggcccggccccgccctcgaccctgccttctccctggtccaccgcggtgcatggggtggcaggaggccgcatgcttcagctccaccagctcctggaagacggggtcacaaaagacgcagcccatgtgctgcgtctcatcgcccgggagtggggacttggccttgttgaagtccacatcaagcaaggcggcctcacagacactgcaggtgtcggcggacacccgcacgcggtgggcgttctcgaagcagtgcgctaccacgttgcacttgttgcaggccaccttccacttggggcccgaggtggggtccagcaccagcaccccgctctcacattccacgcactggccgatgcccagcatgctcagcgagtgctggcaggaggggtgcgtacactcgttgcagcccatgcctggcgggagaagggagccctgtaaaggcacgcccactgtgcccacctgccctctgctgcctgctcccaatgcctcaagctcctggatccctcgtcccagcagaaggaactcttcttggccttgctcttggggacagccttgctcatgtttcggctcctggctgccattacccctgttttctgcttacctgaaacctcctcaactttcaaggcccctcgctggcaccatcccagtgggtttcagctgactccatcccccctttgctttgctgccagcttgttactggtaatgccacatgaccctcatgtcactgggccacatggaaccaccctgtcagctactctggcggcagcaggagggcagggatggggtctcactcccggggcagcctgggtgcagactgaggcctgagggagctttctgcagagcacacggtgaatgtgggcagatgcctcactcccgctgattcctggtctggctcggtgctctgtcctgcctgcctggacatgcgctccctcctccagtaatgaggacgaggatgaggatggaggacggtggtggacgctgactgggggtgcccgctcaccgggtgggtcccccgactgctgcatcctcttgctcactcagctccagagggagcactgcacacctgtgcccaggtcctgagggtggactagggttgcctgctcgattctgacacagagagagggtggcaccactggctgaggcctaagcagtgccccagctacatccagggtctctcgtctcagtgccaatgagtgcaggaaaggccagggtgaggggtcccctcagagtccagcctggtgcaaggcaggggttggcactgaaaagagactgcagctacctgtggacaggagggagtggctgcactcacctttcttcatgtctcggaagggtgggtggttgtagcagtaggggcacagcgggtagctcttgccccgagagcctgatgaccacaggaccagctcgaagtcatccagagggcagcggagctccttgtagagcttgatggtgccgttctgggggagcgtgtaggtctcatcgcagtgggagcagtgcaggcggcttggcttggcctgcggcaatgccaggcaggtggcgtgagggtcactggggccaccgacttggcacccacccccactcctctcataatacaaagtatgtaatctgtcatgcagaacctgtgacacactgccaggcaaggagcatgagtctctggctcttgctccacgcgtgcagaaaaggcagttctaaaatctctgtgtgtacattaatgcccatgatggcaagtggcatggtgttagggaaaaatgcaccatgtgtgtttgcgtggcctaatggctgtgtattctaggggacgtggggacactgggtattttttggcaaggcctctttatgttccatcattcttttgtgacaaccaggacaaagaacatgattcctgctgatcaacgataaagctgaggcctacaggggtgaggcagcttgcctgagctagtgttccctgcacctacctggatgtacttcatgaagcggtggcacttcccacagcgtgagaggggcttgcctgtggccgccaggggcgagaaagacacctccatcaactcatccatgcctgcgggcaagcagagtgcaggagtcatctccctcccagtccccagcaaaaggctccgcaacacgtggtcaagggtctgagtgtgaaagggtccctataggcggtggtttctactgtcctggcagcacggcagggcagcagccctgtgcgtcagaggcacgtgttcctggccatgtgtggtgttaatgcacctgctctttcaacccagccaggaggtgtcactgacctggcctacggaggcctgaagcccagatctgggagctggtcccacgtggggacctgggtccccaggtactggccttgctgacagagagacacccctctggtgaggggcaggccagaggcagactctaccagcaatggagtcgacaaagtagtggaacttcctcttgaacacgtccagggtgtggcccaggacctggcggtagtcggccttgccctgggcgatcaggttcagctgcttctccactgcactgcggatggtggggagcaccagctctgcatctgcaagtgggcagggggcagatattgccctgagcactcgcacccagggccatgccaccccttcccaggcagggatactgccctgttcacccctcccgctctggcccgtcctcctggcctctgccctacccaccagtccacagcctcagatggtaccaggctggctcttatgaccccagacctttcctgatttcccacctggaaatgtcaggcagagtggccagggatgtcctgtggctagaaccacatcacacatgagctccaggccgcccttgggccagttttgtgctcctccctctccccttggcccctggggaacctccagggaacagggctgaggcaacttcgcctccctttttggttccctcacacatctgttcagccttcaaacacactgagctcctgctctgggcaggtcctgggggtcctggggcagcaccccttcagcgggtgttgagggagtgtgtgtggggctgggggatcactgtagggcaggggcctgtctggagcgggcagcagagccaacatccagggagaagccagggagcctcggtgggccctgggggcaggactgaggaactcaccaatcttatagtagccgtgcaccaggacgatgccgaggttggtgggcttgagccggcgcccgctctccaccgtgacatagttgcgctggcagatgttgttgatatgcacagggatgctggcatccgtgcctgcaatgtacaaggccccagggttcctggcctgccttggacatgccccactgaaccatgtgctgtatcacctgtcacggggcccctggtgctcaggccctctcactgctcccggtcacaggagggagggctgtgccctgagctccccctgcactgtgctgggcaccaactgcatgcatttcatgttctgccttgagaacacaagggcagccctccctgtacagggcgcctactcctgctttatggcagagacaacaggctcggaggttaaggaactctccaaggtcacagtgcttattctgcgcctggaaaatgtgacttctatggcttctcctgcctgggtcctgtggcacccacctgctcccggagccagagccccactccaccagaacacggaggtgcttacaagctcactgcagagctgccctcccctaaacctggacaattctgtccacttcctgtctcccacctcctccctctctgcaaggcccgtcacgatccccaggggaggctcccagtccccaggattccactctcccacccagaggaagtttcctggcagaggggcgcagcggaggctgaggcgttttgactatggcgggtgccagtcagaggggcagaaaggaggctggggctccctgcatgctcaccagcatggacaggtgacacacaccttcccaaagtagctcggagagaatctcacatgggaagaaactggcctctgggggctaaggagcctgccgagggcccatggctcttggcacgaggccagctctgcacccggtgtggcaggctgtgggtggcgtgtgccactaccaccccgagtctgccgggcgccatgacgcgtggtgtgggctcctctgtggcggctctggtcaggcccttttgacacactcctgggggctcagtcacagggccaccctgaccactctcctgttcagaaggtaacaccagagccctcttcactgtcacaaacttgtattggtgattgggtctggctcactggctagcatagggctgccaggagccagtgtcccatcaatgcgagagggcagaggacacgggggagcagagcccacactccacagtgggctgagggctatttcaggaccctggcaggtgccctggacccctgagaggagcaagcccagagctctgctctcctgccaagatcgccatggtcaccaggaccccagcctgggaagagacactccctgagagtccacctatatgaccactgctggagcagagcctggacacagtggctgtgacatcccacaggtctccagagcctgtcagccaggggtagtgccccagggaacaggcagtgcccagcggcgcgagtgccacctggggagaaggctccggcagtgaggctggcccccaacatgtgagacatctcacagctccaggcctggggacttgtgaggccaccactcctgtgaggagtgtgcactggtgactacacttttgctttgataaactccctgggctgcccatttttgcgtggaaacttcctggtcaccctttggggagccctgtgcctgggacaggcatttctgttctctcccagggaagcagctcctgtgagatctcatttccctgtcacctgatttcaggacagcccaggctggctgtgtggactcaggggactgccaatatgatttctatgagtcacctggcatctgggccaatcttcagccttgtgggcgttagtcggtgtgtgcacaccccacagtgcacgagggcacatctgggccttcacagggaaggccaggtcctgaatggaggcctcaggaggggatgcccgctgtggacctgcctggctggccacacactgggtcaccagtttccagataccagcccatggaggggtgctgggctgggcacacagggctggcggggcagctttgtgagtagactcgaagcctgagtactggagacggagccggctctggggcctgggcaggcgcacccaccgatgccatgcttctccatgagcgtgatgagctcggcctccgtcaggtagtcgggtgggttcgtctgcttctccagcatcttcacctcgcccacagggaaggcatcaccccgctggcaagtgggcaggctctcctccaggggcacgctctgccagggcatgacctccgtgaagcctggagagatatgcgccgccactcagggtccccagcctgggtggccggggcctcagaccctgggcctcccatccccagacacgatgtagaatgtttgtctgcccatgaaggcacagaggaggaaggctgggcccgtggtgtgacctggtgagaggacggtcttcccggagcaggtgaagagctcgggcccaattctgaaggagatggtgctctgcaggtacttgcagtcatggctgaccgtggcgatgaagtgtctggtgatgtactcatagagccgccacgcgtcaccccctgcaacaggccagggctagtcagttgggagccagctgggggctctggccgtgaggagcccccagtactctcgctcgagcagcaagctcctgcttacagagccgctgtgcaggacacactgcaaatcctggggaaggaggaaagaaaatgtgcaggaaggccgggcgtggtggctcatgcctgtaatcctagcactctgggaggctaaggtggatggatcacttgaggtcaggagtttgagaccagcctggccaacatggtgaaaccccgtctctactaaaaatacaaagaaattagctgggtgtggtggtgggagcctgtaatcccagctactcggggggctgaggcagggtgaactgcttgaacctgggaggcagaggttgcagtgagccgagatcgggccactgcactccagcctgggtgacagaacaagactctgtctcaaaaaaagaaaaaaaaaaagcaaatgcggaggaagggaacacaagcctccatgcctcagtggtttctttctggctgcggctcccaccatcctgcacaacctcctgtccctgcttctggcgggactgctcttcaggcattggcctgtctttccattgtctcgtgacatgacaccattgcttcaaactcagactgtccacaggtggctcctgtctctacctgcactgctctcccttcctcatttgccttctcctggcactcggaccactggtaccaccttaggccagctgggaggtaggaggtgtgctgccccctcccccacaccgccactctctaccctggtttcattcatgtcccctgtggcgtctgcccccttgcctccctgcaacagcacctgctgctacctcttcactcctgtcctggtcccatagcaatggagctcatcttccaggtggccccccatccccacagccagggcaggcagaggctgaaggagcccccacattgccaacagggcctgcaaccttcactgtcgcagctcgcccttccctccctggaagcacaccgggtatgggatgagagcggtacctaattcggcctctgtggcagacttcatgggggtgatggggggatggtcgccggcgtcatggcctttccgcgggcggttgataccttctgctaacaaccgcttcacctgagggagagaagacagagcagagtctgtggctgggctcggctgcctgcctgggtttggctgacgtaccagacctggtcccaaggcctcagtgacacacacacatgctgaggccggcccggctccactcaccgtgtcggcccagtaggggtggttggcctgctgccgcagagagcccttcaggtcaaagttctcagggtagtgggtggtctctgtccgtgggtagctgatgtagccttgcgtgtagagccgctcagccgtctgcatggcgtgctgcggccccatgcctgcgagagacaggaggttctcagagggccaggtacgtggggatggccagctgcctgccctggcctatgcactcaggctcccccattgtggccggcccctcctggagggtgacggtggctctgagcaggcacagctggagtgcaaagctgctggccgggtgggcacctatgccacacagtcttgtatgaggctgaatcccgcacccgtaaggctgaatcctacacccaggatgggcctgatgggaaacgccactcactctaccccacggtgcatcctcatggggctcatggccatggggatgacacatggccttcagagcaccactccccatgcattgtccatggagccataaccatacctcggggttggctgacgacagagttagcacgcagccccattttgagcccttgggtgtttctgtcctcacagcactttggggccactcaggggggctcgtcctgctactccctgaccagcagaggcaggcgcttagctagcaaccactcccagcattgctgccctctgaggacgctggagccaccactcagtgtccactgagaggacactgcccatagttccctgcgggggtggggggcaccaatgcctaggggctgacagctgccagagaccaccagctttccagcccaaccccctcctcgttactaaggagaaaagactgaggagatgaggctgaggggcgacgttcacactggttccctgaaggtgacatctggctggggcctctcccctcaccagggatagctgctcagggactctaacatcaggaggtcccctcaggtggtgaccaactttaccacctttacaacctaaggataagtgaaatcctcctgaggctcagatccccttgaagccttgggcaccatcctgcaaccctgggcactcgctgctccaggctgaacctgcctcaggaagccttctggtgacttgagagaaatgtccctacatacccagagaagagctggccacacgcagcatctccacagtgttcagggccaggggcctctgcttggccttttctttcctgcttgtggcctccacctggaagacaggacagtcaatgatttggggaaggaggaagacaccaccatagagggaatcaagatgtgtggacgaagggtctggtttcattcatctggtctccctgtttctccaattcattcttcccaacagtctaaagacttgattgaatatttattcaggaccaggaaaggaaaaagaatgaaaattcttttttaaaaaaaaattttggctgggtgtggtggctcacgcctgtaatcccagtactttgggaggctgaggcgggtggatcacctgaggtcaggagttcgagaccagcttgaccaagatggtgaaaccccgtctctactaaaaatacaaacattagctgggcatggtggaacgtgcctgtaatccaagctactcgtgacgctgaggcagaattgcttgaacctgggaggtgaaggttgcagtgagctgagaccacgccattgtaatccagcctgggtgacagagcaagactccatctcaaaacaaacaaacaaacaaacaaaaaaccaaattttgttttttttaagagacagggtcctgctctgtcgcccaggctggagtgcagtggcaccatcagagcttactgtagccctgaactcctgggacaagtgatcctcctgcctcagcctcctgtgtagctgaaaccacaggcacacaccatcatgtctgaccaattttttttttcaatttcttgtacagacagggtcttgctatgttgcccaggctagtcttaaatgaactcctggcctcaagtaatcctctcgcctcagcttctcaaagtgctaggattacaggcacgtgccaccatgcccgtctactttttaaattatttttttcagagacagggtctccctgtgttgtccaggctggtctcaaactcctggcctcaagtgattgaatattcttttctggagaattttctagggaaagagaaaacctggaagattgaggaggagtcagaagggctgcagatggaaatcctacagaagccagcatcagccaagctacagggatggcaagtggggcccgtcccaggggaagtaccactccttgttgtggggagggctgctgcctgcacctgctagtattgctacctcttctgatttttcaagagaagctagaaggcagaattttagtatgaaatctcgtaatttttaagtgctggtaactattctggaatttgtgtaaacaccatgcaggttagtggagtgcatctatgagctgtgctttgttggggtcctgccactctctacctctgctgaacacttgtcggaagagacaactctttgttttgcctatggcaaaaacaatccaaacaactcaaccccaggccctggcccttgccaatcccacgtaggctggtcagggcagtgccttctgcattccagacagacagatgtgggtgctaacagaggccagttgttatgtgaagctgggctccccagcgtgaggcctggaggtggcaacagtgtctctgcaggaatgtgatcaatgctgacagcctggagcagctttagaagtttcagatgcctgagacgatagcatggcgggcaacagggcactcaaggaaggccagagaaggacaaggagaaggcggctaaggaggccaggctgtgtctcgacggatctggtagctgtcatgcctgtagcatgtttacttcaatagccacagatgtgtccccaacccatgcagccaggtcacctcaccgttttcctaacagccaagcagcatgtcctttcaattcatagaagccctgagtaagaaacataatcccataaaagcacgcaagctgattgcaattggaatctcaagactttcccctgctagctgtgaccttgggcaagttcatcagtgtgcaccaaggtccctctacagttgttagtttgaatctctgtgtgaaatggagtcctgccacacggaggtaatgcctagcgggtcacgtggaaaggggagagtggaaggggtccgacaaggtcacaggtgtggacagtgcctggtatggagcgggcatgcagtacactgtgactattgcactgggcagaaatatcttaggagtatatgagggagtaaccattcagctttccaaaaagatgtctgtgtttcagaaagggggagaaagacgtggactaggatcacaggctgttcctccagcgggaggcatccaagggccaccctcacccaaggcaactgtgatagatgtgggtggagcaggcacacctgggcttccttctccagctttgtcatgtttaaaaacatctgtgcgatctcccggtcaaacactcttactcggtcccagtccaaaaggagagatctgtctttgtcagtgttaacctgcaggaaaaaggataaagggtgaacgcacaagaaaaagtctccaggtgagcccaacgccaggaagaaccaggacagatgaagctggtccttgtctgggagccaaatagccctggctgtaatggctcacagctgtacctgttcaggtgggcagatacgcaagctgacatctggccctctccaccacttgccccaaaaccaggcagccagtctcaggaaggtggcccaaagctgaggctgatgtgtccctaagaagcacctgagcccctacttctcacaccacccctgcctatccccagtgcctggccagtggtaggtatggccaccgccagggtcccaagccccgtgtcagccacagcagctccaagacagtgtctcactgtgttgctaggctggagtgcagtggcacgatcgtagctcactgtagccttggactcctggcctcaagcaatcctcttgcctcagcctcccaggttgttgggattacagacatcagtcactgtgcctagctgtattaagtcttacagtgagcttctgtggaggcttttatttgaagaaagggttctaggaattttaaaaagtttgaaagccaatggtctcagtccagtgcttggacctgaccactgaagccactgattcctgtggggtgacctcaccctgcactgccagagctgaactcattcccacttatccagattcagcatatacaggcccagtctcttcccactgcccccatgaaggctggggtccctcagccctaggcaccacagaccacttccaggtacagccgtccacacttctgccctcagcccggggcctgccggctgatgatgatggaagactctcagaatccatgccccaaacccagaaagccccagcatgaatagagaaaggcaaggaaccttggcctgcagcacccagtaggtctctggtttgaaggactggattttatcatgtctctccacacagaatcccagggttggagtctgacacggcccaaaggagatgagagagctgtctaaatcaccgtatttcccctggaaatatttagtctgaaacctggagggagtggaaagatattttggtcactgattcactcaagacactattatggccacccatgtgagtccagcccaaggccaggggtggtgcatgaaggaggtggcatcaggtggtgtccccacttagaagccagtgggagcagagtgggcatagccttagggaggattcatgtgtgtacatgggtgacagagccagtgagagaggagacagaggtttctactgtctcaggccagggagccttctattctattccatctactgcacactctcctcaggacccccagagcacagacaaacacactttatcaagcagggcatatgtgatctctgtcagctaaataaacaattttctttaggtctcttttgtttttgtagagacagggtcttgctgtattgcccagcaggagtgcattaatggggattcacagatcattgcagccttgaactcctgggctcaagtgatcctcccacctcagcctcccaagtaactgggactacaggctcacaccaccacacccagctaattaaaacaaaatgtttggacaggcacagtggctcatacctgtaatcccagcattttgggaagctgaggtgggcggatcacctgaggtcaggagttcgagaccagcctggccaacatggtgaaaccccgtctctactaaaagtataaaaattagccgggagtggtggcaggagcctgtaatcccagctagttgggaggctgaggcatgagaatcacttgaacccaggaggcagaggttgcagtgagctgagattgtgccactgcactccagcctggatgacagagtaagactctgtctcaaaaaacaaacaaacaaaaaaataaataaatttttgtttagcctgggcgcagtggctcacatgtgtaatcccagcactttgggaagccaaggtgggcagattgcttgagctcaggagtttgagaccagcctgggcaatacagtaaaaccctgtctctacaaaatgcataaaaattagccaggcatagtggtgcacacctgtagcacctgtagtggaaggctcaggtaggaggatctcttgagcctgggaggcagaggttgcagtgagctgagattgtaccactgcattccagcctaggcaacagaacaagactctgtctcaaaaaaataattttttttttttttttttttgtagagatggggtcttgttatgctgcccaggctggtctcaaactgccaacctcaagcaatcctcctatcctggtctcccaaagtgcagggattacaggtgttagccactgtgcctggccttcttcagggttggtgaaatcccctgttgctcatcctggctcgaggaggcctaggggccccggagggggaccagtagaggcaggtctctggctgagggagagtgagggtgtgcccaggactctgcgggtgtggccagcacctggtgaatgcacagccgattcgcaggtccagctcctggcgagcatccactgagagcgcctcgttgtggtcaggctcgcctaggcaggccatggcattacagatgtctgtgtccgtgatggagctaaacctggcccggaacacggtcttctcgccaccatgggccttgttcatgacgggcagaacagcatcaagaacctgggggtggggagtggccagctgtgacccacctcccagatccctgccacagctccccaccccactgtgaagcctggttccttccaggaaagaacacgtgtgctcggctccctctcctgcccctgccagaccctcctctatcccctttcctgcacctgccagaccctcctctatccccctgcctttccagaagccctgagcactccacaacaccccaccacatggcttcctttactcccatctagaaacatactcgaacactcccttcttactcccgccctctcttctaatcctctgctttcatccccaccaaatcaggaaatgctactgccaagtacatgagggacctcttagtccccaaacccatcccatgtgacacgattccctgccttctaggagggagggtttggaggggtgggtggaaattttaagaggctgaagaaaagacagggaaggaaaaaagaatgaaggggaaaggaaatgggcaagagcaggaaggccacgggtggtcctagcttgtggtgggggcagctcgggctaaagcacagcaggggtcctggagccgagactcactaggaaggccgtgcagtgggactagggtcgccgccggagcctggccacgcagcttccttactgggaataagtggcttcatttctgaagggagaaagccccatgagctgcccccattctccattcccagatgcaaaggcccccagggaggagccgccctgcaggggaggagagggtatctgggaagagacagagtgtgatcgcatttgctgagggtgctgtactgcaacgccaggtgcctcagctctgtctcactgaccagctcttgagccacgggtgagagctgggggtacaggagcacgggggcgacccatagaacaacagtctgaagggcaccaagtgagaccagcagtcatggccactgtgagggcaccatggccggggcaagcatggggcatggggtgtgcacagggagcagctgccacctgcttctctgcagggctcccagggttggctggaggcaggaggcatcctggatgaggcaggagatgagcagagcgaggcctgcaaaaggagctcagtgctgaggtcgggaatcaaccagcatcaacccaaggtccctgagaagtcacgctgggcacaagatgctgaacaccaagctgccccaagacaatcccattctgaaacctgcatccacccagacaatttggcccctcctatgttcactcataccgttgaggcctcagcaagcggaggaacaactgaccacctttaatagagcctatgcagttaaaagtatctgtggagtttcagaataaagggaggggagaggtgtttttaaaccggtacagtttactccctcctttggccccaggagtgatgtgactgactgctggtgtcagtttggggctggtgtcagaaaggccaaaagtgaggaacaaagtgagcctcacactcacctcaaagcagatgttctccccctccttgtcgcagtccagccacagcacgatgtagtcgcagcctctgccctccacctgccacacagcacaggttcacacgtacctgctgcagacccggtctgtgccacccgcccccagtgctcccatccaggacagggcttggtcccaggccctgaacctcagttaggaggactggtacctgggctgggtaaggagctggctgtgttgaggctggctcagccaacagaaaagaattgagtttataattgatgttttttggaccaaaaaaaaaagtataaatgcaacatgatcttataccccaaaactgcccagaagaagggttaaaatgaaataaccctaaatgataacagcagtcgtcttgggtaatatgattatgcataatttttctgtctttctacttatctgcactttctaattttccataatctgtatgcatttgttttaaaattaaggagaaaaaccccccgaccaaacaagctattttaaaagcagaaggcctgctctccaggactgagggttggcaatggcaactgccttgtgtgttgggggtgcctgcaggtgcctcgtgggccagcagggggcactcacagaaaaagctagcaaaggcccccctgtccaagggggattaggactcaagcaagggtgggcaaagacatggcagctgtggagggtggggagccccggtgtgctcatgcccaggccagccccacgcacctgcaggaacttcaccatgttcagcttggggttagcttctttcttctccgtgggagcttggctgaacagttctgcggggtccactttgtcccatttgttgtattttcctacaaaccagtcacagtgacattgagtcacaggagctcagcctccgagaccatcataaccccaggaggatgttggcctcatcccacaaatgaggaggggaaagcttggagaacaatttgcccagggtcatcctgatgatcagaggcagagccaggatgtgggttcaggcctttggtaaccccctcccatccagcctcctttctgctcggctgctgagcggacccaccacaccccggccaaccacaggagccaagcaagctctcggggggctgccactctggcctcacttccgggactttccctgtggctgggagcaccattcctgggctgggtctctttgcctgagcactggaccccacaatggtgccttcattgacacttccaacctgagtttctggaactttgtccttccacccagcactctgtgggggcacacatgtgtgcagtcgttcctgttaaaggaccatctttttgagcctcatgcccagcacattcacctactcatctacagagacccggttcttgcatgctcagctgtctggctttcttttaggccccatttctttttttttctgagacaggggtctcgctctatcacccaggatgaagtacagtgatacgatcacggctaactgcagtctcgacctcccagcctcagtccatcttcccacctcagcctcccaagactacaggtgcgcaccaccatgccagctgatttaaaaagaattttgtttttttttttttttgtagagacaggggtctcactatgttgtccagactagtcttgaactcctgggctcaagcgatcctccccaggccccatttcttgcatcctgggagaatggggtcagacagagccaaattcaaatcccggctccccacctgccagttggagataaaacttggggtccaaatgctcagccacacaactcagtcaccatcattgtcatcactgtcatcaatgagcagcaagaacaagggctgaggctttgctgtgtgtcgggccctgtgctgagtgctttgccctcactgtcacactgaatccttagccttgggaagcagatggcattgctgtgagacccatttcactatgagaagtgtaaactcagaggccgtcattgcccacatccccagccagtgagccggcagagcagggggaaaagcctggatcagactcttgccaaccacatggccccaaacctacacccagcaggtcactaatactggcgcttccaaggtaattgataacagtaacaatataggaatgacaacgacagccaccaaatgaccgacagatgacggtcaacttggcaacagcagcagccttctcttaaatgcctgcacaggtcaagcccttcctaagataggtgctgccactttgtctacataggaaggcacacagggaatgcagcgactaaggggtgccgctatgatggggacccagggctgagttccagagcctgggttctgggcaccgcaccagggaccctctcattgctacttcatgatctgctggccttatgactcatggagttgggacaaacttccctgcctagaggcatctcctggcttcaactggaccctggccagtgccatgcagaactcccttcagtaggatggagggtagaggggcttacccaggaaatccagggtcatcacgtgaccacagacagacgtcatcttgaagcgcactggctggccagcaaaggtcccagtgtactcgtggactgagcaggccccgttcagccctttgtgtgaggacaggctccctggggatgaggaagcacaaagtgactggctgcttcagctgagctgaagaccctgtggagaccccagcccggatgccacctcccagagggccagagtcctccttccccagagtggtgagtgacgacattccgcagactggtgcgggtagttgggcactgagaggtgggacggcgctcagggaaaacagcatctgccaacaacctagcacagagcactctcgatgcagagccccaggctgccgggagccaggagcaggcaggggtgggctctttctctgtatttatgttttcactcttcaattccatttttgcctcacttcattgaaacgttattcatcgtttactaaaacagactccagatctactctcggttaccagggaccttctaattatcgaattctcaccctctccactgaccatactcagctgtactttctcagcttctgggcaccgggcaccacttttggggcaccgtcccctgcggaccatgccttctcagctgaacgagggtctcttcccctctcaactgctggaccaaggggaggccaggtaggtgcctgtcatttctgggtacccagcatctaaaactcttcctatttggagggaattcaaagatagggggaaacagcaccctaccaaccaccccagtggccagagttgggggtgagtggcagacattccctctcgagctccctggtgtctcagtagtgcctgtggccatagctcagtccattggctactctggagtgacgtgaggtccacaggacagtgggagtatccaggggtgacaatgcctggggcatagcctcatcagaccttgactggggtgtagtcctggctgcgtctccttccttccagggctggtttctactacctgtacctaatagccccaccaggcccagcatatggataatgactgtccttcaatttcattgtaaattgtgccttgtgccttatgggaaccccagctttggcacattgccaggagtggaagcaaatgcaccccactgtgacatactgagatgcttcattaccacctgccgacccgaaccaaatctaccccagccagggtggaatcacattaggaaaaaatgtcctgtaacacataaacgaccgtgcttacagaccaaagcagggctggtctctcctacctctagagaggattttggcaattgactgtgccaaggacggcttttcagcaaccatgagcacagtcttcattttgtctcggtccttcacactccagtttcggggcactggcaatgaaaaagtttagactccactcttccgcagcacagcactattaccaatgctgactcctaaagagaagaaaagacactcaggatagcaatgctgtcaatagaacctacaccactacaaggaaaatcactttaacaaagaaaaaacaagaccaacctgaggcaagaagaagaaaaattagggaattagggaaacttgaagacatctgagattaaaaacaagaaaaaactaccaggtcagctgaagtggctgagatgatcctgggaatgtggctccatttgggggaaggtgaagtggccccagtgatctcaggtcaattttattcctaaatccatgctaggaagatgctggggcctggggatctggagtgatgggtcaggccaggtggatgcctggccctcctctctggactggctcttccacctacaggtggactcacctggaaagaggaactatcgtggccgagagcagcacctcccgctcagcaaagcacttggacgccccaggacactttacaaaatgcagatgcccaggctgggccccccaggtccttctgatccatgatgggcctgagaccctctggctagtcggtccagccccaagcagacatcaggactctgtcacatctatctcccacctattccactccaccttttgctttgcaggtcatgctctggccaaattaaatcaaatatcatcatcgaagcaaacacgcacttgaagcctctgtgcctgcgcttccctgcctgagagaaagctccgccaggcctggaggatgcagctggatggcccacaggcccagctcaagtctcccaacaccactggcagggtaagtcagccctcctgtgcccacagctcttgggctaggtctccattccaacccactcacatcatgccatcatcagcgactacttcacccccaaaataggacacgatgggctttgtgtctgaatcactgttggtctttgcaacagctttctgtgcctgacacatgacattcaatacctgctagccaagtaaaagaaaaccacatgaaccctttttgttttttcagtcattataaatgtagcactgatgtttataaacatagcaccgtattaaaaaagaaaaaaaagactcgtattgagacaactgggaaatctgctgtgaaaaaaaataaagttagactcctgcttcctaaatcccactaaaaccgattccagatctagcaaaggtttgagtagaaacaatgaaaccagaaaatattaggaaaaacatgtgcttttaaaataaatctcacaagccaggtgtggtagcacatgcctatagtgtcagccactcaggaggctgaggcaagaggatcgcttgcttgaggccaggaattcaaggctgttgtgtgccatgactgcacctgtggatagaacagccacttcactccagcctaggtgacagcaagaccctgtctcaaaaaaagtaaaagcaaaataaaataatctcagcataaagaaaaactaccacctagatgggcacagtggctcacgcctgtatcccagcactttgggaggctgaggtgggtggaccacttgaggtcaggagttcaagaccagcctggccaacatggcaaaaccccatctctaataaaaatacaaaaattagctgggtgtggtggtgggtgcctataatcccagctgcttgggaggctgaggcatgagaatcgctcgaactcaggaagtggaggttgcagtgagccgagatcatgctattgcactccagcttgtacaacagagcgagactccatctcaaacaaaaaaaaaaaaaaaaaaaaaagggaaaaccaccacgtaagtacctttgtggtatcacatcatgtccaacaacactcgcagaagaaactcagaactacaatgagcttgtgcttatcacatagggagagactcaaagtcgttgcacacacagcagatgagggcatggggaagttaaatgggaacaacctctatgtgcagcaattcagggatccctctcaaagtccgagtgcacatcccagcaattccactccttggaatgaacttaatagtccagttatttattgagtacctactgcatgcttggcctagtccaggatgcagggaatacagcacaaagcaacaccaggtcctgccctcccagaactcatgctgtagtatgggagcaggggagggacagggcagggctgggtgacacctgggagaagagtccaggcagaaggagcagggaaggtgaggtccttggggaggatatggctgggcaggggggctcatggggctgagggagggagcaggggtgtagaatgtgggtctgctctaggggtgctgggaggcagcagagggtttgcataggtgtgggataatctgacttcaagtgttaaagggacctctctggctgccacatagaagaggatgaatgggccctgggtagcagtggtggaggatgcgagggaagtcagaatccaggcagacctgggatggcgggacatgggagggggaggggaaggtgagtcaagaatgacctgaggcagagctgggcatgggctcacacctgccatgggctcacacctataatcctagtgctttgggaggcgaaggcaagaggaccacttgaggccaggagtttgagaagagcctgattaacacaatgagacctcatctttacaaaaaagcaaaaggaacaacccatggctttggcttaggcatgacaggaagggactggcagtctgatgtgggacttcaggtgtgttaaacgggacctgcccattggacagcctgggtggcctggaggaggtggcagcaatgtggaaggagcccaggctgggggtcgggagatgaggagctagcagggtgagtcaggaggggtaaggtcctgaaagccacaggaaagagcacttcagggcagttatcaccatgtgggggacactgacaggccaggcgagatggcagctgagacctgactgtagggtctggcaaacagagccctgggtaatcctgatggggccatgtggtgagtgacagatgaaagctgcatggggtgagctcaacaaaacctgggagatgggagaaggctggtgcactgtcccctcttgtttcaggatggtggctgtgccagcatgttctccgctgatgggactgctctggcgagaaggaaaagagaagctgcgtgccggaggggaaggaactgctgcagtgatggccttgggagggtgaggggcaagagaggcagccggtcagcatccaggcgatgcagagctgccacaaggctgcacttctcttggtggaggaggaggcatggtacggctgtccactgagggaggacaggtggtgatgctgcgggcaggcccacagcagaggaagcactggatttagttagatgggagagtccaggtgagtaggagggagagggagtgggtcagggttcgaggggagagattacaaggacagaacctgactctgagttgggtgaagagggaggtgagggttggggagggtccacagagggtgtgctctgtggggtccaggaagtgaggcacaagagcaggaagtgggagtcaaagaagcaactcccagagggtgggaggctcaaacaggaattacagaggggcctgggtggtggcatgctgacccagggagggcaagggctgtgagacaggtagagagtgaagtcacctggggagactcacaggagtcagtggtgggccctgacaagactgtccatgtggactctgagtccccaggaggtaggacagggcagcgctggagtggcctcaggctgggcacggtggtgcctgtgatgaaccacatcactggggagttctctgcagcattatcaatcatgataaaaggttagaaacaagctggtgtctgtcaacagggaggtggttaaataaaagcatggcattctctggccgggcgcggtggctcacgcctgtaatcccagcactttgggaggccaaggtgggcagatcacgaggtcaggagatcaagaccatcctgactaacgtggtgaaaccccgtctctactaaaaatactaaaaattagctgggcatggtggcaggcgcctgtagtcccagctactcgggaggctgaggcaggagaatggtgtgaacccgggaagcggagaatggtgtgaacccgggaagcggagcttgcagtgagccgagattgcgccactgcactccagcctgggcgacagagtgagactccatctccaaaaaaaaaaaaaaaaaaaaaaagcatggcattctctacagtagagcacctggcagcattacaaaggaaagcatctgcttggtacatactaacgtggatcagatcactgaaataaatcatgctaagaaagctgggcatgtaacggtgtgtagagagcactgccatctgtgatcacacatatgtgtgcacacgtgtgcacttgattatgaagaggcgatatgtctggatggaacgcaaaacaaacagtccaagcaatcacctggagtgggtgttagggcctggaggtcagggctgggggtgcctcctcaccacattcccttttgcaccttttacatttagcgcctggacacaggtgactgagggacaagaactaagacaagggactttacaataaaaccagaaaaataaaggagggttgtaaagggcattgttcagaaaggatgccaaaggaactccctcactaaaggggcttctgctgctcatcatgctgtgcaggggaagaggtccaaggtcggccttgggctgtcaaccttgttccccacttaagagatcacaggactacagtgaaatcagtaatcttgaccagaaagctgtcccaaataaaatgacaatttgcttttttcctcaaaataagtaagtggatgttccccttaaatgtacaaccatcccacagtgaaagagccgaggccttgtggaatgacgacactgtctgcagatgagctctctggcccatgacagctccagctgcatctcccaaggctctgctgcgcacccacctttcctccctgtgcgccagcaggcttcggcctaggccacttttcccccttagtctacttgctctgacccctgcccctcccctcctgaagactgcatctggcgtcagcagtctgtctctcccacaattgtcaggttcattgccatatttctggcacccagcatgcactaaatgcctgctgagggaatgaatgaacaaccaaggtgattatgactggcctctgctctccgttctggggaagttttgattctaccaaaatcagaggcccagaagtgaggtttaaaagagatttagggactccccttctctcaccctgggaagccagaggccaaaagggaaaactcgcagcagaggggcattgttctgtgagggtctgagtttcccatctcttccaaagtaggaaattttgtcctaaaatgtttcctcagattttctcatgtctatgccacagagtagtcagcaattatgtatgacataatgaggacacaccagggaccaggcagtcctgccagcatcctaggcagggatgctaataggtgctgccattttattggcctagactgggactgtggggtcagagagaccagagctccagtggctggacttggttgttctagaacccgtgccccaagcctgatcctgtcctgcctctgtgagcactctgatggaacagcagcccagctttgcttccttgtagcactcatcactacacttggtacagcttccatctacttattcagctcttgtcttacagctcctagaaagtaagtaagcagcaggagaacacgggttttgctttgtgcattctcacggtaaatagacagtgagcaaatactttgcgaggctgaggcaggtggatcacccgaggtcagcagttcaagaccagcctggccaacatggtgaagcctggtctctactaaaaatacaaaaattagctgggcgtggtggcgcatgcctgtaatcccagctactcaggaggctgaggcaggagaatcacttgaacccgggggcggaggttgcagtgagctgagatcgcgccactgcactccagcctgggtgacagagtgagactctgcctgcaacaaaacaaacaaaaaaagaaacaagcagatgtggcctgggagtaggcctagcagtggtctgaatagcattaaaattcctaggatttaccacctcagtaactttaccaaatgcttctagaatcaggaaaagagggaaacaaccatttcttaagctcctcctttgtagtaggcacaccatagctatcaacactattcaatctcgccagcaaccccataaggcaggtgttgtaattttttaaaactgtgagtaaatggaggttcagaacaagtcacactagtgtcaggtgaccttggcaaaagaatcccaggactggctggccatcaagcccaagttaggctggcctctcaggtcctgtttcaaaaggtgagaagataaaaaggcaagactaggaacatcttacctttcacttctgcgagaaattattgcccctggattccagctaatttgttcacaaaagtaccctacttcatttacagataacaggtcagagaacctgggtgccctcaaaacccagccagggcctagggggcggcgagtggaagctgcctgggtgtgtaccgcaccgatctgggccccggtggctgcacagcttccctgagcctcagtttccctacctgtgagactggtacagcagatctcaccctaaagagctgtgggagggttcgaagaagaaaagtattaaccacagcgcctgctccctgcaggcacatggcgggcccatctccacctccctgaacccccacagcaagccccgcgggagagtatcacccccgccagggaagaggcaacaagaatgcagagcccggcccgggcgctctcccgagctcgcgggtcctccgccggccaacgttcaggaaacaagccagaaaaatgcgtgcgcttcccgcctttctgagccgccgggcgagggtcccgcagcccgccgctcacccacagccgcaccgcggatcc

SEQ ID NO: 1038 - DNA, 545838 bp, Homo sapiens
ttggatttaacaaagctgatttctttcctgcaggaattccgaaagcctttgacatatattatatacaatgcgtctccaaaaaaagaaatacaaacagcggttcctaaacatatttggccatggggcccttttgaaattgagtaacctaccaataccttgctgtacagagtttgtgaaatgccaaactagaagtgactatcattgcacttcggatcctatgtcattgatctgttgattctctctggttcccaacagatccataaaaaggaaacggcattcctggtgggaggccagagagatcaaacagtggtggaacagaatgggtacaggagccctaacctgaccctttccttgggaagtccagggcctctttctcctttgtaaactagtctttattcctacaataacctgtgatctgcccttggctgtccaaataagaataatgctctgagtatgagtggcattacaagggcccccctgtttctgtcgtgttctgaaagaccccacttgtcatacagggtctggtttctttcttggcctcaggaccccactagtggccgagtgtgatgggggcctttgcctgcctggtctaagggcgggtcttgagcgtggatggaactagcgtgggcaggtggcgagttcccctggctgggatttttctctttttgtttgtttgcaaaacactgttaaaagattattgcctcctatattgctgaggtctgactacagtgtctgcgtttgatggaggtggggcaaggcctagagggggcctttgcccaaaggtgagccaaacactagtaagaatgtgaaaactagccactcgcagacatctcacttggttatctggcaggtaagcaggcacgtgggtaggcagagggtgtgatgcccatcgctcaggcctgttttgaggaacctggaggctctcaaaggcccacctcacagtcagacaatgctggaatgtcacggtgaaggaaaatgggaacaaatatagataatcggttcctgggtcaaaggcatttagaaagtatgttctcaggccctccattctgttcccatcaggaaccaaggctgagaaggaagatgaggcaggagggggacgagtgtagcagagcactcttcccctcccagcctggatggcgttagtcagagaacaggctggcaaaagacttcctcaggttgcggatggtttcagccttggcctcgtcttcacttggggtcccacgctgggaggtgtcggatgtgctgaggctgttagtcagggactgagatttgctgaaacagaaaggcaagggggttgaggaagacaaggcgaagactatcaaagaaatgggtcttgggggcttgcctgtaagccagatgggctaccccaatcatcataaggttatgaagaccagaaaccaggcattccaatgcttacatgatgtcaggtacattacacacataatttgcaaggtggttattttccccatttcttaggttcagaaataggggttcacagagtcaagtaacttgctccggtcctcacagcaagtaatgggggagcacccagaggccacattctttccattataccagactgttgaggcagcaggcattgctggagagtagcttggctgctctcctgcctatgggtacaaacccactttgtaaactgcaatgtgctgtatcaacatcaggttatagttatttccagcactcgtttaggtatcaggaggcctgtattctagaaccttctctgctctttgatgtgtgtagccttgggcaaggaacttaccttctcagggcttcctttgcctcatctgtagagcgaagggtttgtcctgctgaccctcaggcctcttccagctctgacattctggacttcaattcccatctcttctccaatgtctttatggctaattctgtcccccacccgcttttggaattcttttagtgccatctttttgaatggcagatgccattctgagtgcttcctaaatgccagcctgtagcaactgcttgctgagcacttcccctgtgctaggggacaggggtgtaagacgaatatgattcaggccctgcctcaggaggctcagtcataggaggggaggcaacagacctaggaagagattatgtaaatgtgtcaaaagttgaagagctctgcatgtgatgctgtcatcacattaaaaactgcaccacactgtgctgggcgcagtggctcacgcctgtaatcccagcactttgggaggccgaggcaggcggaccacaaggtcaggagatcgagaccatcctggctaacacggtgaaaccccgtctctactaaaaatacaaaaaattagccgggtgaggtggcgtgcgcctgtagtcccagctacgcgggaggctgaggcaggagaatggcatgaatccttgaggcggagcttgcagtgagccgagatggcgccactgcactctagcctgggcgacagtgagactccatctcaaaaaaaaaaacaaaacaaaaactggggacttcaacgcagggactgtcttttactccttgcttattacccctcagagagtcttatctagaacaaggcacagagtaggtaaattcagtaaatacctgctgacttgaattgaaccaagttctttaaagcagtaagtcaggaaatttatgtgtttttagctagaacactgtaaggtcagtgaccaaacctggtttaaggcccagagcccctgtctgtcctgtgattagttggctgatctccttatgtggtgacaggctgtatgcagataagcctctgtagtggcagcagcattctaagcaccaactgtgcataaactcattgcaatccttataataaccctgtgcggttattgtccccattccacatgtgaggaaattgaagcacagcgaggttaggcaacttatctgaggttgtgtagtttttaagtggtggagctaggatttgaacccaggcagtctgactctagagtctgtgctgtcaactgctattccatattgccaggagggccatttgctagtgtctgtcaaactaaaaatacatttatcctttgatctaacaatatcatgtcaggttattttctctagagtgagtcttgcaactatgaaagtatatgttcagatttattaattgcagcattatttgtaagatcaaaccaagtttctatttgtgatggattagttagataaattatagtacaatggtacagcggaatactatacagccataaaaaataaaattcgaagaaactcggtgctccaggatttttttttttttcgagatggagtcttgctctgtcacccaggctggagtgcagtggcacgatctcagctcactgcaagctccgcctcctgggttcacgccattctcctgcctcagcctccctagcagctgggactacaggcgcacgctgccgcgcctggctaattttttgtatttttaggagagatggggtttcactgtgttagccaggatggtctcgatctcctgaccttgtgatccgcccccctccacctcccaaagtgttgggattacaggcatgagccatcgcatccagcccaggatttattattaaacatgaaaagcagtgagcagaatggtgttgatagtgaatactcctgtgtgtgtgagaaaatgagggcgaggatctgaacaattttattatttatttatgcaaatattttttatttgcataaggaagcactgaaaggacacataggaactaacaaaagtcatttctggggatgggggtagcaaagcgttggatgagaatggggcgggaacgaggcttttcaacatacatctttgatttatttatttatttatttatttatttatttattgagatggagtctcactttgttgcccaggctggagtgcaatggcgccatctcagctcactgcaacctcagcctctcaggttcaagcgattctcctgcctcagcctcctgagtagctgggactacaggcgtgcaccagcacgcccagctaatttttgtatttttagtagagatggggtttcaccatgttggccaggctggtctcaaacccctgacctcaggtgggatccacccaccttggcctcccaaagtgttgggattacaggcatgagccaccacacctggcctgataccttttagatctttgaactatgtgaatatattacctattcaaaaaaatagttgttagcatgatccctggactggatgtcgtgggtctaatcccagctcttctagttattaactggaaactttggcaagttatttaatcttttctttgcttactcgtctgtacaatggggataagaaatagttattaactcctaagcttgtgagaacttaaaaaaaacccaagtaagtaaagtgcttggcacatagtaagtggacaatagctgttagctgtgaactgtgatgatcaacatttggccttgaaagaaggtagagctttccaaagatcagttacttgggacctctctttaggacaaaccaagagatgggcctgagaggaaacaggatgtatatgtgtattgtgatggatggcttacaaaaatgactgcaatgattcctcttgtccctgtagcctgcccttttgagatgtgacttcatggctcctcctaccaaaaatttatttcctacctcttgaatgtgggtttggccctgtgacttgctttgactaaaagcgtgtgataaaataacatttcataactcccaaggctgggcctcaagaggccttgcagcttgtactttctccctttttaaaagcagttctaccatgtaagaaagctcggcttagccttggggaggatgagaccccatggagagaaagaggcccagctgacagctagcaccaacaaccagatgtgtgtgtgaggccttcttggaccatccagcctcagtgaagctgccagatgactgcagtcgtatgagtgatcccaggaaagtagagttgccagatttagcgaataaaaatgtgtagataaatgtgcatttcagataaaaagctaagactttttttttagtgtaagtatattccatgcaatgtttggggcataattatactcacaattatctgttttttatctgaaatgtgaatctaactgggtatcctatgttttattctgtaactctataggagacaccagcagaagaacctcccagctgagctaaactcagaacaaacagctgaaccaaaaaattatgaacaaagagaatgattgttttcttcagccactaagttttggggttgtttgttatgcagcaaacaatagctggtaaatggctggtatgtgtatacacggagggtcacggtggtgtctaatctatactctcaccttgttgggcctccccagcaaattctgtcctctagtcctgtttttacctatttgaagtctaggcaaggcctcgttgggtcttcctttgtctccaagtccctaaccctgaatcagccaagctctgcctacaccccagctctatcctataccttttccaattcccaaagcacttacttgagatgcggatggggtggtgctggcttcttggactcttcaccctgctgggaggtactacggccctgcacagggggccggggctgtgaggcgagggtggcacctggcttggaggcctggtttggggagctgccactggatgcccgggatagctgcggagagcctggtgacctttgctgctgtggagatccggactgggggctcaggggctgctggccttgtggggagagcctctgttgggaggggcttccagatctctggggctgaggagactgagcttggcgagggcctcctaaggggccagaaaaaaaaaggttcagttcaattttttttcttaggatagatatggctgtacacaaataatgttgcttcaaggatgttcattacagtgtttcttataatggtgaaaaactgaaaaccgtataaatacctaaccataaggaagtaattaggaacattaagatacatctgtataatggaatatgctgtggtcatcacataggatgtggctgagtaatactaaatgacacaggatactgttgataacatatgctaaatattatactgctgaacaaaatagcttagaatacagtacttatggttttattttggcacatatgtaaaaacatatataaaaaagcaagactggaagactgtacactaaaaccagtgtgcctcagactttaatgtgcatatgaatcactggggatctggtcaaaataaagattctgatagagtgagtctcgggctgcgttacggactgaattgtgttcaccctgtcccaattcatatgttgaaaccttaaccctaaccctcaatgcaattctatttggagataggatctttaaagaggtaattaaagttaaatgaggtgatacggtggggccctaatctgataggcctggtgtccttataagaggagaaagaaatatcaggagtgtcatgtacccaggtacagaagaaaggacacacgaggatacacaaagaaggctgccatctgcaggccaaggagagaagctgtaccagaaaccaaccctgctagcaccttgatcttgtacctgcagcctccagaactgtgaaaaaaacatctgttgtttaaggcccccccagtctatggcattttgttatcaaggcagcctgagaaaactaatataggcaggatctgcgattctgcatttctaacgggttcccagcttatcctacgttgagtaatgagacactaaataatcattacaaaagtggtgagattaagaaggattttaattctctttttttttttctcacgggtattttccacactgaagatgtatttctttggaaacaacgacaagaattaactcttactttttgagttgctctctaaacttttccaagaactttcaaaagcaacatatcacttgacctagagaggtcagtagggaagataccattcttctcaccacatagaggtggagactgagtcttattaaggtttcccagttggaagaggagccacagaaagctcaaagagaatcttggtttctccctctcaccgtacagggcacacaggcttccacaagcaagccaagaggcatctaagcttggggatgttgtagccacccagaaatgactttgagtagaattccaaggcccccaacaatcaaggtgcactctcctaaccctcaaattctgggtgtcagggctgttgatggtgaattgcattttgccaaagccgactggctgcccgtaggtctcttctccctacgacatgctgctgctgggagagtggggttattcttgccacgtttttttgagagcaccgtaggcacgttaggagactgaaaactaaaaggtgctggaacccatctctgtgactctgtaacaatggggcttctactgagcacctattatgtcaccagctttggactgggcacaacagctctgtgggttaggcattattttcatcccctacccccagccatgggagtgctgtccctggaactctagagagagccacatgtataattacacattttctagtaggcacattttaaaaagtaaaaagaaataggtgaacataattttaatagtgtgtgtgtgcgtgtatataggtatgtatgtatatatataatttttaattaaagagatggggtctctgtcacccagggtagagtgcagtggcatggtcacaccgcagcagtgaacccctgggctgaagccaccctcctgcctcagtctctagagtagctgggactacaggcccaacaccactttttctttctgcctttttttttttgtagagatggggtgtcgctgtgttgcccaggctggtcttgaactcctggcctcaagcaattctcccaccttagcctcccaaagtgctgggattacaggtgtgagccactgtgcttggccccatttttacagagaaactgagacccagatatattgtgacttgcttaagatgtcactacgaataaggggacacgccgagattcaaacctagatctctttgactcaaaaaccctgttttattactttttcctttatgaaaactacaccacgcaggctcgcctgagtcctcataacatctttattgctaattaagaaaaggcggcttccttcagctgaagcagctctgagccagatgccaaaggggcaaggactagatttcagccagcctcccttaccagatgtcacgtcagctgagcacattttcagaggacatgccacctgtataacctccatgacctgtggagtctggtggccctgactccacactggcaccaggagcctcaggtcctgactcaagccttgccattaactcgctgtgtgaccgtgggtaagtcactccccttctctgggcttctgggccctcatttgtaaaataaggtcattggactgaacatcaaacatccctcccgatctgaacatttttgtgagcttgtggaacactaaattggattaaattgcagcatcagtttagcatctgattatattacatggctttgattcattacctctttcatgattgtataggcgagtagatgggaggtcacatttatctcaaacacctctagggccaaccaggtatgtaaataaataaagcaggcaaatataagaaaagtaatgaggctttcaaaaatttgcccacttgagataaaaacagtccagagaactatttctctgaagaggtgcaagcataaagaacatagcaattgcccctctctgtcactatggaagtgaggagtagggctggaggcaaacgcaggagcccctaggagcccttgctctgatcaaggaagccgctgttagtaacgccagggacagttgctgtatagaaacacaggcccattgtttctagagcttctgtgctatcaagagatgctggaaatctagatgtttaagcaacacctcttgattttttttttttttttttttgagacggagtcttgcactattatccgggctagagtgcagtggcgcgatctcggctcactgcaacctcctctgtctcctgggttaagagattctcctgcctcagcctctcaaatagctgggattacaggcgtccgccaccacgcccagctaattttttgtatttttagtagagacagggtttccccatattggccaggctggtctcgaactcctgaccttgtgattcgcccacctcagcctcccaaagtgctgggattacaggtgtgagtcaccgcgcccagctcacctcctgatttttaaatgttggttacttttgggttttctaaacccaccgcagttcaaataaaacatttgttttctacttttatcttcagtttcccctgattcgcctcccttcccaggttgatatcttagaaaatgtgaatacccattcattaattcagtaactctttgttgagtccctatcatatacctgggatttatcaagagagacaccctagttactggattcagagaccagagtgctaaccattaccactgccctagttatttctttcggcttcttggcaaagcaaacaatttagtatttttcatatgagcacatacacaaaatattaacatatatagaaagtatttgcctaagcacagacatgaagcttattaaaagaaaatttcacttttactgagttgaaatgaacagcaagttcaaaataataatgtgatttgttaattggggaactcaatgaaagcgttgtttttcattagccttgttatttttaatctgagcgttaattcactgggcattttctttaattaccttaattggttttaaattgattgtttttcaactcactaaaagtgtgtttagcctcatttcccttaaaataatatctctttatcaagcatgttttactctgggccagagaggaaatcagaatacagtagctctctgttttaaaacggctctgttcaaatgtgcttttaaaaagcaggtcccagggcagaggggaaaggagggtgtggggcagaggcacagccaggagcctggtagagtgaggaatatgtagtttcggaacacttattactatagaattcttgctgggtaacggggcactgcattagttacaaggattgttaataataaacatgaaaagcaatatgtataagacacacgttattaatagtaagcattatgtcatagttattcgtagtaaattattagtagtaagaactgacaccttctacgcactatctctgtgtctgatgccttgctaattgcttcacctgcatttatctcatggacaagcaccccatccttaaacatggaagctgttatttcctcctttacactgaggaaactgaggccccgagaagtaatatgacttgcctaacactgcaaaggcagtgagatacggaactggattcaaacacactagatctgcctgaaggagaatactaatgtgtattttatacaggcataccttgttttattgtggtccattttatttcagtttgcagatactgtgttttttctaaattggagggttgtgacgaccttgcattgagcaagtctgtcaatgctgtccttccaacagcatgtactcatgtggtgtctgtgcctcacatttgacaattgtcacaaatttcaaacttttaaattattattatatctgttatggtgatccgtaatcagtgatctttgatactactattgtattaataattgtttttgggtgccatgaaccacacccatataagacagtgaactggccgggcgtggtggctcatgcctgtaatcccagcactttgggaggccaaggcaggcggatcacaaggtcagcagatcgagaccatcatggccaacatggtgacgtcccttctctactgaaaatacaaaaaaattagctgggtgtggtggcatgcacctgcagtcccagctacccgggaggctgaggcaggagaatcgcttgagcccaggaggcagaggttgcagtgagctgagattgtgcaactgtactccagcctgggcaaaagagctagactccatctcaaaaaacaaacaaacaaacaaacaaaaaaagacagtgaacttacttgataaatgtgtgtgttctggctgccccatttaccagccatttccctatctctcttcctgtccttgggcctccctttcccctagacacaacaatattgaaattggaccagttaagaacccaataatggcctctaaatattcaagtgaaagggaaagtcacacatctcttacttttaaataaaaaaactagaaatgattaagcttagtgaggagggcatgttgaaagccaagacaagctgaaaattaggcctcttgcaccagaaagttagctaagttgtgaatgtgaaggaaaagttcttgaaagaaattaaatgtgccactccagtgaacacacaaatgataagaaatcaaaacagcctcattgctgatacggaaaaatttgagtggtctggaaagaagatcaaaccagacgcaacattgccttaagccaaagcctaatccagagcaaggccctaactactttcaatcctatgaaggctgagagaggtgagaaagctaaagaagaaaagttggaagctagcagaggttggtgggtgaagtctcaggaaagaagccatctccataacaaaaactgcaaggtgaagctgcaagtgctgacgaagaagctgcagcaagttatccagaagaactagcttagattattgatgaaagtggctgtgctaaacaacagattttcagtgtagatggaacagccttctattggaagaagatactatctagggctttcatagctaaagaggagaagtcaatgcctggcttcaaagcttcaaaggataggctgactctcttgttggggctagtgcagccggtgacttagagttgaagccagtgctcattaaccattctggaaatcctagggcccttaagaatgatgctaaatctactctgcctgtgctgtgtaaatggaaaaacaaagcctggataacagcatagtatttccaatatggttcattgaatattttaagcctactgttgagacctagtgttcagaaaaaagattcttttcaaaatattactgctcattgacaatgcatctatccacacaatagttctgatggagatgtacaagataattttgttttcatgccttttaatacatatcacgtcttttagttcatggatcaaggagtaatttaaaatctgaggtcatattattttaaaaatacattttggccaggtgcagtggctcatgcctgtaatcccagcactttgggaggccgaggcgggtggctcacaaggtaaggagttcaagaccagcctggacaacatggtgaaactccatctctactaaaaatacaaaaattagctgggcatggtggcgcgtgcctgtaatcccagctacttgagaggctgaggcaggagaactgcttgaaccaggacccgcgaggtggagcttgcggtcagccgagattgcaccactgaactccagcttgggctatagagcgagactctgtctcaaaaaaaaaatttttttcataaagctatagttgccatagacagtgattcctctgatggatcttggcaaaggaaattgaaaaccttctggaaatgatttacctttctagatgccattaataatatttgggattcataggaggagatcaaaatagcaacattaacaggagtttggaagttgattcccatccttatggatgactgtgaggggttcaaaacttcagtggaggaagtaagtgaagatgtcgtggaaatagcaagagaactaaaataagaagtgaagcctgaagatgtgatggaattactgcagcctcgtgataaaacttgaattgatgaggagctgcttcttatggataagctaataaagtgacttcttgagatgtaatctactcctgataaagatgctatgaaggggccgggcgcagtggctcatgcctgtaatcccagcactttgggaggctgaggcgggcggatcacgaggtcgggagatcgagaccagcctggcaaacacggtgaaaccccgtctctactaaaaaatatacaaaaaattagccgggagtgttggtgggcacctgtagtcccagctactcgggaggctgaggcaggagaatggcatgaacccgggaaagcggagtttgcagtgagcggagatcacgccatagcactccagcctgggcgacaaggagactccgtctcaaaaaaaaaaaaaaaaatgctatgaagattgatgaaaagacaacaaaaggatttagaatattacgtaaacttagttgataaagcagcagcaggttttgcgaggactgacttcaagtttgaaagaagttctactatgggtaaaatgctatcacacagcatcacgtactgcagagaaatcttgtgtgaaagggtgagtcaatgcatgcagctaacttcactgttgccttatttttataaattgcctcagtcaccccttgcttcaacaaccagtaccctgatcagtaagcagccatcagtattgaggcaagaccctccatcagcagaaaggttactattcacctagggctcagacgattgttagtaataaagtattttatcattaaggtatgtactttgtttttttcagacataatgctattgtacttaagagactacagtgtagtgtaaacatagcttttatatgcaccaaaaaatttgtgtgactccctttattctgatatttactatatactggggtggtcttgaaccgaaccagcaatatctctgaggtatgtctgtacacagttgtgtacaattatacaatttcccttttcttaaaaatatctcctgcttttccagaaggagaaacacaaacaagaaaaatgaatgggacattttatctaagacctgtggaagaggaagccatttggtggccaaggttgactttttttcacaaagtaatgaatctgttgcttttaataatagtgactgggaaggccacaacatgatagtaatgccttctttctgatatatatatataatttatttattttattttgtttttttgagatggaatctccctctatcgcccagggtggagtgcagtggcgcaatctcggctcactgcaacctccgcctcctgggttcaagcgattctcctgcctcagcctcccgagtagctgggattacaggtgcacaccaccaccacatctggctagtttttttgtatttttagtactgatggggtttcaccatattggctaggctggtctcgaactcctgacctcgtgatccgcccgcctcggcctcccaaagtgctgggattacaggcctgagctaccgcgcccggcctctgataggtttttaagaagatccttaaaagattgcagcgagactgcctgctttggtttcttggtgcacaggtgctctgaagctccatgctggtgccagagcgagtgtgcccaggaggttttgattgcaagagaggatacggggcggatttctctcaagactgcatgcaagaatatcagagcagctgatattctttgagaaagttagttagccattgccctgattgcttttcatctttttacaatagtttgtccattctctaataagtggtggaatgtagtaatgctggaatatatttgaggaggaatttcaatggccaaggttttatagatgatcttccctttttctatctttcttactctagctggtcgactcacaaatctatcatcaggcaccactcattgaaatgaataaacacttcctaggtttgaaaggtctgaaaggccagacttgtaaatctaccattttctgcctccttgggcaaagcctcaacttttacctcgcagtagaaaggctcacgcctgtaatcccagcactttgggaggctgaggtgggcggatcacctgaggtcaggaatttgagaccagcctggccaacatggtgaaaccccatctctactaatactacaaaaattagctgggcgtggcggtgtgcacctgtaatcccagctactcaggaggctgaggcaggagaatcacttgaacctgggaggtggaggatgcagtgagccgagatcgcaccactgcactccagcctggcgacagagcaagactctgtctcaaaagaaaaaaaaaaaaaaggaaataatgacattttcactgcaggacggctgggaaaataaaagtgagaaaataggtgggacattccctggcacagtgcttggtgcatattaggttcttaataaattaaccttctatttcccttctcctttcttgactttttaaagagtttgaccaaccccatagtctcattcattctgtggataaagtattcaggtgcattttcccagagccccttgtgggaatcacatgtggatccctcggtgcatttcagcaccctcactgcatgctttcttgcagtggctcgtcctgggtcataccttgcggaggtgggcgtggctggggctggcctagctgaggccccagctgggcttgccctggggatttcgctgatttaatctgtggagcctagagcagaagagaaaagaagcctgttggtatcaccacagccctttacttcctgggtgagagggcagcatttatgaagatctttttatcattgagaagagactcttacacataaagtgtacagttctggagtatacagtgtagtgaagttctatatgtgtatacgtcggtgtaaccactgcccagatcaaaacagagggcattctctgcgataaagcctgccccgtgccccttcccagccagcagccccgtcagtataataactacgattctgatgtttgttatcatagattactttctgtggggaaatctggggtgggaggtggaagtttggggacttgcttttacataaagctggggagctggcaaattctttggagagcagtctggtaatccatggtgggaactgtggaggggaggagcgacgtgggagctcatcgaggttggggaaaatgggagacacaatagcgtccattgactggttccctgggagcacacagagggcttgtgtgtccatatgctctcgcacacgcacgcacacacatcctgctcaggcccagcaccgagggcacagaagggacagcagtcgatcatctctgcccacagtgcccaaaggccatttgagacaagattgttctccccaggatggtgaagaagggaaggggcctctgaaagcctcctcaattcacttactggggcaggctgtgaaagctctccccaatgtctggccttcgtccacacccccattccttctccccaaggtggtttcttcctgggggtatcccctttggatccaggggctccccatttccagacagcctggcatttctcatggctataaagtctcctttgatcgtgagggtcttacccaaggtctgaggggggagggcgctgtgcctcctggcatcgggagctggctcattttggagacaacaaggtcggccatcagctgtctgtcctcttccacatgctctccaatcagcggcattgagctgtccattacctgtggggaggaagggagagctgagggacccccatgccaggagagatggcggttgggcatcacatcccagaagtgggggctcagggctcaggacagaagtgaccaccagatggcgatgtcctccatgcaaatcacctccagctgggactggccggcagcgacatcagttcccttcggttcagtctaaaccactccctggaggtagttcaattcggcccacgtttgctggatgacagcaatgcgacaagggccagggagcctctgccgaccttttctgtgcttttctttggggagccgctctccgccccctcctttctcaccctggccccctcccagggtcggggctggccacctctcctttggccccaggtcaaggctgctttccacaaagcagaaacagtaaaggtgggggcttgatcatgacaaaaatatgacgcgggctggagttgacccagggttcagaggaaagagggaagaggaaaggcctgttttccgaggccctggcaaaacacaggcgggagggaaaagcattccacagggagctgggctgttctcaaagtgcttctatcgggaggaacctgagggatccgagtttccccttctgctgtttttacaaatagagcaactgaggcccagagatgggaggggacttgcccaaggtcacacaggccaatgctccacgtgattccctgggcatgggaagctatgggagatctggaaggggtgtctgtcaggccttggcgcatctgcggaacagctggccgcgtcaccctctctgctccactgcaggagtcggcggcctgcattcacccacgccaccccatcagactcaccgtcttgtctcccctgttcccacgctctggacatattaggttttctctctcctccaggttcttatgtaatccctctacccactccttacctggccaactcctttcatccaacagggaacagctaactaggtcttcctccaggaagccctctctgatagtgcaagctctgacgagccacctgacaactgtatcctgccgttctcacctggtttcacacgggacagcttatccacggcactgtcaccccttgcttactatgtctccaccaccagactgggagcccccaaggttaggaatgggccccgtgtcctgctaagcaggtgtgccctccacagacacctgtttagtggaggaataagacgcccttgtgataagcccggctcataaggataaggatactaagaagcgccgtattttatggggcatttcctacgtgctacgctctattctaagcattgggtgtggaggatctctcataaacctcagaatagctctttgaggcagtactattatcctcattgtaatcaagaggaagcagagggtcaaagaagtggcaaggtcaaggacacagcactggcaacccacggtcctcccactgcatcaggctaattcccaccaagcactggaacagcacaccagggtaggaactgagaagagggaacctgggttccaggcttggcttctgctgtgtatttgctctgtgatcttgggcaagtttcttttcctctacgggcctatttttttttttttttttctcaacagtgaactgagggatctgggcagctgctaagacccttccagctgggacttgtagggatctgtgagtttaagcacccactttgattaggaaactgaaaagctagcttaagaatgtgaatactggctgggcgcggtggctcacgcctgtaatcccagcactttgggaggccggggcgggcggatcacgaggtcaggagattgagaccatcctggccaacacggtgaaaccccgtctctactaaaaatacaaaaaaaattagccgggcgtggtggcaggtgcctgtaatcccagctactcgggaggctgaggcaggagaatcgcttgaacctgggagtgtcggaggttgcagtgagccaagttgctctatttgtaagaagagcagaaggggaaactaggatccctcaggctcctccccatagaagcactttgagaatagcccagctccctgtggaacgcgtttccctcccgcctgggttttgccagggccccggaaaacaggcctttcctcttccctctttcccctggcgacagaatgagaccccgtctcaaaaaaaaaaaaaaaaaaaaaaaaaaaaaagaatgtgagtactgcttctagcagggtcctgagctctgcgcaggtcgtacctgggactgaggcctcctggatcccagcgccccagacagggacagtctctcagtcaccactggctgagctctgactgtggagtctgccgcgaaggtacacaggcttgctgcaccctgcctgtcctctctccccctgcccctgccaaccccattttattctggtctctgtttcctacattccctgcagtggaaaacagccaccgcaaggaacctgaggttcattttggaatccccacggtagagacagccaaaggaagtggccaccctcgtctccccagggaaacatttttccagtgagcaatgtcattccccggacaaggtcagagaggacaagttcaagggtcttttcccctgagtatttcactgtgagcctcttcacaaaacatttcacacacattttcagttctcaccacagagatggctgaagaaaccagtgttttgggatctcttctgcctttttttttttcccttactgggggaaaataccttttatatttctggtaacaagcttcccatctcccctgaccccactccaaactcaaaagcaaaggaaacaactctgcaatgtttctgcgaggaaaaaaaaaatctgaaaagctatctttcatttttcccctggaacattcttgggagacgttgttttcttattttttgaagtccgagcccactacttttacttttttttttttttttttaatgtgaaaggtctttcatccccaaccctctgaatggctaaaggcaggaagcctgagcccatgaacacagatttttttttttttccctaagactgaaagctgagacccggagaggtaggggctcacaggggacagagagactgctggtgcaagggaggagctggcctttgggggtcagggcagtccgggagctctaggagacagggcccctgctcttgtgtttgcagttgtactgtgtccacctggcttgggggctggctcctggagcagcggctcagtgaataaacaaatgagtgcgtgtgtgccaaatctgggttcatgtctggtggtccccgtgaggggatgcagaggcaggaggacctggtggggtctcaggagctgccgtgctgggggttcctgccccacctctgggctgaagctcccagaaggcgagggaccggctcctccagggagcaactgtacaggtcaaggagtctgttcccagccccttccatggctcctccaagtaggggctacttggggaacttcaggtgtggtggcggccagagggaaggcgtttccgggccttgagaggagagctgttctccagagtgggactaggtctgctaatgcagatgcagctcttcctgcaggagcttcctggcctctctggggaggagagaggggctgtgttcatcctggactccctcctcctacctccaaggcctgggtgtgaacaccctcctggcatgactgggctcccacccactgagtcacctggtcctgcttggccgtgggcccctggggagcgaggcagacatgagagacgggaggaccggctggctcctgtggtcaccccagccatgtgcttcccattagccgcccacaccccggggaggggacggccgcagggctctccctcacgtgtcctggccttgtgtcagcaccgcccatggaaggagggggctggacgcggcactggagctgtgagtgtggagatgggaagttatggcggactctgaggccagaggggcttttcaggggaaagcagtggagagccatgggacatggagtgggggggcagggaagaagagttggggaggggacgggagggctgtgggaccgtgagagacactgggaagacatggaggagaggtgggggttagtgggatacggggaaacagagagaggaagcggcggggatgggaggactataggattgggagaggcatgggctgctggagggtcttgagagagattccgggacccacagcccctctgtgagccctctgttaccattctgtttccctacatctttccctctattcatgcccctgtaccattccatcccccttccaaatcctcaatgctctgccactgtttctcaccctctcccctgccagcctgcacaccccatgtctattatgtccacggctgtatccccagagccacacccatgcttagcccatgggagccccctaaggccatgtttgttgaatgaacaaatgatggactgtctgcatggtgaccaaggaaggtgcccatttcacatgcttggacactggggaaatggaaggggccccatgggacagtatcttgttgacccttgaccagatgccctttccttcccttaggcctgtgggttggggatgttgttcaacctcgggccctgaggtctcccgactcagttccaagtccccaggcatgaagcctttcgatgcctctgagggtgggaaggagcctccagaagcaactcactgaggcctgggttgcgtgtgccctggagccaggacacagctgatggtgccaaagaccatgcagggattccctccccctggcacgcctgccaggctggaccagccaggaggactccctgcttcatccctcacctcgatgatgtaatctctgccatccttgctgtggacagccttgacggcacagatgtccaggccgccaaacatttccgagcagctgtccacccacagcctgtacctgcagggacagatggacagacagtgaagtggcctgggaaagtggggaagcgggtagagggagagaagtggattcacatggaaaaacaggcagggagggacagtgactcacacatccagacggcgatggagagagacagagaagcagcaagagagacagaaagacggagagagagttggagtccaacacgcagagacagagaggcagggagagaggcagggacacacatgacagtgagagagagacccagagaaagaacacgagagagccaggaaggaggggagagaggcagggagagaaggaaccagagttgggagaggtctcccccgaccccaggacttgctggctctgcagtaatggggagcttgccctgtccccatccggagtcatcctggacacccagccacccctgtgtcccttttcccttgggaaagctgctccaagggctccagaagtccctccaggctgcccttccagtcccagccctggccggacaagaggctgtggaggacaaagggtgcatttttcccagggcccggggcgggtgggctggggagactggcaggctgcttctgcctcgcccagggggcctggccctctagacccactgcttttgttccctttccagccacttgatgtctgcaaggccagtttgctttgctggggacagatctcagcactggactctgaccctgcaacaagggggtggttgtatgtgaagaaactgttccagctttgcacttagcttcccctgtgggctggatttgggagtcacaggggactctgtgtcaatgttcttgcttctcactctccagggtcacacggggcacgcctactctcacatcgctttgcgtctctgagccacaagtgctgggatgaggagggactgtgactggaatgctcttagaatggagtctcatctcatccaccaaagcctactgaggcccagagagggagggtggctggtccagatcacacagtaaggtgtaagaacaccaggattccctcgatctccttgactcccagtccagttttctcattcagctgtagcacggagcatgtgagatcatcaaataaaaagaaggatggagactcacacccatggagctcctggtatgttccaggcattctgggcccgggggctgactcctcattccctcgaatcccagcacaactctatgaggaaggttttaacccatcttactgatggaggaacaggctcagagcgatgattaagtgactgtaccgcttccaaatccagatcctgtctgattccagcttccaagcaagccacccttcctctcattctgaaggtgccccagcccatccattctcactcagcatgggagaccagggacctacattcttgctattaattccttaataattttggaaaagcctctccctcttatcataaaatgggaaagcctagatctgattctggttgtacatcagaatcaccaggagagttaaacgcacaaacagccagacttggggctccaccctatgttagagtaatttctataattttttaaagcttttcatgtgattctgatacgtggccacgtttggggacaaccttgggtccttggagctcgaagaatcctctgggctctctgatcagggtcctcgtttttggccccagtggctgacttgtgggtgccacacacagggtgagctctgccctgagacacactcataaatcaggtttcttctcaatggaacgtggaaatttgagctgaggtccagaggcagctgtttccagaggctgttttgaaaggatgaaccttggggtcccctgctggctacgccccatagggcacaggcatcccagggtctaggaaggggctgcaggcgtacagcagcgtgagagtgcttggagaatcggggggggggccctgctcccctcctgccaggtgggactagcactgaccaagcgacatcattggttttgcccaggagtcaggccacctggcaagcaggcgagccagtggagggcggggtcaggccctgtgtatgagtccctgtatggattttgctcctgtggggataggactggggatctctccagcccagaccctggagttctgcctgtgattggaaaagggaaagtggattccaggcctgggcaggcccactcccacgttaggttcctccagggatggcccatgcagcctgggacttggcagagccagggataggtggcctgctggggacatctgtgagtggctcaggaggcactggggaaggctgggctcacattccggaagggccatagagaagatggccacgactgtcccgtgaacacctgttgggggaaggaggtgactgcctcagccacatgattcagtcgtgccaggtcatgagcgcagcctccaagagactcattagcacaggtgggttcccaggttgaaggtggcagctgccccctggggttgatgggaaggacaggtgttcctccctgccaggggctggttctggattaggtgcagccctctctcattcagtcctcacacctgcactctgacttgggtattactactgctttcgttttgcagttgaagaagctcagaaagcatgagcatgcctaaggtcacactcagtctttgttgctgtaggggatgctcccactccagtctccaggggtgcagacctgacataggcctccaatcacagcgttgcagtgtcttgggccatagtgattggttcagggatggtcatgtgacctaagccaggccaaccagtacatatggctcagttctaggctttggttgaaatgactgggaaacagaagttttccttcttttgaacctgacactgtgaggatgaaagcctggagccactgtgtgccaccatgaaatgaaagagcctgcctggatgaagccaacacacaaagaagctgaacttgggtgggcagaggaggagccttaaggccttacctgacactgtatatctggagtcgtcagtgacatgagccagtaaatccccctttctgcgcaaaccaatttggtttgtgtggtagcccttgcaaccgatacagagttcttagagggaaggattggattttttcatcctttagcgctcagcacaacatggcctgcagtaggtactcaataggtgtttactgaacagagctttttgagttcacagcccatgctctgtccattgctattgtgtggctgctagcagaggtcacagggcatgcaggcaagaaggtatgtatgtggcaggccctgagaccagctgacttggcccttcgacccttcccccccttttttttttaaacagagttttgctctttttgcccaggctggagttcaatggcacgatctcagctcaccgcaacctccgcctcctgggttcaagtgattctcctgcctcagcctcccgagtagctgggattacaggcacccaccaccatgcttggctaattttgtatctgtagtagagatggggtttcaccatgttggccaggctggtcttgaactcctggcctcaggtgatctgcccgcctcggcctcccaaaatgctgggattacaggtgtgagccaccgcacccggccggcacttccttaagtggggctggcacacagtgtctaaagggagaaagaccgaaaaacccttcagccagagagcatccctaaaacatgcatgattcatgggacgtcaacctttccctattcatattgagatggaaggacgcttgagagagaagtggactctccaatatgcctggtctcctaataatgcttccttgcagctgtcagagcacaggagggactggccagggcttcctgacctcttcctatagcagctggtcagggctggaaagacctcggacttggagtcatgacatcagggttctactctcagctctgtcatcaactagctctgtgatcctagacaaatcacttcccctctctgagttttcttctcccatctgtaaaatggggttattttaatacctgccctgtaggttgctgtgggcagtgaagatgatcatgtctaaaaaagtgctctgtggatggtgaggcactggacggagggcggagtggccttctcttcagggccttttgttgcattcccccttcagctcctactatggccagtgcctctccctacacctcctttgtctcttacctctctgtcatggccacctgctccagcatggcagagcctgtgttggccttccagttcccagagatggaggttctcctgtaccagaacaaacaacacattgagggaattagggaccctcgtcactgatctgctttccttctttgctttggctgttaggaggctctgattcaaataactggctcacgtaatggcatgtattcttacgtacacaccttgtcttcaactatattttcctatgtttatttcccttcatgctgtttgccttttttatttgttggatcctaggtattgttttctaagtcatctttgaaattgaaagattaaattaaaaaatgcctacatcatctgatgaaatcccccaaactttggcctgtttttgaggagaatgagggcagtgtgtatagcccctggtgattctggaatcttttgagggccccaaaatgttagaaaagtgatccttagagagaagtgactacttttctctggtgaagattaggaaggccttctggtctctgactgtcttgccatccttctctgtttccttgccctttctgctccagtaacaaccgacctcccttccggtgctccactgcccatggctctttcccaatgtcatggcctctgcaggtcttcttccctttactccgtacagtctttgtctccatctttgcctccctaagtcctgctcatccttcaggtttcatctgacatacgacttcctgacagcccacctttacacagcaaaaatagactgcccggtactacgccctacactaatgctcagtaatgctcatctcccttctgatgactgcattagtgtcctctcttctctgatggaggagaatcctgacggtaggggacatgtttaacttcatcccctgtatacccagtatccagtgggatccggcaggtagtaggtgcccagtaggcacctactgggtgaggaactgtgtacactgggggagaatccagacaagctatctatcactaatgatgcatctggcctcggcaaagactgaacgagtttaagcatagtggtggaggtaaagctatttgtcttacggtcaagggaagctatgtcattgagatcaaagggtgaactggtgagaggaattgacacaaaaatgtatcattgtaagagaaaattgaagtaaaaatgctgagaatagatgaccaccaggagccataaggcactgcaccgtagttggcaaggttgtttcccatggagctacaggtgaaccattctgagactgggcacatacactgagatggaaccaaaaaagtggaatagatggtggatgggggagctggatttttctctgttggagtgggaagttatagattagcaatcaggaaaggctaaaatgaacgaagtggtaccagatgaaagtcagggacatccataggactctgtttagcttcatagggatgtggatgggaacatatagaaaaaattatggatatatgtgtatacacgggtaaggatacacacatgtacttccttactgtgtctgctaggacttagaaagaatgacagcccagtagcgacaagcacaaaggcccgagtgcagggcaaggagtgggccagagagggggttgaatggccggggaaattctacactgaagtctgacatgaaccccctcctttggagatgggccagcccaaggtccaggaaactcggtaagtaatgacaaagtggagctgtcaggccagggaggctcagcagaaaaatgctgcaatgaggtaatcctcaagaaaaaaaaaaactgggacaaggtgtcgtcaatgtcaagtggaagctcaaacaatgaagagaggagggaaatgatatcatggctgaaggcaggggcctcaggaacgcactggaatgggccataactcagagggggcagggaggaggtgattttatcaccccgaggccatctgagagcagtggcaggtctggcttgcctcacaggaggaagaggttgattagtggaatagggcagttactcctcaagaatgagctccatccctttcctgggaacacttccttctagggcaactgcctgcacctcctccagtttcacaagcaatgacagggctcagtagttgcaacagagacgatatagcccgtcaagcctaaaattaccacctggccctctacagaaaaagtttgctgacccttggtctaggcaatccaggtagtgctaaagcaaccacaggcaatccataaatgggcgtgcatggctgtgatcaacagaactgtatttagagacaggtggcagctggattcggcctgtggttgtggtttgccaaccctagcttaaagcacaagctacccacacagaagcctgcggatggagggactttccagctgtccagggctaacccttgcagtcctcagatatggagccctgcacacagtcagtgccccataaatgcttggcaaccaggcaacgattggccctctggggtctcatcatttcaagtggaactaacaataacattccagagtgaaagatagagagggcttggagcaaagacctctcccaagaacgagacagtctgcctattccagaagtccccattcatccttataaccacagccccatgtaatccgtgctttgttgaaccacctctagggtgaaggcgggctgcttttctctgcctggcattctttccttttcctctagattcagcacctctatttccactgggcaatggctctgcccacactgcatgccttcttataaagttttctgcttttctctaatcaataaaatgcgatcaaagttggactaatcagtactttttccacggaatcacaatcttgagttaagccttgaaaatgactagggcagattcatttaccagtagggatgccatgaaaattgtttattattatttctggctgcccaccttcctggggctactctgtatctgaatgtttctgaaattgataattgagttgggagatatttttgtttgcttttttaaagtttctgataacccatggttttctagtaaattccctttaaaaacccattaagttaatgagatgtggtttctgttgcttgcaggcagagaaatctggtgtaacctcctaactggtcttattggcttcagagaaaccgttctgcacctcccagcctcatggtcacctttttataaacacagatcagaccctttgctcagaagagaagagaaaaatactccaaaaccctcagcaaggtattcaaagccctccttgatttgtccccaaatttctctctcaaagacatatatcctgtgtgtatgtgcagttccctagacatgccaagcacctttcttgctctggaggaaacagcccttgcttgggtagacagatctctgcccagggataagcagtgactggacatcagcccctcagccacactggacagagaagaagggcagtaaggagacaggaaggaggataatgatgcacccttgggtgcaggagacagcggctggacatgcacctctgggctgccttcctcccacactcccccagcccctgccccagagactcacatgtaagccttgtagttggatccaattttctggatgcggatgtcgtacttggagtcgatgaaggcctcggtggtggcgtaggttttggccatggcgaccacgctggtgatgtcctggaagtcaagctggttttccactttgatctgtgtgggaggatgagggggatgagtgccacccaccccgtgttcactgagcccaccctatgccaggaacaagtgctctgtctatagacacgaattcccttcagaaggtcacctgctggcaggggagacagacacgggaagcaaatcattccaccacacaccgcacgagctgcagagaggaagggagtgattctgcttgggtggtcaagaaagctttacagaggaggtgagctctgaactgggtttggaaggatgaacatgtttcagatggatgaggtaggtagtggggccatcctccagagatgcacgaggaacccacagtgggggaaagggcaggtggcacagactcgctgatgggggatgcggcacgggccatgggggaacagactgtggagggccacagtctctgggaaggagctaggatttttagcctgaattttctggaaagccactggaagagggagtggagtttaaataaggaaatggtgtagtttgcgttttagcaaaatcactgaagcagctgtgtagaggatggaatggatgggtgtgatatgagacacagaggggccattaggaagaagggagcgtgcatgtgtgcatggtgtgtatgtgtagggagcatgcatgctggtgagtgttgtggagtttgtgggagatgtctgtgtgtggtgtgtttgcatatttgctgtatgctatgtgtggtatgttctttgtgtattcatatgtgtgtgtgtatagtgtgtgatatatgtgtgtgtggtgagtttgctgtgtgtgctgtgagttgtacatgtggtgtgtagtatgcggtgcttctgtgtgtgtgtgtagtgtgtgatatgtgtgtggtgtgtttgctgtgtgtggtgtgtgttgtacatgtggtatatagtatgcagtgcttctgtttgtgtgtatgtgtgtgtgtgtgtgtgtgtgtgcgcgcgcacacaggcacacactggagaggccagctttgctaggccagaggctgggagagaaactcacactgttgactagactgagccaggaacacagagaggtgtcctgggcttggggagaggtcccaggagagcttccaaggccaagcgcagaggacgaggccaaggctctatgatagtgatcttaagacagaacagaggctgactcccagcggctgtggacagctgggccagctgctccctcccactggccacgggagccctgcttgtccagaagcggctccccacttccctgtcaccctcaccccgacagcagaggagttctgatgctgggtcagagacgggcagagccctgtggagtggccgggcactaggcggtccacgtggggttggtctcggccacaccccatctcacgtccttccgatcttcctctcagcccttttctgcctgccctttgtggctcagctttgccttggcaactctgtccctcccacaagaatgcccactcacatttccaccagcgttgatgcttatgcagagtctttacagctctccgtggggcccaaacaggattgtgagcaggcaggcaggctgggcactgtcgtggtcacttaacagataaggaaactgagatttcttgacttgctcaaggttataaagcagctgagcccagagctaggcttgaaactctggactccgaaggcacagcttttccttgaaccatctcaggggtctgtaagtaggtgcctgcctgttctaccacaacggacctaaacagcaacaggagagaggctggaaaagccatctctcttcttggctctctgagtgatgactccaggtctcaatttgcagagaaaataaaggtgaccaggcaagagttccctattttccagcccttttcaaactcagctaccccacttcttcctcccagctgcagtggcggtggtgtgcctccttcctttgttctgggccttctaagcccttggttttagctgggtacctggcctcctcagccagagattactttgctccagtctgtcgtgcgggtagatgtgcctgagtctccaagctctggccggtgaaacctgggtagccgtgatattagcaacctctgggtggtgccctgaagatgaaaataatcttccccgtcctttttccttctttgctctggcagggaatgtgaacatgatggtatgagcagcagcctccatcttgggccatgagatggaagctgcatgttgaggatggctgagtagaaagatggaaggacctgggtcactagcactgtgaagctccctttctgagacagggtctcaatatgttactcaagctgagtgctgtggcatgatcatggctcactgcagccttgacttcctgagctcaagcaattctcctgcctcagccggccgagtagccgggactacaggcgtgcaccaccatgcccggctagtttttgattatttgtagagacagggcctcactatgttgaccaggctggtctcaaactccttggttcaagcgatctttccgcctcggccttccaaagtgctgggattacacactcgagccactgcgcctggcccctattatgtgggtctttgttaaagcagccaaatgacatttctgctcattatttttactctcttgcttttcattgattctttattctttggattaacgtgatcaaggatccaccattctcctcaacatgttcctgcttttcagaacctcagttacgcaccactgtctatctctacatcttcattccccacttgcccctcaacccactttctttaggttttactccctaccattctcctgagactgatttggccaaggtcccttttagtccactctttggcaaatcccatagaatgcctctggtccttgccctgcgttgaccctctgtagcacctgaaattagtgaactttgggaaatatgatttctgtaccactgttttcccagttctcacccttctttctggcaacttcttcacagtctatgttgccacctcttcttccaatgcccctttgattatcctggggtttcatctcagccagtattcagggtcaggtggagagaatcggaattgccaaaatgaaagaatcgggtgagcgtttgcagggacggcttgtttaactcacatttctgtccttggtggccttggaaagaaccagaatttctttggcaccttggtttcctagacagccctgagcacagagtgggctacctcggaagtgtctagctgtccacagcatcattttcctgctttacagtcatgatgcaccctgatatggggggcatgtgtccatccagggtacactttacactctctcctctccctggcatcttcataccgctgtgtggccacattttggccaacaagatgtgagcggaagaggtgtatgaacttccaggctgtgccgttaaagggcaggggagggctttgtactcctcgcttctctccccttgctggctggagtgtggaccatctttgacagtgtagctgagggcaacacaccaggcatggatgatcagtaagatggaagaagtccatggtcatgaaaccatggtagttccaggccagccctgggctgcttttgtgcagagcagagaaagaaagtcctagtttgtttatgcctttgtaagtctttgttatggcagctgaaatttatcccaattattatacaagccctaagtaaatttttgtggaatacatcatgcattctttcacagagtagacaaagagagcaaagggagaaagcacagacatagtggtttaatgcaggagtgggcaggcgccctctgggaacccttctcttctgtcttcgtttgagtggttgtgcactggggtcccattctgttgtcaccaacagtgagcatggaacccaggtctctctctctctctctctttttttttgagacagtctcacttactctgttgcccaggctggagtgcaatggtgcaatcttggctcactacaacctctgcctcctggattcaagcgattctcttgcttcagcctctcaagtagctgggactacaggtgcgtgccaccatggctggctaatttttgtatttttagtagagacgtggtttcaccatattggccaggctggtcttgaactcctgacctcaagtgatccacccacctcagcctcctaaaatgttgggattacaggcgtgagcccgggtatcttatacacaggcatttcaaagcttcaggagaggccctggccaaatgttcctttttattttattttctatttctatttatttatttttttaaagagacagggtctcactctgtcacccaggctggagtgcagttgtgcaatcatgactcactgcagccttgaacttctgggctcaagcattcctcccacctctgccacttgagtagttgggactacaggcgtcaccacatccagctgattttatgttctttttctttacagagggtctcccacattgtatgacacctgggcaataaaaaacggattctacccctggaaccaccatttctgtctccccattagactgtgagcttcttgaggacagacgagtgttgtccccagctgttgcactggtgccaagcagattgtacatgctctacacaagtttgctggattgaatttaagaaggttggatcaagacctgcttataatttgggaggggggcaagaaactagaaggaaaaacaagagagttccaaaaaaaggcaaagaaactgtttcaaggaaacttgtcttttataaggtggatatttccatgcattcttgggtaggtgctacgctctctgagggttactgcctgcctcacaagttcttgagaaccggaagaattccaggattctggcgaagaggggaggtggtctggagcctcggtgggtgggtgctggaggggactctgggatggtcctcaggccagagagggtagttggggtgagagggcactggggacacagccctgaggatggtgaaatggctgctagcctgggcagggagtcttggcactccgctttatttactggctggaaatccctccaagggttcacaaagacaagctgaaaacaggaagccctcaatgagctgtgattcaagattacccatttgctgccccaggggctatgatggggccactgtgaactctccaaaacagacccacccacacccttgcctccctcgcccctcttctcccttctcttatctcctctctccttctctctctcctttctcttgcgtccttgccttctcactctctcctccctcccttttctcccctttcctctaacactccttgccttctctcttactctgttttgtttttttgttgatgttgagacagagtctctctctgtcgcctaagctggagcgcagtggcacagtcagggctcactgcaacctctgcctcccaggttcaagcaatcctccaccttagcctcttgagtggctgggactaccggcgcatgacatcacgcctggctgttttttctttgtcgtattttttgtagaaatgaaatttccccatgttgcccaggctggtcttgaacacgtaggttcaggcgatcctcccaccttggcctcccaaagtgctgggattacaggcatgagtcaccatgcccggccactcttccttttgcttttaatgccatctgtttccctcttgcacctctttcctccttgatttttccttgttgcttacttcttctcttatctttctccagcctctcccttccacctccttctctgtctccttcagttttcctgacctcttttcaatgttgccattcttcttctccttctcatttcttcttcattccttcctctctgtctttcctgcctccttcccctcatggtctccccattcaggttctcacactcttctcctctcttgctttctgaattgctttaccctcttgtgtgcttgtgtgcacacatgtgtgtatgtgagtgtgcatgcatgcatgtgtgctctgtcctgaggctgagcaaggagggagagtggaaacagaggcagagaaagtggagagaggagtcaggatgcaattccaaatcttctgaatgggttttggctcagaggtctcctgttccaaattacaaaatccaacccgggatgggaaagtcatctacatacttagtagactgtctgctatttgcttgaatatctccaatagcagggagcttactatcaggcagggcagctcaatcccttttaggaaacctctaacctgttctggtgtatatcacaccaggaatgaatgaatggccctcgttattctatggagtaagtcttagccctctgccttgtgtctgcacttcatccacttgaagagagccacccaggtgtgcacaagtcattctttccttaacccattcctaatacgagctgcttccaggcccttcaccatcatgaaacgcccacatttgacaacctcttaaactacataatacccagaattacacaacagaccccaggtgtggtttcaccagcagagatcagataagactgtcccctccctctatccagaatccacctggcatattcctgcctcagggcctttgcacttgctgttccgagcctgcatggggtttcaccatgttggccaggacggtcttgaactcctgagttcaagccatctgcccaccttggcctggcaaagtgctgggattactggctgagccatggtgcctagcctcaggttattttattttattatttattattatttttttgagacggaatcttgctctgtcgtcaggctggagtgcagtggcacgatctcagctcactgcaacctctgcctcctgggttcaaacgattctcctgcctcagcctcctgagtagctgggactacaggcgcccaccaccatgcccggctaattttttgtatttttagtagagacgtggtttcaccatgttagccaggatggtctcaatctcctgatcttgtgatccgcccgcctcggcctcccaaagtgctgggattacaggcgtgagccaccgtgcctggcctaaaatatttatatttttatgccacctgttctagaaagaatttatggcaaatttcaaagatatataacatacaacatgagacgtaattaaaagccggatgatagtaattccactattaaacatccatcctaaagatataatggaagacacatgaaatggtatgcacgcaaggctgtttattgcagcactacgtgtaaaagaaagttttctgtcaacaattgggccatgttctatgatctcagaggtttatagctccaccttaagccttgaggacaggatgaagttagatgagaccctgaagacaggggtgggcggcctagagctgtggatggagctggagggatgttgggatggtcctctggccagaggaggcatttgggataagaaggtatgtagggcggactgccaccgggatggtgcattgactgctgacccacatgctcctcagcaggggacagctgcatccatggtgctccatgcacacaatcgaatgctttgcagtcaagagaaggcaatgaggaggatctacatactgctatggcgtgaaaaaaatagggtgcagaataatgaggataacatgcaagctttttttttttgtttgagacagagtctccctctgtcacccaggctggaatgcagtggcatgatcatggcttactgtagcttcaacctcctgggctcaagcaatcctcctgccgcagcctccccagtagctgagactacaggcatgtgccaccacatctggctaattttttattttttatagtgacaggatctcaccatgttgcccaggctggtcttaaactgctgggctcaagcaattctccggccttggcttcccaaagtgctgggattacagacattagtcaccatgaccagccaacatgcaaacttttatcaagaatttttttgtggacaatgcacatatttgattaaaaaaatacaggctgggtgcgcaggctcacgcctgtaatcccagcattttgagaggccaaagtgggtggatcacttgagggcaggagtttgagaccagcctggccagcatagtgaaactcagtctctagtaaaaatacaaaaattagccaggcatggttgtgtgcacctgtacttggaaggctgagggaagagaattgcttgaacccaggaggtggaggttgcagtgagctgagattgcaccgttgtactccagcctgggcagcacagcgagactctgtctcaaaaaaaaaaaatgcaatgaaggaatgaaccaaaaccaaatgagaatgttacctatagagggaagggaagcgggaggtgacggggatggaggctagtcctcactgtatatatcttgtttttataattttggctttggaatcaagcaaaaatggttattaattataaaacaaaataaatcaactggagaaagaatttcctgaaaacagaaaacaaaataaagttagtctaacaatatattaagctagtggcttaaacttacagagaagaattatttcaagtgactttgtaacagaaggctgagcacgtggatctctgtgatattccatttcttagatgaataaattcttactattacttataacccacagtattataatatacttatttgactgtccttcacactagaatttatttcttaacagcctgatcagtaattggcacatggtagatgttctataatttgtttaaccacattaaaaaaaaaaaaaaagctcaacacaacagtaactatatatccctagcagaaaatatccaaaagattttttaaaactgctaagaaatataaaattttattcaacttgttagtaataataatggtattgctattttaaaccatgataatagtaataatgctattaggacccaagatttttaaatataagagaaaagagatacaattttaaaataaaataaataagtgttgtaatctaagatttgaattcaaaatatcaggatgaatttatgatgtatttttctcttaaaaacatatatgcatttttccctgtgtctgccaaaaaggcctagaaatggcaaaaaaaaaaataagaataaacatatttagcacccagattgtggtctctaaaacccattatgttattgaaaggcttccatggctccttggggaaatgactgattccaggtttgggcagaaaatgtacaagatgagttcaaaacatcttatcatgctagtaaaaggaaagctaccatgtcaagaagacacataaatcaactcaaaagggctcccattagccaaagatgggataacttgagtatcagaaagaatagtgacttcaatagattgaaatacatcaaattgttaataaccaatgacaaaaagatcattggtcatgtttggagggtgctaagacactatctcactattccaaaataaatgggtaaataacagtgatgaagaaatattctctttgatgttttctagctactaaatgcaaaagaaatagaattaggacatcatccttctgcagcccctaatgcaataacagattgaggcaatgctgatcaatgccaaggccactggggaaaggctgatgggaaacttgataatgtgtggatcaggcagacgatacctgagctcaaggaccactcttgacatctcaacagagagacttgccagtcagatgtgatgcaagataatggcccctacccccaccctgcaccagggaagtattcttgccagaatccagaacctgattcagataaaaatctctgcatttaactactagtttacaggaaatgcaggtgatagaggaacaacatggagctgccattggccaaattagcatgtaggaaattctacaggaaaaatggcctccccccaccaacaaataaatgacaaggaaaaaaaaaaaacagaggagactgaactgttatagatcataagaggcttatgtcatactaaccatgtgaatatgaaggacttgtctgcatacaatggaacacatcaattaacaggaggctattgaacactgatgatatactagatgatattaaagaattattattatgtttttaggtctttggctacattagagacaaaaaaagaagcttttgtgtgttagaaatattcactgaaatatttatgggtgaaatgacttgatatctgagatttgctttaaaatattccagtgatctacagagacaggaagcagaggagcaattgccaaggacttgggggagaggaatgggtagtcactgctaattgatgtgggataatgaaaatgtgctacaattatacagcggtgatgcttccaccttgtagatattctaaaaaacactgaaggccaggtgcggtggctcacgtctgtaatcccagcactttgggaggccgaggtgggtggatcacgaggttaagagttgagaccagcctggccaacagggtgaaaccctgcctctactaaagacaaaaattagctgagagtggtggcgggcgcctgtaatcccagctacttgggaggttgaggcggaagaatcgcttgaacccgggaggcggaggttgcagtggagcaagatcgcgccactgcactccagcccgggtgacagagtgagactccatctcaaaaacaaaaaacaaaaaacaaaaaactgaaaacactttagaagggtgaattttatagcatgagaattagatctgaaaaaagtatccagaggtgtttgagaggaagattggagatgtacataaaatataattgagcatcagtggataatggttgaagttgggtcaaaggtttttcttttttttttctttttttttttttttagtgtgaggctaaaggtacatggggttccagtttaccattttctcttcttttgtatatatttgaaacttttaggttaaaaacaagcaggactaaaggagaaaaacaaagatgaggacataaaattgtacttagactggggttaacagtggttatgtctggatatagatgtggccccttttttgtgtgtctgttgaagaaaagaaactttgatcagtaacatgattcagtctccctaagaggaaaaagcacgaggtgcctaagagatttacaacccattcttgcaataaaatcatatgatgtttctcctgagctcctcctatagaggacactgcgatatgtaacaaatgtaagcctcaacaatgctctttgatgattggctgtttcctataatgtcacttagttaggcttctgtcttactctactggagctactatcacaaaataccagagactaggcggcttaaacagcagacatttatttcccacagttctggagactgggaagtcctagatcaaggtgctggcatggtcaggttctggtgaggcgctctgcctggcttgcagattgctgccttctggctgtgtcctcatgtgccacagagagagagtgagcaagctctctggtatctcttcttataaggaccctcatcccatcatgagggccccaccatcgtgacctcatctaaacctaattacctcccatagatcccatctccaaatcccatcactttggggattaaggctccaacatatgggctttaccggggacacaattcagtccagagcatctcatgtcctcatgtcctctccttaaagcatgattcaaagaaagcagtttgcagatggccaataaatgcaatgcagtgatcattttgatccgtttttaaataaagcttattaattacttgaaaaaattatatacagacatggcaaaaaaggtaaaagatatcaaaaggaaatctggaaaaaaaataattctaaacctcaagcctcctggtgataagatttctttgtacttgtctggaaatattctataaatataataatgtaaggtgatagaaatgggtctcattctgtctcagtctgaaatgaatcaagaagacaaagttgctatttcccaaagtgtgctatgagagactgctatagtcaagacctagcagactcacccatgtattatataacaaggttaggttgctggagattagggaagttttttgaaatggtggtttctttggaaaatgttgtgtcagcctactctggccttttggtagataggtctggtaagagagtctatgggacacccagtgaggtggggcctggtgaactggtgctgatccctagggcatctgtaggtgagcatcccagcctttggggttggcccacatcccagagtttatccaggctcagaatgcaaatgcttcctgtggactacagttgggctgtatgggagaaaggctggctttgagccacttaaaaatcttacatgggggagcagcagctgaaggagagacattgccacctccactgccaccaccacggtccacaccatcatcatccctcactggaccatcgccatcatctcctttgaaaattccccttgcccaggccaaatgtcaggcttatttcctcaaaatctccggaggtaccagtgtctgttgaagctctgcaggcagatgtgtgcagcccaggttggagaggtggtgtctggccatctctcttttgcgttcagccaaacttggtcctgcctcagtgactttgcacttgctgttcctgctgcttggaacaattttcctgaatattgtctgtggctggttgcttcaggtttcagcccagatggtccctcaatacgggctttttccaagtacctgatatacagtggccactcctccctgtccgctctgggaagtctctactgaaatcccctggtttattatcatttttgttaccaccttcacctctctgaaattacttgtctgttaatatatttactgcctttctcctccactaaaatataagctcataagactaggaaccttcagtgtcttgctagggaggcaatttaccagcatgtttaaaaatgcaagctctctgtccttaggcatccttagtcacctgctctgtaaccgtccttccagccaaactattcaccccgccactccggctcgtacccctgctttctttaaaatagccaatcggaattagcttagactgtatggtccaaccctagccaataggggaaagacacagcagtaagaactagctgcattaggaataagacccccttcccctcccttgtccggtgtgctctcgccattgctccatctgcgagacacacccttctctagaagtaaaattgccttgctgacaaaaaaaatgcaagctcaaatcccaactccatcacttattcgctgcatggccttgggtaagttacttaacctctctgtgtctcactttcctcatcaacgaaatgtggataacttgaatactggattgctgttgagcattcaatgagatactacatgtaaatgcactaaaagagcacctggctcatcacaaatgctcaataaatgttataactatcattattattcctttttatacccctagcacccagcataaggcctggcacatagtaggtcctccataaataattgctgaaagaatgaatgaagaggccagtcatgagaactgtggtgggaagagagtctaggccgaggaaaaaaggaggtgcaatagccctgaggttgatgctgaaactcacaagctgtaacagaaaactgggtcttaacatcctcttacgaaagctgaaggctaatagggaataatgcttgaagaggggacatcccatctcccctgagagaggaacacaaggagtgaggccaagatccttcccagaaagtgatttggaatcaatcctgatacagaaacacataagcaactgaagcttattgccctatttcaatcacccagaaaacatttaaggcaaccatgaccagttgctcaccctgctgagtttctctccagcaagcctccatagaagtcccagcttggagcatgctccctcctggtgtgatggccgggacatactggtttttttaaagtaaagataactgcatgaggtaatttactgaaccaggttatttacaaatcagtgaaaagtcaggaggatgcataccaaaaataatcaccataggttcagaacagtcactctgtggcctttctttctggcaaaaattagctggcagggccaactggatgttcaggccactcctagttggagataataaaaccataacccgggcacacaaatggatgcttgttttcctgtttttataacaggaaggcatgcatccagctcattccaaaggggtatcagctcattaagaaactagtcggatggggtcaagggggataaactaaatctctgttttacctcccaggaaattcttaaccagcctgcatgtcccagactctcaagacaggattaagtacaagttctgtgtgacgaatattaataccaggtcatgctcacagagtttagctcagaatcaattcccgagctcatcaaaggcttagaagcagcaatggggacttgcaaaaaccctaaagcagaggttcccaagccttcttggtttatggtgcccatctcaagaattttttcacggcattcttaaggccaaagaagtactaagcagattcacgtattaagtagttagagcgaaatagcttattaagtgtttacatcctaacaatttagtaaccatttgaaaaaaagtacggaatgtttttatttcattcctaaataactacaattacttactaatgggatgtatgtgcttattgggcagtgcacaaattcctgaaccttagaatcagattggacaccattaccctcatttcctctcccacgtgattttcacatggtacttagtttttggcacaaccaccaccaaaaactcagcttcacaaagatgcaacatcactgaaagaaacatacgatccaatctagaaacgaaactacttcggccattaatttacatggcgtctgacagacgctgagaattgctatgtttcctttgaaaattaaaaatatactgtgctacccccatgagtctgtggcgctccaggacttctcagtgtcgagtttgggaactggagccctaatgtgatgacttttggagttctcctctaacagtaaataacagaagtctctggtgttatatcccagggaaaaaagcctgactgctcctcatgtaaaacacaggtctgagaaacctatggggtgggctggggggaggaggtatatccatatacccaatgacccaatgacccaatgacccaatctataggtttcctggtttttttttttttttttttttttttttttttgtgtgtagagatggggtcttgctgtgttgcccaggctggtctcgaactcctggcctcgaatggtcctcctgccttgacctcctaaagtattgggattacaggtgtgagtcactgcacccagcctagtcaatctatactttaaaaaagtccacactttaggaaaattaaaaggatatcacactttttaagatggtataaactctgttcaagatagatgcatcaggaccatgttcttaatgcatacaaaggtgggttagttagtgagagtaagctcgctatttagaatagtccttaaacatatctgaaaagaaaatgttgctcaaacggtgtattaaaaagattattaaggtaccatttctatcatgaaggagttcacagtccatgggagaggcagatacatgaacagataattctatagagggtgaccaacaccacaaagggcatgcggctgaggggccctgattcacaaggggaggggggatgggtgcagaagtcttccccagtgaggggatggagtccacctgaattttctttgtaatgattatggagattaacctgcaaaataacaattcacagtgggtgttggcatggggcttcatctcattttcacactcattctttcaagacatctttcctgctttttactgggcattaactatgtgccagcaactgtactgcacagtttacatgtattatctcagttaatcttcaaaacaactggatgagcctctggccatgacgtatccagacaagccctgtctctgtaaacaactataaaactggaaataatttatgagccaactgtttctaggcagcagaaataggcaatgcaaggctgtgatcctaagaagaggggaattgggaggggagcctcgtgttcacccggtgcctttcccagcctcgtcacatgccactctgcccttgcccgtgacactccaacttactggtctggcacttcctaaacaacccaaactctttcctgcctttgggcttttgcatctgctgttctctgcccccagaaagttcttctccattgttctgtgcctggctggcttgttgtcacttttcatatgttttgtgtaagtgtcaccaggtcagaagttttttctctgatagttctactgtgtttttctctcttttaacaatctcttcttctcaccaagaagtaccaagttgagtttgtaactgtgtatttatttgcttgcttttgcattgtctgcctattccactagactatgacttctctacccagggcttagcacagcacctagcacatagtaggtgcttaataaatagctgttgaatgaaaaaaagaaagaaggattagattggcccctctccttcctggagcaagtgagggaatgaggagttaggaggaaaattaggagaaaggcaattcctccttcctctttacaatgttactgaagctcagaaaccctgtaggatatagctgagaaggctttgtgaaggattaaagacatgaagacagtgtatgtccactcagtagagcctcttggcaatcttgggagggagatgttgttcctcccatttcagggatgaggctcagagatgcgaagaacttgcctgaaagcacccagctagtaagtggaggaatgaggatatgaatctggtcctggagaattcagaaccccatgatctgtccatgatcttgccctggtttgaatgcagaggatggaggcaacttttcccttttcctatcttttctctttcctatcttttcccttccccacttcccctcatctgggtcttctgcaaactccagtgacagatgggcttgagctggcaaagtgcaggttttgagagtgccatggggcaggtgcctagtctcttcctggaaggacccgggagggcaagctgtaccagccaaactctattgccaaggtatcccccactggaatcatggccctgatgactcaacccaagggccccttagccaaggcagactgtgccaggggaccctaacatggccggggctctgggctgactcacagggcaggctgccaccacctgagtcacccgccccacctctgactggagagaagaggctggggaggctggggtggggcactggtctgggaccatgtgactcagcctgtgaataaataatgatgacagtgattgtaataacaaaaatgatggacagtgacagctacctctaacgagtgctttctatgtgcttggtgctattctatgcactatatacagtattcatttagtcttcataacaatcctatgaggtaagtactactattcccatttcatacatgaacaactgcggcccagcaaggttatgtcattggctgcaggactcacagctggaacagaaaagctgagatttcaactacgtccgtctgactctaaagcccagacattcattcagttaatatttattgagcccctactacaagccagacactgttgtagacaccaaggagacaatggcagggttgggtgggaagataaacaaatagatatatgacatattaggtggagatgagagatgagtgctactgttagagtagctagtcaggcagacatgaggagggccaagagggctcttccccatccaccagaaatgtcaggcgactttcaggtgatggtcaggcagtttttaattgtctcgttaaaataataattggttgcagctggcaccagagaaaggcagtctcctaatggatagaaaaaaccttggccgggcgcggtggctcacgcctgtaatcccagaactttgggaggccgagatgggcggatcacgaggtcagatcgagaccatcctggctaacacggtgaaaccccatctctactaaaaaaatacaaaaaaattagccgggcgtggcggcgggtggcgcctgtagtcccagcactctggaggctgaggcaggagaatggtgtgaacctgggaggcagagcttgcagtgtgcccagatagcgccactgccctccagcctgggagacagagcgagactccgtctcaacaaaaaaaaaaaaaaagaaaaaaagaaaagaccttaaactggtgatcagcagcttcctgattagatctcaggagttgggtgagtgggctcaagcctgtgcactaagaggcaaaatggcggagtgtatgtaactggtatatgaccttcttctaggaacacgtgactgggaagggcaaaacgcctccagtgagcatgcgcacaacttcagtaaacacactgtgcctgcagcccctcccaagtgctggcaggccactgcgcatgcagacagcccacctcaagggaagaatcaggggagaaggaatgcaagaccccggaagcaaccccaagtcaaaggtcaaactgtgcacttgatctctcaagttgcccgactggccctcttccaagtgtactttacttcgtttcattcctgctctaaagcttttaaatacagtttcactcctgctctaaagcctgcctccttctttccctctgccttaggcctcttggtcgaatttaaggcaagaatggaggttgctgaaggttccactgctaacagtatggggaaaataaattacataaagtggggtagggatgattggggggtcagacttgggacactatttctcatagagcagctggagttctccctaataagacgtcgtcgagtaaagacccaaaggaagtgcagaaacaagtcacaggcctatcctgtcgattccaggcagacaatagcaagagccaaggcctgaggtgcgacattgacgtgtgtgcttggagaagaggccgatgtggatgcagcggagtggagggagggctgagaggtgggctgcaggtcagaaagatggggaagggtcatgtagggtctcagagccaccgcaacgactttcgtttttactgcaaatggcatgaggagccacggagggtttcaagcaagggggatcacatgatctgacttatggcttgaaaggttcgctttgttgtgagactaaagcaaggactgaaaagcaagggacctgttggaagcccactttcatcatagaatccccatgagaagggacagtggcttgaacgagggtggtacattctagaaatattttaaaagtagagctgaaaggatttgctgatgggtaggatgtggggtgtgaaggaaatgcaggagtggaggatgattccaagggctttggctggagcattttgaaggcggatcccggctttcccctcctcagcccacccacaaatgggaaagcctgcggaggagcagttgtgcccacgatcagagtccttgtggacagccccagtcagacgacagagaaagtctccctccaggtttttcctgctcctagtggatgggaacagagacccctgaagcccagaatgtcacctgcggccagcgtaggtcaggggaactcgctcaagaaggaagttgcccctgaggccagcaggagagacagacagagcctagggcatcggtgacttcactgagacactcatcaccaggacttcatggtgtttaggccagtttgaactggaattttctagtatttacagccaaaataatcttgatacagggtaggtgccttcactggcttctggctgcccaaacctgcttggcttgcctatgggtgtgtctgcagagaaggtatttttgctgaggctctagtctccagaatttgtcactctggagggacttggggggtcctggctggttttcttcagcagcagaggacctttcagttgggggaatgataatgggggcatctcttatttccaaactctggcagtttccttccatgtggagggaacaacatccctggcctgtcggctgcctgccactcacccgtccccggagcaggtgacattctgatcagagagtttgaaggagaaacggggcaagtgtggaccagtccattcttctcttctttctgtttcccacgaagagcatggaatctactctgcttctgactggagagtttgcaggccaggctcctacgtggggaagcctgtagaggcccaacgctgcctccaaggcttgggggaggcaaatctgtctcattctggggttaagtcctgaggagcccatttgcctgcacagcaaagccacattcctccacatcttgatttctactaggtgatatatttgattttgcaaattccttcctcttacgacaccccagcataaacctgcaacgtggctgactggttggaagagcatattgaaggagtgaagccaagcatgaggtgggttgaattcttcttccaatccgagatccaatgattctgttatctgacaaaaagaagcaccccggttctgtcaaagagataacatcccccccaatacttaattctgaaaggcacatattcaatggttcgtcatgagactttgcacagtggataacaaatagcaccattgctggtggttttataaaagttgccgaaacgtctccagccgactggaaccttcctcccgccctttcccaccttcattgcatgaccccttggctttgtcaggctgaggacagggcagcgggctcctccagagctcattaaggtttgcttttcccttgctcaaagtgatccttggtaaatttcctcttcagggtctgagaactcgacctttagtcaaggaaccatctgggttggcctggagggacattgctcacctgtgaaatgattgccccacagtgaccggccctgacagagagctcctctctccctggtctctgcctaatactccccacaatctggtctttcacggggagtgcccgacagtggacttgaccggctctgccccctgtcagcacttcctcactaagccgctccaccctactccgttttctgcccaacaggagaataaaggaagcatcagagcctcccaggcgagattccagattgtctgtaatgaaaacagaccaagccaagcaaacaaagcagatgcttggcctaagccctgcttattatttcaatcttatatggacatttcattgcttcgggccatgtctgcaggtgattggcccagggtccttcctttctgttgttggggggcatcagcccaggctttcatgggaaggacacaggatcaaccaggacaagggaaagaagagccagggggcctgaactccagttccagctgggaagagacctcactgggtgaccttgggcaagtaactttccctctctcaactctcagattcaaatttccaccatgcaagcatagggtataaaagtaaatcaaggttaagagagtggcctctggagtcagagcatgtggctttcagttctgactcaccgattgccataacctcattgcgttcccactccttcaactgtacgctggttattagtatccagcttagaggcactataggtaagaggtttaagtaaattaactcatgggaagttctccaggcagggcctggcatgtagcatgtgctcaatacattcatcatgattattatgaataatcctatgaagatcacagcctgtaagggcaatgagacatgtcaaagttaagtacaccagcagattacagatggggccccagaattctgcataaacacagtgtggatgcaaagcagggagggtcatgtcaactgaaggtgttggggagaagttcaggaaactcttgaacttgagctgagtttggtcttgatgaggctgacacaggtgtaggacactcgtggaagataaaatggagggaaaagccagagaacatggaacagcctggcatgttccgggattggagagtggttgggtgtggctggagcagtgggtgtgaggaggcatgtgccgagaggaccctggaaaagttgatggatcagggtggatcctgtaggctttccccttggacaacctggagtcctgctagtttttttgtttggagacagagtctcactctgttacccaggctggagtacaatggctcgatctcagctcactgcaacctccgcctcccaggttcaagcgattctcctgcctcagcttcctgagtagctgggattacaggcatgcaccaccatgcctggctaattttgtatttttagtagagacagggtttctccatgttggtcaggatggtctcgaactcctgacctcaggtggtctgcctccctcggcctcccaaagtgctgggattacaggcatgagccactgcgcccggcccctgttgggtttcaagcagaggaagtgaggtagccagttctgggttttaggaccctagcaaatggatgggaggggccagctggggggccacgcaatccttaggcagtgattgttgcagtttagagcagaagtggtgcagagctgacctaagacaccaagatcagggaggcaggaaaatgcaacgcatgcctgagctgggaacacaggactcaatcatggagtggctgtgagggcccaaaggggagccaaatgatagaaccatttgccggccatgactgcacgtctttcatactgggagtcctgccctgctacagatgaagaggccccgggagggttgagtcacttcttccaggtcacatagctggtgagcaaaggagaaggatgcctactgggaatctggcttcgcagctcccagccataaaccaaggctgcttctctgtaaccatggccagcctttattgaatgcttttcatatgccaggcattgttctaagtaactttcccaaggtcacacggctagtaaatgacagagctgtgattcaaacacaagcagtactcccagactgcacccaaacaatgctcccggactgtacacaaacagtgtcccagactgcacccaaacagtgctcccggactacacccaagcagtactcccagaatgcacccaaacggtgctcccggactgtacacaaacagtgctcccagactgcacccaaagagtgctctcggactgcacccaaacagtgctcccggactgcacccaaacagtgctcctgggctgcacccagtgctcccgcattgtacccaaacagtgctcctgggctgcacccaaacagtgctcccgcattgtacccaaacagtgctcccggactacacccaaacagtgctcccggactgcaccctaacagcgctcccggactgcaccctaacagtgctcccggattacacccaaacagtgctcccggattgtacccaaacagtgctcctggactgcacccaaacagtgctcctggactgcacccaaacagtgctcccggactgcacccaaacagtgctcccggactgcacccaaacagtgatctcagactgcacccaaacagtgctccctgactgtacacaaacagtgctcccggactgcacccagacagtgctcccggactgcacccaaacagtgctcctgggctgcacccaaacagtgctctcggactgcacccaaacagtgctctcggactgcacctaaacagtgctcctggaccacaactgcttatcactatgctgagttgctttgggtgacacaatgatgcaggtgaaaccatgggagtggatgggattgtctaaagcattgttgtctctggaactccagtgagagtcacatgtataattacaagttttctattagccacattaaaaaaagtaaaaagaaataggtgaacataattttaatagtgtatgtatgtatgtacatatatatacacacacatatacatataaaatagtttacgtatatacatatataaaaaatataaattcatacataaaaatatatataaatatataagtatatataggagaccgaatcatgccctgtgcccaggctggaattcagtggtgcgatcctagctcactgcagcctggaactcctgggctcaagcaatcctcctgctacagcctcccgagtagctaggactacaggcatgcaccaccgtgcctggctaatttttaatttaatttaattttattatatatttatttatttatttaatttttttttactcgctctgtcccccaggctggagtgcagtggcacgatctcggctcactgcaagctccgcctcccaggttcacaccattctcttgcctcagcccccccgagtagctgcgactacaggcacccaccaccacgcccagctaattttttgtatttctagtggagatagcgtttcatcatgttaaccaggatggtctcgaactcctgacctggtgatctgcccgcctcggcctcccaaagtgctaggattacaggcataagccaccgcgcccagcctattttatttttttagagatggggtcttgctatgttgctgaggctggtctcaatctcctgacctaaagtgatcctcctgcttgggtctcctaaagcactgggattacaggtgtgagccactgcacctggccagggtattttgtttaacccgatataaaaaaagttctcatttcaatgtgtaatctatataaaaattatgattgagatattttatgttctcttttttgtaactctagtcttggaattgggtgtgtattttatactcagcctatctcaatagaggcatgtgtcaagcactcagtaggtgcacgtggctgatggctaccaaactggacagtgcaagatggagggatctgtggacagtgagaaagagagagggggcaaggtcagaaccgtagggcacatggatgctcaagggaagggtggaagaggagcttgcaaaggagcctgggaaagcctggctggagacaaaggaggaaaggcagccagcatggtgtccctgaaagtgacgtaaagtttgtgtgttaagagatgggtacaacagtgacacaacccggaggagagcaagcaaaacaaggggctgaagactttatcaggattttctatttggaggtcatgaattatctttgccagaccaaactttgtggagtggtgggagctgattcagggagctggagagaatggagacaactacaggctcctttttaagaaacttggctgagaaggtaggtaaaggggtacaagggctcagcaaagacttatttattcttttcaaatctaaatgagacttgaacattctttagtgttgaaagatgcccttcagaaagcaacattgagcgccaggagtgagaagaaacggacaggtagccaagtcctagaggctatgatggaaatgagagccagaactcagaggtaaaatgaaatctacaaaggagaaaagactccactgagatgggaaagaaggtgtgggggcaggcagaggtgcaggaagatgaactttgatacaggggaatggattctcttctttgatgggaaggacgtggggcttgaagagagcagcaaagttctggaaatgccacagtgagactgggaaaggtaactgactagggagatgtaaaagcttcaccaggacccactagggccctgctggggttggagatgaggcatttgtagtaggagcatgagatcagtgatgaggttttctccaactgtgctcagcagtgtcagtttaggaaaggagaaggcccatcggtggattgattcaaggttgagtgttctagggcaggtgcaatagaacgatgacggagatcctccctccctccctccctccctccctccctcccttctttccttccttccttccttccttcaccaaaaatgtattaagggactgctgtatgccaggtactctgctaggtggtggaaatagaacacagagccaaaagagattaagattcccgcctccatggagcttatggcaatggttttctgcaaattctcaattggtccttaatatggaaggggaagaaaagggttatgtattgggcctcagaacattagctaaaaaattgggatggactgatacatttcacatgtggagctggcatggtctactgtgtggtcggggagagggtggctactttggacagtggataccaatcttgaagtcatggaagtagggattatcatccacatatccccagatggggttgacgagcctcagaggcagcacgtgaccagcccgaggtcacacagccaggaagtgggaagattgtctgggcccagagtctgctgtttttactttcctatactcccaagctgatgaaaccccaggaagaggaggtttattgaactccttgcgggtataggttccctgcctccctcctccttctcttgccaaccctgatttgggccagagccatggccattttatgcatcagtgttgtttggagggggaagcttgctaatgaggatgatccccagtttcagaagggaccggacggtcacagctgcataaagtcctctggatgattaaagctcctcacgggacaggcaaggctgttagaatcttcctggagttgacaggcaaaagcacagccagacctttgctcctagctgctgtggagagctgtgcctctgggaggtcctgaatgacaccagcctgggctccctgtacctttgctcttgtttccttcctggaatgctctccttgctcctctacctaattcctactcattcctcaaaaccctaaaactcagttcctcctccagctcctaggaatttctctttcctcctctggacttccacagggctttgtatttagtctacaaatatttattgagggtactgtgctaggcattgggaatacagtcataaataagacaggtatattctagtcagggaaatggaaaacaaataagcagatagtgtcttgggtccattggggttgctctaacaaaataccataaactgggtggcttataaaggacagaaacgtatttcttactgttctggaggctgggaagtccaaggtcaaggtggattcagtgtctggtgaggccctgatttattcctgtaacctcacaggatggaagggacaaacaagctcccagggcctattttagaaagacactaatcccattcctcagggatctgccctcatgacctcccgaaggctccacctcctaattccatcaccttggggggtaggactttagcatataacatattttaacatatctgtagcagacagataggtggatacctagctagctaggttggtaacaaattggtagaaaatagctagtttgcaaagactttgaaagacacaaccggagagtgtcctaggggatgtattactttgtattgcctgaatactgaggggcctcctgaagctaatcaatcaggctgggtttgtagaattccatttgatgggtgtttaggctgcactatgacacacattcttcccatgcaagtcacaaagttgttagaggaatcagaagaaattttgcaggcagcacaatgcaagtatatagatgacggggtcaggatggtctagattcacatcctagcttagggacttacaaatgccatgatttggaatgagttcttaagtctttctggggttcaatttcctcatgtgtaaaatggagatgataatatttatactcaccctcagagagttgggaggattagaaattctatctacctaattctttctttctatctatctctatgcatccaaaatctatctatctatctatctatctatctatctatctatctatctacacctatctatataaaatctatctatctatctctatccatccaaaatatatctatctatccatctatacctatctaaaatctatctatctccatccaaaatctatctatctatctatctatctatctatctatctatctatctatcttctctatctatctaaaatctatcaattgatctaaaatctatctgtatctaaaatgtatcatctatctatatctatctaaaatcaatcaatctctctctctctctctctctctctctctctctctatatatatatatatataaaatctatctatttcttctaggtgatggttattattgcatgcataagagttttaaaaatacgaaatactccacaaatggaaggtatggctttgagcatggtttgggagtcaggctttactacttcctaactatgtgaccttgggacatttcttaacttctctaaaccttaattttctcatccgtaaaatggggtttgtaatagtacctgcttcacagagttactgtgaagatttagaagtaaactggcccaatgatttgaacagtgccaggcacaaagcaacgaatgttagctgtttgtcattaaccgtaagcacctttatcaaaaaggtatctagagattttgtaaagtccaggatacattaatagcattaaagctattgtcctcatttttctggccccgatggcttacgttttctgggcatggacacccctctcccagtcctctgaaaagtgtttttagtacgggccatgctgagggtgtgttaggtgccacaatggctggacttatcttgctcatgcatagcttccgaggtcgattaaacatggtatttaaccaacctccctccacacacactgccttctagggaggactggaaagcctgctgactgtcctgcaggacttgggaggggtttgtctatatccaaaagacagacagtggaggaggatgctgagcgtggggtcccgccaggggatggctagactccttgtctgtctggctcccttgtgaaatactgggaaattaaaggccattgtaaacatttcccaaaagcagtaaagatttttttatgcagatggggatgtgactcactttaccaaagttaaagggtctagagcgttgtgctgaggttaggaagaattggaggtttttgttttctgattaaaacattgaattttaattttggagttgaagctgtgcatgtttctctcccaggtagatctgggagtagggaaagggggtgtagtagggtcgggggaggagtctcaggagggagggagagggtggggtgctgagaagtgtgctctgagtatgccgcatttagcaactctacccttatagaaaaaacagcttagaatctcagtgtgaagggacgtgagttggcatctggtcaaccctctcattttgcagctgaggcacacagggaggagcaggtagcttggatagggttacttacccatgagccaaagaccaacactggcttcaagcctgctcagcactgggatgctgacttctctctaccagtgacccacaatgcgtgacactggtggcccacaggatgatttaggggggacacaaatgaacatggataattttaacagttagatatttatttcaaggtgtattaggaaaaattatctggcccataaaactcataatctatggtagtgatacaaaacaccatttaaaaatatatttaagcagagcaagagggaattgtgtgtgtgtgtgtttctaaaatgttggctaaataacagaatgggtgacctgtagggtgtcctaaatcatgaccacagtccactccatctttagggcttttggtgctacaggaggcagtctgaggaaggcctttcaggctctcctagagttttaagtctgagaaggagcaaacttccccagagcatcccccctccccttctcatcctcctttcttctccatttctctcctcctttgactttgtcttcttcctttccatccccagtgcccagaacaaccagtaggcagcgggagtggctggccctgggttgctctgggaggtcaggatctgcctcactctacccattccaggagcttggatttatgtggcaccctggccaccaggggcaaagcctcaggccttttgctcatcctatctccaggcatgttaagctcactccatctatcattttggccagggcttcctaacctgtgaagcaactcagcctaagctattaatgggttatagtggataaatatgtaacaagcaacctcctcccacaacccttgacctatggcgatggtaccttaatacaccttcaagtccttctcccaaagtcataattaaaaaataaaaccaaaagactatgaaaggtggcactgtttatgtgtgggttctagctagggttaaaataaaatgaatgaaagttcttctctgccagccttcctaagaacagcaactgcaggggactgacttcgagagtcttatctattgagtgtcttctagaatcaaacccttcatgaaggcatcagctttgttttgttcaccactgcatcctcagtgcccagaacactgcctggcactgggtaggggtttagttggtatttgttgagtaaactaatgagagtatcaggctgtgtgctcggtgttggcgctccagttgtggtttctgcccttaaggtctagcccagaagaggaaactgcagatggtgagatggtgcagtaagatggggctgtgctaggcccagagctcgctcacaggagggcatgaatcgcatcatgcttgggcaagcagaggaggctttaagcggggaaggtacttaagttgggtcttgaagtatgattctcaaggggaaggtaggctatgacgtgatctgaggtgtataaagtacaggtaggtttgggagagcttggcttaaagaggagttaccatttctgcccctggagtcagattctggctccttccttcctttccttccttccttcccccctccctccctccctccttccttccttccctcccttactcccttcccttccttccgtccctcccttccttccttccttcccttacttcccttccaccctccctcccatctttccttccttccctccctccctcctgtctttccttccttcttccttccttccttccctccttcctttcctcccttccttccttctttctccttccctcccttccttttcttccttccttcctccctccctttctctttcctcccttccttctttcttttttctctctccttctctttccttccttctcttctcttctctctctctttttttccttctgacacagcatctcactttgtcacccaggctggagtacaatggtgcaatgatagctcaccgcagccttgaccccctgggctcaagcaatcctcctgcctcagtctcccaaagtgtcagaattatagatgggagccactatatctggctctctggccatttctgacaatacaccagccccaggacttcagcaactccagctcgtgtcttccactcctctgttccccatctcactctcactggccctccttggctccagccaaagttatcagggccttgcgttgccactgcgggtgtttgttttcagatgatagcattcgagggggctcgactcaagaacaccaaccatggataagggctggaagcaatggtgtcccggagctggctcagacttgcttataagaggtgattgttaaatatttagacatcttgtcagccagttattagatcattgttaggttgaaatcatttgtggtggaaatatttataccccagaaactggcaaacacaacatattagggttcccccctgttttccccagagagccagtttgccagcacaccactggctggaagacagtttatgactgttttcagtattccaggtaaggatatgacatgttgcacaaatggcttgattgtcattttgttaaaataaaatatttaaaagcttgactttaaagcatccaaaaaggacactcaaatgttccacacacatgagctgcctgggtgaccttttctggtgcaatcctcagaataaggcctctccttccatcttggtttatttggagattgcagagaaagccggtaaaatactggtgattttgtcaacactatgctattcaaggacacaaaatagaaagggaagttgggtgctgaggctaatataggactgagttcatcaaaagggccttattgttctcttgatgaactctatcatacatgttgtaaatgaaaagttattgaataaaattacagctaatctaatgctacttttatccatgatttcaagtttcctgtaggatttcatgcaaaaggagagttttgagtggcccagttcactcatgttttgaaagaggacacagcagcccccgagaggaagtcactctgttttggtggtacaactggaaaggaaaaggaaaggaaaactcacaggggaaggaaggggtttttttttttttttttttttgggagacagagtctcgctgtgtcgcccaggctggagtgcagtggtgtgatctcggctcactgcatcctccgcctcccaggttcaagtgattctcctgcctcagcctcccgagtagctgggattacgggtgcccgctgccacgcccggctaattttttttttttttttattttagtagagacggggtttcactatgttgcccagactggtctcgaactcctgagctcaggcaatcctcccgcctcggcccctcaaaatgctgggattacaggcatgagccactgagcttggctggggtttttttatttttaagttaggactctcatctccctctcagggccctttccttgatgaggaaagaagtgaaagtgtccaaatttcattattttggcaggaaataaaaccaccatcgtgagccgggtacagtggctcacacccacaatcccagccactcgggaggctgagcaggaggatcgcctgaggccaggagtgtaagatcaccctggacaacatagtgagaccctgtctctaacaaaataaaaaaagtagccatgtttggtggtgcacgccagtagtcccagctacttgggtggctgaggtgggaggatggcttgagcctaggagtttgaggctacagtgagctatgatcacgtcactgtactccagcctgggcaccagagacagactccatctctttaaaaaaaatcaccatcgtgttcgatgccaacagcacctgaacacaacccacgcttgctagtgtttcataacatgcacctacaggggctaatgtggtttagccttgctggtttctctgacctcatctcctaccacttgccccctccctctctcttttacttcctagaactcaccaagctcagtgttgcctcagggactttgcccttggtactccctctgcctgcaaagctctcgctgcagccagtcccatagctaggcagcgccttctcatgatctgaatagctgatggatcatcccatctaaagcagcccatctgttactcccagtcatatgctattgcattactctgttttgtgtttttcctcgcacttagcactgtctgaaattattttgtattaatagttttctataccctccaaaataataagcaaaatatgggctctatgagagtagggacttggtcttttaaactcgcaaatgtattccctgctccttgcacactagcaggtgtttaggaacaatttactgaatgaataaagggatgctgaccctggtacctaggccctcttttgacctaagcgggtggttttcaaactgaattctatggagggaatggcgccatgccgggagcccggctgggtgggtctctagatctcttttcttttttcattcagaacagctccactaggatctgtttaatatactaagtgttttcattgttcattggacaaagggctcaaagtcaaaagagcaaagccaggtcactgttgaggaagcattgggtggaaggttggacgccacatctttggaagtcctctttaaccccaatacttgtgattccatgaatgggacacaagtcgagtcagctttgatattgagatgcggtggcaagaagagaaggaccatgacagacgtgttctggcgagggagtgggtgggggttccccaagcatgggggtgggggtcttccagagggcggcagcctggttctaagttcttcctgcagctgcctcagctacctgcccctgagtcatgacctgcgatgcactggctgatgcttttagctgaggccacatttgaggatccagcattttccgaccacaactttaaacataatgtttgctcctccactcaccaagagagcaacggtcttgctctctgcggtctcattaaataggattctattttcacagcactcacttttaggacattcttatttgctgttccaggctctcggagaggcagcccaagaggcgctgctgctaaaatgactctgggcacggtagagatggggagatacggaaatgaatagcagctttgtttatttggcatgggaccaggcaagaggagctatattaaaaaataaataaagttccccttctttcctcaagacaaaaaacaaaacaaaacaaacaaaaaaaaacaaacctattccggctgcgtggccaacaacacaatttccctcacagaacagaacagatgtgagtacattgagattaactttgtaggaagaaatttaaaaaaataaaataatgatgagcggtcgtgggatagggctggtgagggggtaatatcaagagtatttgagatgccctcattaggaagccggaaataaaatgaagcaatggcctgagtatggttctatcgacatatagacactctgaggcacccacatatccacagggctcccaagtattcctgattccctctctcgcagacctggcttgaggtcttcccacagtggggaagagataataactattaatagtatggccattctctgagcattcaccatgtgccaagctctgtgccgagtatcccgtgcacaccataatggatgtaattcaccattcttcccactggcttcgcttgtctgagcttcagttttcccttctgtaaatgggtttaatcagattacctaccccagagagctgctgtgacaactgagtaggaaaacgcacatgaactacgaagcacagggcctggcacctagtatgcggtcaataaatacacggtttatgatggtgactattttccgtaaggtatttcaaattcaaaatgttaaaacctgaacccattctctttccccttcaagccattttttcttgattgtacacttcagtaatggaatcgtgataatcttgagttcttttcccgcctggcacagtcagttcccaaattcattcaagtctgccgtttttcatatcactcgactgcatccttatctcattcctcacggccttgcttcctgcctgggtacaaacccttatcatctcttctctgaactgccgcagtttcttcctaatggggccctaatcccccgcttccaacccccacccctctcttctcttcacaccactgccaggacgccttttttcccttatgaatctgaccatgcctattctttgcttgaaacccaccagtgggtctctctcaccaagaagataaagcctgtattctagagtgtagcatgaaacactctcatgatctggccccagtctcactttctcttcctggcctcactccagcccagggcttgtccacactggcttcacattagcatcaccaggggataatacaatgccagcatctgggccttactccagtcaatcacattagagtccctgggattaggccctgggcagaagtggaatttacaagcttcccgggtgcttcgaatgcactgccagggttaagcatcgctgcttccccccattctgagcagcttgcttgggcctttatgcttttgtgtgtaggtcctgctgtgttggacagtttgctctgctttttctacctgcgatgtctccttatctttggagacacagctgaagtttcccacctttatggaagtcttccctgggaccccctcgaaggggctcctgttgcccatgacatttcctgctatgacaatgtaatcatttgcttgcatggctagattcctgctagaaagggacccccttgggaggcccaatgtccattcatctttggatcctcacactgttgtggttgtctaagtacagcgtctacacacacttacatgtttttttgataaatgaaaatatcattggagatttgtcctccatcatgactctaactggattctcagctcttggcttatatttctgctttagagtttattcattctgccttgatcacagtacattgtctacatgatcttcctccaccacctgtcctcactctgggagcttatttcctaccactttttacctcaagcactcactcctgctccattggcctcctccctgttccttgacctccctgttcctgccccagggccttcgtctgtgctgttccttctgctgtcatgcccttcctccacatgtccacatgactcactctctccttcctttacatggcacctcacagaaaggcttctctgatcacattcgtcacactctgcctcttacttggtgtctttctttttcagagcccttctcatctcctgatatatggaagatttatttgtttattcttttcttcatctgcttccctccatagcatgtaagctgcatggggcagggacttgattgtgtttgatattgcatctccagtgcctagaatagtgcctggcatgtacaaagtgcctggatgctataaatacttcttcaatacacgaatgaatgaagatgatttgctttctagtaagccagtattttctttctttccttttcttttctttctttctctttctttctttctctctctttctttttctttctttcttttctttctttcttgctttctctctctctccctctctctttctgacagggtcttactctggggcctaggctggagtgcagtggcatgatcatggctccctgcagcctcaatctcccatattcaggtgatcctcccacctcagcctcccaggtatccaggacaacaggtgtgcaccaccacacctggcatttttttatttttatttttagtaaagatgggttttgccatgtagcccaggttggtcttgaactcctggactcaagctatccacctgcctctgcctcccaaagtgttgggattacaggcatgagccactgaccctagtcaagccaatatttttcaaactgtgagtttgaaattggtcatcaaatcaacttaatggatcacaaccaacattttaaaaaataaaatacactagaactgaagatatcacaattccttgaacatagtaagggcaagtattattctgtaaaacttatcttggtcaatatacagtatctagcaatcaggtggcaagacaaaatgtattcctcattggggtttattgtacacatttttggaaaagcattgtgttaggccagagattggcaaacgtttcctgtaaagagtccagtggtaaatattttaggctttgtaggacataaaaactattgaactctgattttgtagtgtgaaagtagccacagacattatgtgcacaaataagcagggccatgttataataaaactttattaacaaaatcaggttgtggggctagatttggcctgtgggtggtagtttgccaagccctgcgctagactgttgtctagcctgtgactatgtttcatatgtgtaaattccctttatacaggagctatgtctttttcatctctgaatcttaaccatgagtgtgtcatcccagcatctaacccattgattaaatataacaaatgttcatgaaatgtttgccaatatattcaatgaacatttattgactccttaactccaaacagcttggcaccaaatccatcagtatttgttgaatgaatgtaagagccatgtcttagtctgtctgggctgccataacaaaatatcttagactggataattcagaaatttattgctgacagctctgcaggctgggaagtccaagatctaggtgtcagcagatcagtgtctgatgagggctttatagatggtgacttttgctgcattctcacacagcggaaggggcaagggagctccctcacacctcctacgtaagggcactgatcctattcacgtgggcagagtcctcatgacttaatcacttcccagaggaaccacctcttaatactatcacattgggtattaggttccaacatatgaacctaataatatgtttaggaagacaccaacattcagaccatggcaagccattagtctcaaattctcaaaagcctttgcccctcctccaacccttctgaagatcaggactcagagctcaaaggtgtccttgccccagccgcttgggtcacttgctgccaggggccagaaggggtggtgggaaggtgatgggaacaacagggtttgatggactgtttggggaactgtctaattatcctgcttatcagtgctggttccttttcttagctctttcccttaataaatgaaaactccttctgttgttattgagctcccgggtcactgattcttttgagtcatataaaccacatgtttatagagttacagtgtgaccgtgaaattgaatggaggggaagggaggcaccagagaagtgtcagccttgaaaggcaacactttctcttcccaggcttctgctcattgtgtagggcaaaggacagggctttccgctgtccagggccctggcctaggcggggaggggagctgaggtcactgggtacagcttgtgcgtccacagagcttacagcctggttggggagggagatggccaggctcagagttgaagatgacctagatcatgcgtcaacaaactatggcctgagggccaaagccagcgcaccacccgtttttgtacagcccatgggttaagaagagttttcaaaattttaaacagcagtctccccttatccatggtttcaccttctgtggtttcagttacttgcagtcaaccatggcccaaaaataggtgagtactatacagcaggacatattgagagggagagaccacattcacatgacttctgtgacagtagattgctataattgtctgattttattattatttattattatttctctcttactgtgcctaaatttataaattaaactatatcacagttgtgtatgtataggaaaacccagtaaatgtagggtttggtactgttcatggtttcaggcttccaccgggagtcttggaatgtatcctttgccaataagggggagctactgtagtcgggaaaaaaaatcaaagaacaatattattcgaagtgggaacatgatatgaaattcaaatttcagtgtccatgagtagagttccagtggaagatagcactgcccattcatttacgtattgtctgtggttgctttcccactacaagagctgactgagtagcttcagcagagaccatgtgccctgcaaagcctcaaataggtagcatctggctctgtgcagaaaactttgatgacccttgcctagatcatggtctagcagcattgatatcacctgggagcttgttagaaattcagaaccccaggcaggcgggactgcagatctagtgaatgagagcctgcattttaacaagatcccctgggtgatctgtgtgcacagtcaggcgctagaggaagcaaatcaacatctcttaagtatctacaattttttaagagtgcgttacctcaatcagtctttaggttaatcccttttccactagggacatttactggccctgttttgtttttattttttgagactgagtctcgctctgccactcaggctggagtgcagtggtgcaatctcggctcactgcaacctctgcctcccaggttcaaataattcttgtgcttcagcttcctgagcagctgagactacaggcgcccaccaccacgcccagctaatttttatgtttttagcagagacgggtttcgccatgttggccaggctggtctcgaactcctgacctcaggtgatcggcccgccttggcatcccaaagtgctgggattatagtaggcatgagccgtagctcccggccaactggggctattttacaggtgagaaaaacaaagatcgcacgtcaagtgctcgcccaaggttatataattaggaattggctgagtcagatttaaactcttaggtcctttgtacatcctgtggccttaaccattaagctcaatggtcccctatacagagagggtaaggccaaattcagtgtcttctgtctgaagctggaggcactaaactggctccctaagataccctaagtgggtggctgttttatttgacgtatacagtgtttcaaaagatttttaaattagttgccaatatttaaaaataaggagtctggatattggagaccccagataattgattctttttttctttttctttttcttttcttttctttctttctttcttttttttttttttttttttttgagacagagtctcactctgtggcccaggttggagtgcggtggtgtgatgacagctcactgcaacctccgcttcctgaagaattgaagcaattcttctgccttggtctcccaagtagctgggactacaggcgtgcaccaccaaacccggataatttttatatttttagtagagatgggttttcaccatgttggccaggctggtcttgaactcctgaccttgtgatccacccatctcggcctcccaaaatgctgggattataggcgtgagctaccacacccggcctgagaattgattgttataaaagaatctggaaatcaggcttccctggctggggctaagttgtgacttctcttgcaggatggcctcgaactcccagcctgggcttctgactcatggtaatgcctggtcccttgggcatctgagtttgcatcccttggtcaaaaccagtggttatgcagaacagcctgcaaatcacctgtgcattttgttaaaatgtagattcagagttggcaggtctggaaacaggtctgcattctccctttttttttttttgagaccgggtctcactctgttgcccaggctggagtgcagtggtgtgatcacagctcactgcagcctcgacttcccaggctctagtgatccccctacctcagcctcccaagtagctgggaccacaggcacatgctaccacaaccagctaatttttatttatttatttatttaatttttgtagagacgggctgggggtgggggtgggtctcaccatgctgcttaggttggtcttgaactcctagactcaagtgattctcccatctcagcctcctgaaaacttctgggattacaggtgtgagccactgtgcccagcctatgttctgcatttttaaggggctcccaggtgatacggatgctgccagtacttccatagggcacactgagcagcaaggctaccgaagagctcaggaccgtctgacttcagggcccattgcccagatcatctgaatcggtgcccttggctgctgatccattatctgttagagtggccaggggcctctaggtccttctcttcagctgttagcagcctcctccatcgacctgctgagttgtatagctaccactcttttctaggagtgtcatgacgtgaacaaggctgagcagcattcactggcccatcacagtgcctcctttgtcttccagcttcacccctggaggacagagctattggtatggaggtctcctgggggtgaagaccaagagtcaagcaagagatcagggtctgccgctagtgtcctattgatctggaggcttaatggaggcagatgtttgtattttagaaagctgcttcccctacccccaacacatggacagacacacaccccaaaatgtaacaaacccattgtctgcatcatctgtggtcttcctggaaaacaagcctgccatggccacctgtcggcagtgatgccaactgctccccggtacagctatttccaagattccagagatgtggctggtttcacttccaggaagcttgctggaagactgccctgtgccccacgcctcagtagggcagggggcctcccctggttttaggatcatgcttctcctgcctgctgatggtaagaatgggctgtgcctgagcgttttggctagagaagccctcagcagacatataggctgtgttccaaaaggcctggcagaactctctggagtcttacctcccctggcatggatgccagaatcagtgggaagaacgtgtgcgtgtgatatgcagccctgtgcaaatcatttctcctctttgatctctgcttatctcatctgtaaaatgagtatcattgaaacggtcctcacagggataacaaaaattacatcctgggtcctgtgcagaaatatagttctattaagcactaatcaggccacactttggcccacttccttgtaactgagagtcaggtagcactagatactgaccatctgcatcctcattgttcctatacctaggatttctaaccttagaatcataggtttttgtttacgaattgatttatatccccattgttcctatagctacgatcagtgaccatggactcataaggcttttgtttaagaattgcctaagatgttcttcagatcctgaattccagcaggaaagctaatgccaaccagtttgaaaacaaccacagaggaatcgaatcagcacgagaatgcagtttcttcatttccctgtcccatgactttactctgcactctttgaccaatcaataatcctggaccttggcccacttcaaaccccttgaaatctctagctccaactccctggaggggtggatttgaggtttcctcctgtttccttgtttggctgccgtatgattattaaactctttctttgctgcaatccctgttgccttggtttattgacttactgtgcatcgggcaaacaaacctattatgatgacatcatgacgcaatatccacctcaaaggactgctgggagcctcaaaaatttacaaatttgtgaattgtatgtgactgtctgatgccggggagcagcaaggagcttttggtgattggagtgcggtaaattataatgttccccaccccaccgggtgatgtgtgccccacttctgtctgagggtctcttaaggggaagaattctctggcctttgttagatgcagtgtcaggatggctcaacagacatgaccaggaaaacagagaaaagaaaaaaggaaatcttattgcttttcaatgtctgtcagttaaaaaaaattgatattctttgtttttcatggaggggtcctctgcatcagtgctcataagaacagacaatttatttcttccaaatgagtctgttcctgggcctctgtccctcttgacaaaatggggcttatagatggtgtacactgtctttaaaacacagtgccagagggtggtattctttctttctttttgtttaaatcattcttttgaaatgaatgttcttggttttggcttcaggcctggtgtgagatcagttgaccaaaacacaagagcagttcatatgcaaaaggtcagtgctggtctcaaaggtactgacatgtttcttgggtggggccttgtgaaattctttataaataaactctctaattaagttggctccttgccttgtactgggaagagatgattacaccagggtgttcctgagggtccctggcagcaagcagaacagggctgtcaatctcagtccaaattctgcttcaccacttacctgtgaccttgggcagaatgactcttggcacctctataaaacagggatcagaaatacctctgaaatacctctgaaggttagaggagatgcacaaggcactcatcgtggtgtacgggcacttgggaattgttactatcctccttctctttccttattcatccatgtaatctgctctgagctatcccagagaagcagaggcccagggaagttaagaaatttgctgaaggtcacaatgctggcaaacagttgagccaagctcagaaccccagcatcagttggttttccccagcgccagtctaagcccaaagcccatactctcttttgcttatctccccatctcctatttctatgaagctttagactttctaatgcacttttattcactagctctcccaagtgattgggtgaggaaaatcatgaaataagggaaaattgcatttacaggtttaagtgactggcactggtggttactgctggccccagggagtgtgaggctagcaggatgacccagatttcccaaaccaggccagggctctttccagtgaaccaaggatgatgtgaagatgcaggaggtggcagaggaagatctcaggtagaggtcttagctttaagttcttgtaagaaaaatgacttcatgatctagatggtcctgccttcaacaggtgaacattgggttacacagagaagcaggatgactgtttcagttagctctgcttacgcctagaatcacagcattttagctttcaaaggcaggaagcaaatttaaggactctttacaagatgggcatgtgtgtcttttatatgtatatatacgtatatagacatatatacgtatatatacgtatatatgtgtatgtatacatatatgtgtatatacgtatatgtgtatgtatacatatatgtgtatatacgtatatatgtatatatgtatgtatacgtatatatgtatgtatgtatacgtatatatgtatgtatgtatatatgtatatgtatatatgtgtatatgtatatatgtatacatgtatacatgtatatatgtatatatgtatacatgtatatgtatatatgtatatgtatgtatatacatatacacatatacacacaaacacatgcacacacatgcaaatatacacatgcagttgattctcattattaatgctagttatgccttataaagttgcagtgaacactgaataagtgaatactgacccattgctcctaggagaaatacagagttaagttcctttaagcctctggtcacaatattttcatccagtgattaatatataaacttgtgttatgtgtgtttctgctgaaagacattttaatatatattgttgattcattgacattaaactcaatgccaatggtactgtataactcatgcctaaatgaaacttatctaacacatctatttttttccataaagaatatcacttaggaagactagacagcacttcagcactacacttcgagggcattttaaacagtgaaatcatcaacaaaaagcacaaaaatgcataagtgtggcaccaaatagactgcaagaaggacacttgtttacggtttgagagctgaaaccaggagacagagtgttatcttatttgactcaaatttttcaccactctgagcaggtccgtgaatggccacaaaactgctgcgagatttcattttggggctacaaaggaatttttgcaagtagatgaattggcaaacatggagtctgtgaatgatgaggatggactgtgtatgttgcatttgtggagaggacaacttcattgcagaggatgtgtaaagggagcacagtgcctaaagtcttcattaaggtgtaggggactgatgtatcccctcccgagggcccactgtgctcaagagaagcagagaatacgccgggagcggtggctcacgcctgtaatcccagcactttgggaggctgaggcaggtggatcacgaggtcaggagattaagaccattctggccaacatggtgaaaccccatctctactaaaaatacaaaaattagctgggcatggtggcctgcgtctgtagtcccagctactcaggaggctgaggcaggagaatcgcttgaacctgggaggcagaggttgcagtgagccgagatcacaccactgcactccagcctgggtgacagagcaaagctcttatctcaaaaaaaaaaaaaaaaaaaaagagagagagaagcagagaataaaggaggccagtggccatcaaaagggagtggcaggtaggtgagagaggacatagggagggaggtgggattgagagggagggcagtgggtgttgggggggagggtccctcacggtttagctgggtcccagaactccctccccctgaacacctcgtgggtgggtgcctcttctctgctcacttttggctggacttctgctgatctgtgaaacacagagagactctcctctctggctgtctcccagttgcggggaaccttttgatttcttaactattcccctgggatccattcctctatttgctcattttctaatactccctcttcatcaccgtgttactgggccactgactcccactccaaaggccgaccaggcccggaaagctcataaagtgagtcagcctaagagaagggatccgagtccaggtcacttggagctgatgacggcagcgaacctggctaagccagcgtgtgcaagatgctggcgctgctggaaacatcgcctggaggagcggccctctcatcacccggaacagacaggggtgtctgcagaggtttcccaacctgtcatcattactctagggtcttcttagaaggacaacaaaccctgtacctgcatggcggagtgttaggatatctggtaccatgtcactcccctgagctcagccagactgcctgagggttgtgccccactccaccatttactgcttgtgcctcagtttcctgatctgtaaaatggaagttctaatagtatccacctcatagggttgttatgaggactgcactacatatatacatatagcactgagaacagtgcctgcacagagtaagctctacagaacactggcttttattattgtgattattattgctcgtattattactactcttctcatctctaaagaatggaatggggctgaacgatttcaaaggcctttctttcccttcctgttctgttactggagatgctcccttgctgtgtggccttgggcaaggcccttgtcctctctgggccgcaagttcttatcttctaagtgaggtgctgggagtcaagccctgagagcctgaatctatgaaataaggataagatgactcctagagtggggttcatttgtgactgcagcctctcctggggatgctgaatttccttattttaagaatttactcagaatttaatccaattcctctcccctttttgtctattgtaactgcttatttcatctcagctgagataaatggttaagtaatcaacataacagggtatatttgtagtgtgtttttaaagctcccattcactgaaccaaccaccttcctaagcctggattaatttattctatcatcattacaaccctgggagggagattattgtccctgtgttagagatgaggaaattgaagcacagagaaaagttaagcaacttgcccaaggacacacaaacagtaaatagtaaatccagatttaaaccaggaaccttgactccagattctgtaagctttaccctgacactataccagcggttggccttgagcttaatttctaattctacgatggaaacgctgaggtgggaggcaggtctttactccagaccagactgatgactggctgaaccagggaagaggcaaaagcacctctccataagacatgctcaccagtacatgccagtttacccttgccagtaactcagaagttactgcctctttccatggcattgacagatccaccccttttctagaaatttctgaatagcccgcctcttaatttgcatgtaattaaaatgggtataaatatgactgaaacactgccccgagctcctattctcaacacactgcctgtggggtagccctgctctgcaggaggagtcacggagctgtaacactgctgactcaataaagctgttttctcctaccactggtttgctctcttgctcttgaattctttcccgaacaaagccaagaaccttcccaggctaagtcccagttgtggggcttgcctgctctgcatcaacatgatattgagcaattccttccaatggactgctcataacattggttaataccacagaatctcatcattggaggataatgtaagggtcacctccatggtgtcttaattgggctggtcaggcgactaatgagaagctgaaggaagttatggacccctttcccccaaaatgctcatgtcacatccacacataaacacacatgcaagtttgtctctatttcagggggtgcaaatatctcaggctaagaacctcacataatacttaatctcttgaaactctcaataagtttcctaactctctcatctttgctccaactgtccagtgatgagaacctcttacctaagggggcagtccagtaagatgtgcctctgattgttagaaagttgctctttccacaggactgataacactgattgggtcccaactatgcccactagatgttatgtagaatcggtctaatctatcttcccatgataatcctccatgtttctgaagatgttgttggtcacactctctctagttcttctggggtatatgcctcatccatccactacttggttcattcttccatacattaatttgtcactatccctttcaaacacccaaaattggtgcagcccagaacaccagaatcttctggctgtggactggctagctaggtgcagggctcttgtttttgttctgggtatcatctttccattcatagatcctaagagtgaattacatttttaaaatcttattttgaaatatagcacaactatgaagaagggcaaaaacaaaaaacaacaactcaatgaactatcacaaagcaaatacccacataaccaccccctaaatcaagaactagaactttgcccacttctgcctcatctccatgactatcccttccgtcctctccgaagataacttctattctgacttttatggtgataatctcttgcttttcttagaagttctatcacctaaatatgtatatgagttaatgctatagttaagttttcctggtttttaaattttatataaatggaactatagaaataggcaatcttttgtttctgacttatttcactaaatggtgtgtttgtgagattcattcaagttgctatatgtagttgtagttcattaatttttattgctgaaaatattccatttatatgaatatactacaattgatttatctattctattaaatggacatatgaatttccagcaattataaacaaatctagcataatcatgtgctttggtcacacatgcatgtatttaggtcaggtatacctaaaataactcctgtgcgatcagcttagtagacaatatcaagctatattccgaagtggttgtacaaatttatgcttttacaaaaaatatgtactttctgtgtgtctgttccaactgttccatgttctcaccaacacttagcattattaatctttttaattttggctattctcgtggctataaagtagcaactcattgtggtttcaatttgcatttccctgatgactaataaagttgagcctattttcatctatttatttggcatttgttgattagagcttttggcaacccagtcctcatctgagtcatactaaacttgtagccaagtgaaataaattatgtgacatatgatgctatttaatcatatctcccctactgacttaggttggattttgggtgcccagaacaggtctgaacattcttaataatgacgggccatatttctggtgtgcccacttgtttcaggcactgagctatgtgcttgacatatataatgtctcttaatcctcacaaccagcttacgaagctcatacaattattactatgttcattttacatgagaagaaactaaagtggacgaggcaacttatctaaggtctcacaactattaggtggtgtgacctagattcaaataaacacccttagccaccgtaataacaatctgcttccaaagacggagacatatggctgcatttaaaaaaaaaaacttaaaaattgctaaaaactgaataataaggcaaacatgtcattgtcaaaaggagaaaatagttccaaagtatgacaaagcattaatggttttcgaatgtgagatgttcttacaaattaataaaaggacaaccatctcaatagaaaatggcaaaagttttctggggttagataaatctgggaatttctacttacttttccgttcttgtaccccaacaatgtatatgaccaaatttatgactctaagaagttctgcgctaaaagcttactttaatgcagagttttccaaacctatatgacaaaaatagattttggcatcctgagtaattacaattcttcagaacatgctttgaaacatgttgaactctattatcaccacggcttcctctggtttctagtctggtaaaatctccaaaaaaggaaatgaagttagttttgtgcaatgtttctcaaccttgatactccagtagtcccttcttatctgtggttttggttacccacggtcaactgcggtccagatacattaaatggaaaattccagaaataaacaattcctaggttttgaagtgcacaccatcctgagtagcgtgatgaaatcttgcaccacccagctccattctgcccaggacgtgaatcatcactgcgtccagcacgtccatgctgtatatgccacccacccgttagccacttaggagccatctcagttactggatccattatcacggaatgttcaagtaagtgttattctacttcatagtggcccccaaagttcaagggcactgtgcctaatttataaattaaactttatcataggtatgtagaggaataatgattcagaactatcagtggtttcaggaatccactgggggtcttggaatgtatccccagcagacaagtgggatcgactgtattgacattttggggcagtacaattttttgtcgtgggaagctgtcttatgtactgtggatgtctagcagcatccctggcttctacctggtaaatatcagtactaccccctcactgtccccaggttataacaaataaaattgcctccagacacatccaaatgcctcctgcccgggggcagatcattttcctcccaaccacttgtctaacctgactgacttctaacgaacttatggtatccccatgaatacggaccactgtctaagcactcccaaaatggcacagagtttcaccatattttgatttctgtttctcatgatgtccactatttttttgttttaatacaagggggtaattgttccatctcttgtcttctagtcttttttattttttaggatttcttaaatctccaggcacacccaatcacatgcagttcccctgatgccaggtttcctcttactagttgaattttctcctttcctgggcatgctcttaatcaccagtgccaacaaaggccatgcacttttctttctaaatcaagcctcaattctcctaggatgccttttccaactaggtagaattaagttcttttctctaagcctcataccctctgcacagccttctaccaggcccccaacaacacattatgcatatttacacgactatctctccaattccttgaggacagggactgggtcctattgattttccaattctcagcatagagtaggcaccacaagtataaaagaacaaaggagtgaagtataatttgggataggccagcaattgcatccatgggggcctgggtagatttcaagcaacactgagctcattgacagcctccttaccagctttcttctaggaacgttctctttgcttgtctccaggaggacaatcttcactcccaagagaaggtaaacgtaccacaggtaccagctttgtttttctctctctcagctatgaatatgacatcctttgcttcatcaacttggtcgagactgttactgcaagttttctcattccaaacataaggagaaaagtccttttcccttgatctcagcatttttgcaaacctcagtttattctcgtctgtgtcattttttttttttttaatccttggagtgcaccctcctttccatgttttgggaggcccttctggacctgagtttctcatctctttatttcctttttatgtcctgttggggattattttaagctttaagcacagagtttaattcttgggaatgctttgactttaccagagctgtccaagatagtggaaatgggtggagagaaagatacaggtcagagaaacattaacaaggggcaattgacaagacttggagaccatttggacatggaggagggggagatgactcccaggtttctgttttgaggcaactaaatgactggtggttcctgctgcagagatggaggtcacaggaggaagcagaggaggaggagaaggagggaggtgagggtgtctgggaagatgctgagcctggtctgggatgtttaggctctgaggtttccatgggagacaaagtagagatgtagaggacataactggatataagagcctgatgctctgggaaggaaaaaggtgactcgggagtctgttggcatgcagatggcagctgaagctgaggtagctgacaagagcactcagggatcgtgtgcagatggaatagccacggttagggatgatgcaggaagaaaagttcttgaaggagaacaagaaggagtggcaagagacagagaggaggaaagccaggagagaagcatgcaccagaggccactataaggagagtttgggacagaaggatggccagccactgtaaatgatagagagaggtggattccaataaggacagaaaagtgcctgctgaattagcaacagacgatcattggagaccactgagaggacagctttagtggagtggagggggctggagccatatgcaaggatggaagaggcagtgggagacaagggaattggggggcagacataggatgatggttaaagaggggttcgttcattcatccacccaagcaagaagtggggcagggggcctcctgtgtaccgggtgccactcagggctctgggatacagcagtggaaaaccaggcagaacttcctgccctcaaggtgtgtactttctagagagatatactctgaagggaggactctttttaaaagatagttattagaattatcatttgactgatgaggaaaccaagagaagttagatggtaactcacccaagtttatgaagatgtccaagctatgggtcatgccctgatctgcctgacccattccttttgttttgatttttcttttcttttttttttttggactgaatttcactcttgttgcccaggctggagtgcaatggcgtgatctcggctaaccgcaacctccacctcccaggttccagcgattctcctgccgcagctttccaagtagctggaattacaggcatgcgcaaccacgcctggctaatttttgtatttttagtagagacggggtttctccaggttggtcaggctggtctctaactccgaacctcaggtgatccaccctctttggcctcccaaagttctgggattataggcgtgagccaccacgcccagctgacccattcctttttaggctgcctgaagggaatggagtttagccatacagaaggtataacagggtagggaaaactatagatgtgaggtgaagaattattcacgtctgggtgggcctactcaaagaaaggtgtctacttggcctcacattgtttaactccagctgtactttatctaggacccactatgttgggcattgtgtctgggctcaagtcccctccaatgtgagtggcaggtactgagacccacatgttcccacttgtttctgaaccagaggcttgagaggcaaactgtgggagacccccagtgccccctttcctgtgggactctgatgcacatggtttgactggtgttaaactatctctacatcccattgttgaggccaagtacattgatccaagcaaggttccatgggattagatacagaggtgctggacaaaaagagggtctttatcctttggggatggtgagcttagggaccaggttgggtggctcacagccattttgactgtctgaagaaaatgccaagtagagatgaacagagccaagagataaagagggagatcaagctctatttcatttgaactcctggatccagctctgctgatcttggtagattcctaccaagaactatctcagacatcctaatatcttgaacattttgacacttgcaactgaaggagtctgaccaatatagtttgtcaggatgttatttgtgactgtgtgagatatattatattattgacttttgcagttaactgactctgggggcttcttccatgaagccagatgtgtttgccattttctaggtgtcagcagccctacagtgattgatatggtttgcatttgggtccccacccaaatctcatgtcaaactgtaatcccccatgttggaagaggggcctggtgggaggtgattggatcatgggggcagattttctccttgctgttcttgtaatagtgagtgagttctcacgagatctggttgtttaaaagtgtgtagcactttggccaggtgtggtggctcacgcctataatcccaacactgtgggaggccatgacgggtggatcacttgaggtcaggagtttgagaccagcctggccaacatggtgaaacccagtctttactaaaaatacaaaaattagccaggtattatggcacacacctgcagtcccacctacttgggaggctgaggcatgataatcactttaacctgggaggtggaggctgtagtgagccgagatcacgctactgcacaccagcctgggtgacagagcgaggctctgtctcaaaaacaaaataaagtgtgtagcacctcccctttctctctcttcctcctgctccaggcatgtaagacaggcctgcttccctttcgccttctgacacagttgaaagtttcctgaggcctccccagccatgcttcccatacagcctgtggagccacagccattaaacctcttttctttaaaattacccagttccaggtatttctttagagcagcgtgagaatggactaataaagagatgagtaagacatgggcttacaacatggctgtggagatgatgacagcaaccccttacaaaataattacgctcaataaaatgctctacatctctttctcttcagtcgcaatcatagagaatgattagttagcaattccaggtaggatttggcaaggatggactgaactggagagatgttctgtgcaccaggagctctgaggaaggtgggctgggaggggaaggagatgtactatggattctttctaacactctgttctgggtgcctgtgctaaggggttgatgggtgacagagggagagaggaacaggtagtctggggaatctctgggtgtgtccactgtgagtggaagggctgtttctcatacctttcccattccagcgtgggcatgtcccagcttgactaccaccgggaagtgtggggctgtgacctgaaagagacaagaagaagtcactcttaacatctcagagcattgccaccaaggctctgggtgctgcttgttccatagaaagatccattcatttcatatggtcgggaatccccacaagaatgcttcgacagatggtcacccagccatggcccaaacaccctcaatgtcagtgcttttggcttccaaaggaagctctgagctcttaagaccagcttgtctggggcacccatcaatctgcagagacaatggagtgggacaaaccaactggtttccaatcttggctttaccgctgtgcaacttcaggcaagttattgcattgacccatgcctcagtttcttcatttgtcaaatgaagacgataataatagtatcccacggggttgctgtgaggattgagttattacatgtgtggcactcagtgaatggaagcttaattattcctggcatactcctgtcttacattattctctttttttttttttttttttttttttttttgggacaagtcttgctcttgttgcccaggctggagtgcaatggcacgatctcagctcactgcaacctttgcctccagggttcaagtgattctcctgcctcagcctcccaagtagctgggattacagatgcctgccaccatgcctggctaatttttgtatttctagtagagatggggtttcaccatgttggccaggctggtcttgaactcctgacctcaggggatccgcctgcctctgcctcctgaagtgctggggttacaggtgtgagccaccgcgcctggcccattattctttcaaataacacttcaaccacctgaaaactttcactacttcccttaagcctccccaggccaccatacgaggctgcttaataatagcggccatgtctgcctctggcacaagcgtttatcgactgtaccacataggctccgtgctgagcgactgctctgcgtcacctcccttaggaagccacacttgaggacagcagccttgctgggttggttccctgctgcacccccagctcctagaacacggcctgatccagggaaggtgctcgatactgaatctgtccttcaatcaggcccctcagcaagacctaggaggcatgcatgcttctccctctgacacaagtgagacagttgggctggaaagactgtatacttccccacacacaccatcacttaaccagggagctaggaagccaggactcaggcctgagctttgctttccccctttcatgttgttcatgtgttttttgagggtgttttcttgatttctagaagaacattttgcattgcgtgagggcaaaggttatccctcctagttatgtactaataacataacttccttccatgtggaccattcccaactgggggccatcctgaccccttctcctcggctgtccatggacagcactgtctgtcctcttacactgtgggcaccgaaggaacgcagccttgccctcttgatgtctcttgcctggtctgtcctgtagtagctgctgagcctctgcagaaggccgcctgtgcatcacaaagccattctgtggccctcatctcattttacccccacactggccttagaaggcaaccagggaaagtattttaatcaccattttacagataagaaaatcgagactcaagtgagttgctgggaaggggtggagctgggacttgaacttgggtctgtcagactcccagcttgagttgaacagttcccttttagtctagcacaagagtggcctgcagtagactttaaataatattttttttgagacagagtctcactctttcgctcaggctgaagtgcagtggcacgatcttggcccactgtaatctctgcctcctgggttcaagcgattctcctgcctcagcctcccaaatagcaggaattacaggcatgtgccaccatgcctggctaatttttgtatttttagtagagacggggtttcgctatgttggtcaggctgattttgaactcctgacctcaggtgatccgcctgcctcagcctcccaaagtgctaggattccagccccggaaaccactgcgcccagccatagttttttttttccttgatttcaggctaaaatttaccataccctggtgtctatggtgaatacatacatgttaaaaaaacagcaacatttgattttgattccaaaagcaataagtactcactataaaaactttgcaaaatatgataagattaattgaaagaacctcatcagttaccttattgattgatatatatatcaattaccttaagtataaagacgtcaataaaaatcatcctcagactgctaacagttttggtttattatctgctgctcttttaaaaaaaatctgtattgaggttttcccttgatttgttctgtttttacaaaattgggagtatagtggatatccagtcttggttcttgctctttccacttaatattatgtaatgagaatactcctggtggttattacttgttaacttaataataattatgaaatatttcacatatggaaaaagccttaaagagcaatattacagacatcagcttgcttaagaaataaaacactgcttagacagctgaagcccctgatgtactttttttttttttttgaggcagagtctcgctttgtcgctcaggctggagtgcagtggtgcgatctcggctcagtgcaagctccgcctcccgggttcacaccattctcctgcctcagcctcccgagtagctgggactacaggtgcccgccaccatgcccggctaattttttgtatttttagtacagatggggtttcactgtgttagccaggatggtctcgatctcctgacctcgtgatccgcccgcctcagcctcccaaagtgctgggattacaggtgtgagccactgcgccggaagtcaagtttatgtgtcttgactctccatcaagcactctctccatcaaggcacacttttctgggaatcatatgcatatctggggtgtaataaatgctccccaccccccatgatagtgatcaataaaataatatcaaatcaattgcgtgggcacgactgaatgagaactatgtggctagttatgtgtcttgtgctggttggggcacaccaaaggttgagacaagatttctgccctcagaggatttattatctgcttggacccatgggctgtacaatgaaagagcagagtgaggcagcatggcaggaagctgtggggtacgtcgcggtcatgtgcaagtctccagagcagagcccaacatttttggcaccagggaccagttttgtggaagagaatttttacacgaactagagggggatgaggggatggttttaggatgattccagagcattgcatttattgtgcattttatttctattattattaccttgtaatacatgatgaaataattacacaactcaccataatgtaggattagtgggagccctgagcttgttttcttgcaactagacagtcccatctgggggtgatgggagacagtgacagatcatcaggcattagatttacataacgagagggcaacctacattcctcgaatgcgcaattcacgacagggttagtactcctatgagaatctaatgctgcctctgatctgacaggagatggggctcaggcggtcgtgcgagtgatgcagagtggctgtaaatacagatgaagcctcactcacttacccacggctcaccttctgctgtgcagctctgtttctaacaggccatggacctgtactggtctgtggcccagaggtgggggacccctgctccagaggaaatgaggctctgaccagggttctgaaggatgagtaggttgtgggtggatggatagaaggcacagagttcccccaagggtgaatggtgcagaccaccacggtcttcccgtggggcatgtttagattcttcatgagctctaataaacaaagacccataggaaggaaggatttattttatgcaacttaatatgattttttttttttgagacagagtcttgctctgtctgccaggctggagtgcagtggcacaatctcggctcactgcaacctctgtctcctgggctcaagcaattctcctgcctcagacttccgagtagctggtattacaggctgtgccaccatgcctggctaatttttgtattttcagtagagaccgggtttcactatgttggccaggctggtcccgaactcctgacctcaggtaatccacccacctcggcctgccaaagttctgggataacaggcgtgagccacccctcccggccacttaatatgatttgatctgcaataaatctattttgcaggtgattgctgaacagaattgtatatttgaacggcatgtccttctccagggttcttaaatgaaattggaggaatgtgttcattgctagaaattgtggagtaggtgctgtatctgtatttagagaacacagaaagtcaatctagcaaaatctgagaatgtttaagtaagatatttcacagaaaacatttcagaattcatccaaagcaatggattttcctgatactaggggaaattttcctttgcctttttttttctttctttttttttttctgagatggagtcttgctctgtcgcccaggctggagtgcagtggtgcgatctcagctcactgcaagctctgcctcctgggttcacgccattctcctgcctcagcctccggagtagctgggactacaggcgcccgccaccacgcccggctaatattttgtatttttagtagagacggggtttcaccgtgttagccagaatggtctggatctcctgacctcgtgatccacccgccttggcctcccaaagtgctgggattacaggcgtgagccactgcgcccagcctcctttgccattttttactttgacttgtgggaaacagcaatctttttagaaccacgtatgggctggcaagactccgggctagtgctggggacacagaagaggtaatttggggccagattattgggggcctttgaaaccaaagaggggagttcaggttgcttggatggacagtggggaagcaggatagttctggaaccggggagcgacctgccagctgtgggcaggatggatttgtgctagtggtgactgaagggccaggggccagtttggaattcattctaaagacagtaaatgccactggttgggcctggactgggaagaaatggtagagggagtgggagcactcccagagcttttcttttcttttctttttttttttttgtgacacttctttattgaaataatagtattaaaatgaccagagaaattcaagacaaaaattgtctacaatctcattgtctaaccaaatcagtgtttgcattggtccacattaccttataatttttatatgtccaataaaacccccaggatactttacaacaatattagaggtagaattttgcatctatcttctcacttaatattataccataagtgttttcttatttttgctacagatgtttttattttcttctatctttccccactccccttctccagaccaggtaactaatctcacctccccagtgtgtctggggtgtattcctgcccatccctcaccacgtgcaatctttgcaaacacgtatgcacggatatggctgaggctgatgtttgtatttttgaaaatagctcttatctcttaacgtcacactgtatacacccctcctcccatgtcaataaagatagttctatcccgatagttttttgttttgttttgttttgtttgtttgtttgtttgtttttggagacagagtcttgctctgttgccaggctggagtgtagtgacacgatctcagctcactgcaacctccaactccctggttcaagcgattctcctgcctcagcctcctgagtagctgggattacaggcacgagccaccatgcccagctaatttttgtatttttagtagagacggggtttcaccatgttggccaggatggtcttcatctcctgaccttgtgatccgcttgcctcggcctcccaaagtgctgagattacaggcgtcagctaccgcgcccagccaatcctgatagttttaataatagctgcaccgtctacacatgtacacgtgcactggtttcctattaatagacatttgtgttattcattctctctctgctactataaacgagacttcattaaacatctttgtacacatgtccttatgagctagtgttttaattcctccaggccagtccaggagattttcaaagggagaaccagcagaatttggagacattcttttttttttttttgagatggagtctcgctctgtcgcccaggcttctatttctaaagtcagttgttagagctcaagaaatgaaaccggatgccatggcattgcatacggggtgaatcagccaccatattacctccaggctaaaagtgactgtatttattgtcatgtaagaagggccaggaacgggaccaggcactttatggatggtagcatcctttccctcccccatgttatagataacaaaacacagcgctggccgggcgcggtggctcatgcctgtaatcccagcactttggcaggccaaggcgggcggatcacaaggtcaggagatggagaccatcctggctaacatggtgaaatcccatctctactaaaaatacaaaaaaaaaaaaaaatagccaggtatggtggcgggcacctgtagtcccagctactagggaggctgaggcaggggaatggcgtcaatccaggaggtggagctttcagtgagccgagatcgtgccactgcactccagcctgggcgacagagcgagactccgagactccgtctcaaaaaaaaagaaaaaaaaaaaaaagaaagaaagaaaacacagccctttgcccgaagccagacagtgaagacggtgctgctgccctgtggccaccccacttcccaagctgttcaaatgggtgtcgaaggccattcccacttctacccctttgcaacatgccagcccctccccaaacacagacaggtcacagaggacaaaaaacatcttgccggctattttctctcttcccttcccaacaatagctttatttagttcccctggggatgccgaggtctgcatcagcctctcacaggctccctgtcccgctcacatgccctgggcactccagagtgcagcactgcccagtggcgtaagaggcctgacatcctgtcagaaggggcagaccgattttggaaaacagagatccccacccagataagggctttattcaaaagaacccaaagaaaccaaaatactcggggtagcccagtgcctatgctgggtgttcccttgggaggattagagatgggagtggaagcccaggtcagcctagtcacagccgcatcctcaatccacagagtcagagaaacaggactttagagtggcccggacagcctcccaccaaaggaggcaactcctcctatgttcttgactctgaagatttaaatagtcagagtctggtcctacgtaagcgatgggaaaatcaagatcgagaagaatctggaggaagaaatcaaggactgaagtctgggaagacttccaggaggagctggcctccatttcctgcctccaaggctctgcctgatccagctctcccccatgtcttctgtttcatctcatgtgtctccctcctcctcctcagcccaacccctaactcccagttacagcctactgacctttcagttctttactgaatgtgccgcactccctccagccacggtctttgcgtaagctgttccctgtttccctgagataccctccctcacactcttttctaggccaatcccgtctcatactcatgtctccgctgagataccctccctcacactcttttctaggccagtcccgtctcatactcatgtctccgctgaaattctgtccctgaaaagccctcccgggccactggtctcccgtaggcacttcctgttatcttctctatctcactctgagagttctcttttcctagctctagacaccatttagaattatacattcatgactgggcgcggtggctcacgcctgtaatcccagcactttgggaggctgaggcgggcagatgacgaggtcaggagatcgagaccatcctggctaacacggtgaaacccactctctactaaaaatgcaaaaaaattagccgggcgtggtggcgggtgcctgtagtcccagctactcgggaggctgaggcgggagaatggtgtgaacccgggaggtggagcttgcagtgagccgagatggcgccactgcacaccagcctgggcgatagagcgagactccatctcagaaaaaaaaaaaaaaaaaaagaattatacattcatcttttttttaactgtctgtttctccactccccataggtggtctgaggacaggaactttgcttgttttgtttaccactgcgtctctagactctccacaaggcccggcagacagtaagcgcgtttgttgaatgcgtattagacgaagtctcccacaacaagcgggagaagtcatatgcgaacaggcagagtcaggaggaatgtggtgattcgagtggaaggtttgttggggatgcagccagaattagggcggacagatcaggaatggcaagcttgggaagggcctggcaccagaggtaggagtttgaactgtgtttcatggctaccaggcagccgtcgagggtttggatgcagtggggtagacacctgtagagcaggctttaggaagagttctctggaggctgtggaaacaacagctcatatctcttgagcccttagtgtgtaccaggcatggggctaagcactttacatatatcgccccacgtaagcctcttgatacttcttctgtgaggtagctcctatctttattccattttacatacatggaaataaaggcaaagagaggtgaagtttttggcctaagatcactcagcaagaaagtggaagagctaggattcagccagagccacccgcccctgctccctcctgcatggtgccgcctctggacaactatgatcatccagtgcttcccctgcacccagaactggagcacgtgggtggaggccagcagacctgttaggacaagactggctgcagtcatcactgggcagggcagggcaaggtggcagcagcatggacatgggtagaaggatgccagttcacttctggctcccacatttacagttgtgagcccttgggtaagtcaccgaccactctgtgactcagtttcctcatgccccaaataggaagatcacttgaatcccaccagattgatgggaggaatggacattataatagattttggtcactgaggagttggtcactggatggttgttgctagtggagaggcacaaatgaacttagaggatgcccagggcctggctggcctggagtaggacggcagtctgcccttgctctcatctcctccacatctatgatctcaggggcacggcagcaagtgggggccatgggatgtcaaaggctgatctgttattccttggaagcaggaagggaagggaaggggaaggaagcctgaggcccaggttgtgagcagggagcgcgttacgaagcctttgacagaaatggggcagcccggaaatggggtttgtggtagacatttaaaacagactcattcaacagaaagcacaggagcactcccacggctgcttcataaagcttaaccttgctgtgtagcatctgacagactctccttggaattttaagcacggcacatagagacactcctgtcaggaggaggagcacagacaagatgacctttgcaactcttctgtaattctgccatgttgtgacaaatctaccaaatgccatttagaggagtgaaatgtggaaacgcaaatatgttaagacaaaacttcacggcttacggggctctgtgtggtctgacccctgccttctgctccaaacccatcttacccacactcccccatcagcctctctggcccaggctcagtggctttctccccagcctggatactagtatactagtgctgtcccctctggccacaggggctttgcatatgctgtttttattgcctgcagcgaagtccctctctgctcctcttcattcagccaactctttattttttattttttatttttttaatttttaaataagtatttatttaaaaaataattatttatttatttatttttattatactttaagttttagggtacatgtgcacaacgtgcaggtttgttacatatgtatacatgtgccatgttggtgtgctgcacccattaactcgtcatttaacattaggtatatctcctaatgctgtccctccccgcctccccccaccccacaacaggcccctatgtgtgatgttccccttcctgtgtccatgtctgcatgcttcagaagtcagctccaacatcacctccccaagcagctggcttgcatctccctgcctatgtcacagtctgctcatctgttcttccttcttagccatttcaaatggatctgtgtgattgttgaggaatgtctgactccaagagaagcggtggggcagtgtctgtggctgctcaacattgaaccctcaggcctctcctgaatgacagacctgcctcctgatcccggccgccaggtgctgctgcagaacctgcaactcaacatttccaaacaactgcatgaattcccatcaaaaatgttctcttctcttcttgtaccccaacctcagtcaacgctgccaccacccgcccaggtgcccaagatagagatcctgcctgccttcttcatccttatacctgtcctgaccctggtcaggcacacaggagggcccaggagatgtttgcagagtgaggtctgtggtctccctgcccagcctcgagctctctggccttctaatcccacctctgaactccctgcatcacctccttccaccttaagtctgtcttgggaaaataccggtagcatattcagaaaaatgaaacgaaatctgccctaccaaaaaacaaatattccattatcttacatttcctgtttccctgagaaacggaatagtcaaaaataaacaaactgataggatggcaatatttgtctgcttttcttgttcttgcctgtgtgatgtttatagcatagaacaggttcagtctcccatgaggatcctcctgggtgacactcaccatgcagacaacatctccagcaaactgtggctctggggagggtctgaatgatcctaaatgacggggaagcgaagaccaccctgagccacatggatacacgcagctgcgggatcacagaccctctgggcttgtgctataatttactttttttgacagtcttgttccagctgcatctgtagatggggaaaagcacccctttccaagtcagatgacccttttaaaaaaagtatttattcttgagatggagtctcgctctgtctgtcacccaggctggagtgcagtggtgtgatctcggctcactgcaacctccgcctcctgggttcaagcgattcccccacctcagcctcctgagtagctgggattacaggcacgtgccaccacgcccagctaatttttttgtatttttagtagaggtggggttttgccatgttggccagagtggtctcgaactcctgacgtcaaatgatccgcccgcttcggcttcccaaagtgttgggattacaggtgtgagccaccatgcccagcccatgtcagatgatccttaatatgggaattactgttcttcttagttacttcagaaaatagttgaataacaattacttcagtgtccacatttctttgcttcagttgatgttcacacatttaatgtcttaagattaaagataaatgtaaacttttgtttaaaagtactgttgtcttggtattgcatagaagaaatactgtttgcttggggctgtaggcaaaggcatttcatctggttcagagaaactatttgtgcagtgccatgaaattagctggaagagagaagataggctttgaagccaggcagacttgcgtttaaatatcattagcatcagttcctatggggatatccttggcaagtttcttagcctttccagtctcagctgctttacctataaatgggaataagcacacccaaaatcgacgttgttgtgaagatttgagttttcatgtaaaatacatgttataggtatctggatcctagccagaaactctttggggataatttaaactgatacgcagttaaaatcagtacaactccccctccttcaaattagtacttgatacagtgatagccattgctctttttttcttcttcttttttttaaagttttcctttttgtactatttattgtaaaaatatctgctttgaatttatttttaaagttattaaattgggccaggcctggtggctcacacctgtaatcccagcactttgggaggccgaggcgggtggatcacgaggtcaggagatcgagaccatcctggctaacatggtgaaaccccgtctctactaaaaatacaaaaaattagctggacgtggttgcaggtgcctgtagtcccagttactcgggaggctgagggaggagaatggcgtgaatccgggaggcggagctttcggtgagcggagatggagccactactccagcctgggcgacagagtgagactctgtctcaataaatgaataaataaataaataaaataaaataaagttatcattacattgaataatgaatttgtctgatattccttatataaataatgattctatgtatttatttacctgtgcagaaatatacttaaactctagtgatgacatcctgcctggtgttttttttttttttttaagagacagggtctttctctgttgcccaggctggagtacagtggcgtggtcgtagctcactgtaatctcaaactcctgtactcaagtaatccttctgcctcagcctctccagtaactgggactacaagcgtgtgccaccatgcccagctaattaaaaaaaaataaataaaagtgtttttggaggagacagggtctcgctttgttgcccaggctggactcaaactcctagcctaaagcaaccctcccacctcagcctctcaaagtactgggattacaggtgtgagccactgcacttgacctctgcctggtttttatcctgtaaatcttgcataaccttttaatgtaattcagtgaaatctgacccactatagctgcagagatggtgcccgaatttttaaactgtttacagctgttattttacaactttattgagatacaattcacataccataaaattcacccttttagaaatgtgaaggaaactagtcataaaagaatgtacaattcagaccaggtgtggtggctcacgcctgtaatcccagcactttgggaggccgaggcaggcagatgacaaggtcaggagcttgagaccagcctgggcaatatggtgaaaccccgtctctactaaaaatacaaaaattagctgggtgtggtggtgggtgcctgtaatctcagctactcgggaggctgaggcaggagaatcgcttgaacccgggaggcagaggttgcagtgagccaagattgcaccgctgcactccagcctgggcaacagatcaagattctgtccccctgccccccccaaaaaaagaaatgtacagttcagtgcttgtaggttattcacagagttgtgcagccatcaacactacctatgtttagaacgtttttatcactcaaaaagaaactcggtacatagtaccagtccttccccatttccctggagccccttccagcctctgatgaccaatgctctactttctgtctctacagatttccctattctggacatttcagacacatggactcaaacaatatgtggccttttgtgactagtttccttcactttgtatgtgtgtttttgttttgttttgttttgttttgttttgttttgagacaacgttttgctcttgttgcccaggctgaagtgcaatcacgcaatcttggctcaccgcaacctccccctccagatgtcaagcaattctcctgcctcagcctcccaagtaggtgggattacaggcgcatgccaccacgcctggctaattttgtatttttagtagagacgggttttctccatgttggtcaggctggtctcgaactctcgatctcaggtgatacaaccacatcagcctcccaaagtgctgggattataggcatgagccactgcgtccagccactttgttttgaaggttcatccatgttgtaacatttatcagtgcttcattctttttattgccacacagtattctgttgtatggatggtgtctgacgtttaattatattttggaatgacctggatatgtatttccagtgattgcagaccatgaagacaaatgaatgtctaggaaatctcaagaatatgggtaatactttggcaacgccctggatcagaagtgatttctatacctaactgggcagctcatgaatttttaacatttgggaagaaggagggttttcacaagtgaaccaacactagcttgcagggtcttgcatcctgtgtgaaaccttttccgtctcatccactgttgtatctttggccatttgagagcagagggcttcagctagagttttttttttgtttttttttttttttttttttgtgggggggatggagtctcgccctgttgcccaggctggagtgcaatggcaccatctcggctcactgcaacctctgcctcccagattcagatgattctcctgcctcagtcccccgagtagctgggattacagtcacgcaccaccatgcctggctaatttttgtacttttagtagaggtggggattcactatgttggccaggctggtctcgaactcctgacctcgtgatctgcccgcctcggcctcccaaagtgctgcgattacaggcttgagccaccgcacccagctgagctagatcttttgtacaattattggggtgagcaagatctctgcttctggcttattcttactttgtcatcccatgagcaaggtgataaagagaagggctaagaaggaagaatgttcaggatgctgtgacgtgataagaaacatgcatttagtctgtgcttccagttcctgagacagagctcctaaaagccttgtaatttcctgagtgacaggggtgctgggagcatcttttgttctaatgaggccactcttggtgggctcctggatagcttcaggatgggggctggtcaccagattgaggcttgaatctttcagtcccacccttcatcctctgggaaggagagatgggatagagattgaactaataattcttcatgcctatgtgatgaggcttccataaaaatccctcaactacagaactggagagcttccgggttgctgaaaacctccgtgtgctaggagggtggtgtgccccaactccatggtgatagaagctcctgtccttgggacccttctggattttgccctatgttcctcttcatctgactgttctttatatcctttctcacatctcttataataaaccaataaatataagtaaagtgtctcctgaattatgtgagcagttatagcaaattatcaaatatgagcagggacttatgcgaactccaactccaactccaaccagtcagacaaaagtgtgggtaccatgggcacccaaatttgcaactggcttctgaagtgggggacagtcttgtgggactgagcccttaaccggtaggatctatgctaactccagatagttagtgtcagaattgaattcaattgcaggacactcagttggtatccacagagaactggataatcacttggtatggaaaacccacatatttagtgtcagaagtgttgcgagtagaaaaatagtttcgctttaggggctaaagaaaaaagtatagagaaatactggaggccacgcatggtggctcacgcctgaaatcccaacattttgggaggtcaaggcaggaggatcgcttaaggccaaaagttaaagaccagccaaggcaacatagtaagaccttgtctctataaaagaaaaaaaaattagccaggcatggtggcacatgcctgtagtcccagccacttgggaggctgaggtgggatgatcacttgagcccaggaattggaggctgcagtgagcagctgcaccactgaactccagcctgggtgacaaagtgagaccctgtgtcctaaataaataaataaataaataaatgatatggtttggctctgtgtcctcacccaaatctcatgttgaattatatttcccaatgttgggaggagggacctggtggcaggtgatcggatcatgggggcagatttctcccttgctgttcttgcgatagtaagggagttctcacgagaactgatggtttaaaagtgtgtggcacttcctcttctctctctcctgctgccatgtgcaaatgtgcctgcttccccttcaccctcctaccatgattgtaagtttcctgaggcctccccagccatgcctcctgtacagcctgtggaactgtgactcaattaagcctcctttttttttaataaattaaaaaattttaattaattttttaaataaagtacccagtctcaggtagttctttataacaatgtgagaatgaattaatataatacagtaaataaataacaaataaataaatatgaataaataaatattggtacagggtaccagcagcagggtaggagagagaattatctctagccctccctcctccttgcaaggccattgcctcctcccttctgaaaatgaccttcattttttcaagagctcttatgccatggctaactttgaagccattcagaggggaagctttgagacctggagttaatcctgccaacaaggaaagctaaagttgggtttgccctgatatatttatttccacgtttatttgagttccgtgagggcaaggatagcattcattttgttcattggttgcccaacatggagtaggtcctctgtaaggattcgttgatgggattcattgaatgaatgtaggcacacagattgccgagagctctgtaaacgtcaggtgctgttgttgttaccattatcattattacgtattgactgaactacttttagagtatcaaaaactcccctgtatcaaaccctctgccattccaggtgactggtgctctcttggtgtctttgttgtttttcagccctgcctagggtgcaccatgctttctttagcttctccttcacccttccttccacctacggaagaggctgcaaaacacagtgagcacttaaaactacagtctttgaagccagaccacctgcgcttgaatctcagccctaccactgctgagctgtgtgtccttgggcaagttgcttcacttctctgtgcttcaagttctgcatttgtgaatagggctaaaagtaggatgctccacagaggttgtctcagggtttaaatgaattaaccggcacaaagcactcagctgggcatacagggagtgctggctgttggtattattgttgttaacccaactgcattcctgcaactgctgttctgtctcactccattgctctcagctttccaaagtgacatctgacaggaggaatctgggcttccgtggtagaggctggcaggggtttaatgggctaccggtgtgccatgtatctgcagccgatggatgtgtgtgggtaacagggaaggctgccctgagatactgactctgagcccaaagagagagatggacaagggtcactccagctccttcctgggcctggggtcaggcagctctgtatggacacagtggagggatttgatggtcccttgagggttattgcagctgccaagacccccagttttcttcattacactatattggggtctccccttgagtggacagggggatgaaccctgtctgaccagtggtggggaggtggggactcacaggtcacccagagcagcagagctccttcatcacacaaaggaggaaactgaggcctgggaagcagagactgtgggcaggtcccatttctagtcatcatccttcaatctccacttcattctgcatttgtagctattattaatgatatacaaaaggccgaaggcattacctcaactttataaataaggaaactgaggttcaagcttgtcaaatgaagctgtgaaacccaagccttaaaactcaagagcggggccccctcctcggaatccagaagtagttttgttccatccccagtcttctgcactggaaaaaaaactttatgaagcacatactgtgctggccccatggaaacagcccctgactccaagggaccttttattctgcaaatttcagacaaatgttccaaaaaaaaaaaaatactgccaatggggaagaataattggaaagtaaaaaattacccccaccgtggttgggagccgacagtggtgacactctgctaagtgctgatgtgcgtttaactcctttgatcctcgcaatgactctttgaaagctacagatgggaggccgggtgcgagtggctcatgcctgtaatcccagccatgggaagaatcccagactttgggatccaccgctgaggtgggtggatcacctgaggtcaggagttcgaaaccagcctggccaacatggtgaaagccggtctctactaaaaatacaaaaattagctgggcatggtggcaggcgcctgtaatcccagctacttgggagactgaggcatgagaatcccttaaaccaggaggcggaggttgcagtgagctgaggttgtgtcactgcactccggcctgggcgtcagagcaagacttcatctaaaaaaaaaaaaaaaaaaagaaaaaaagaaagaaaactacagatggagaaatggagtcagggagggaacaacaggggcacagggtcgcagtaagtggcagggctcggctccatccagctctgccacattctggaggaggtgggaaaagtcacaaggtgggaacgccactgctctcagtttagggagtgggctttgagggatagcacgctctaataagggaatcatacttgttctaagaggctggccatgaagcagttttaaacccaccctagtgtgtgaaacatcacagcagtgctcagagagaataacacaggccgctttttcccacctgtctgcagggagtagagatttgggaagaggagggctgttttggggctcgttcacagcacggctgggccagaggaggtcttcctgggagaaagggcatccaggtacgacagggacagcttctcagctgcaaagtggagggaatgcaatgggggcggagtctccctaacttctgtgagtgaacgtgtgggaatggattggctgaaagccaagctgcaagatcctccctaggtcacaactggcctggcagacggagccttcctagacacctgaagttcccagggaatgcaggatgccaggagttccctgcaagctgcgaggagagaggggcattcccctggacccagccaggagccggagtgacagcactgagtttccgtgtagaagcccccagggaagggtgcagagttcgcagggcctgctctcctgcatgggggcaggaggtggggggcaggaggtgaggggcagcaggagcctcgaggtggcgagctggtccatggtcctttactgcaggctcagtggcccaggaccagccaggaaacttccagggtctctgacagaggggaaaacgaccagggcccaaacacgactagggccttatgctaaggacggacatgtctctggctgaggggcccctttgagggaggagtcattgctgacacctggtgatgaaggtcacaattgttcagtgtctccttgtggcagtcgggccacagtagccgcacagacacagggcactgaatccacacgagaggcctgtcatagtgctgagtataatagcatccctagttcacaaacaagaccactgagactcaattcaatagcttgtccaggcaaggctgaagccagaatccatgcttggggaccagatcgcctctctgggggacacagaaaggacccagaccctaccctcgaagggttcccaggctggtgggggcagcagatctgtaagcaaatgatttcaactcagaaatatcaacattcaggagaattacgaagaaaaaatgctatagaagcaaagaagagtgagtgatgacctgtggaggacaggaggttgttggaagaggtatcatggacagtgcataggggaaatttgcactgggctttgctggtcatgcaggagtgtgcccaacagaggaaaggacgttccaggcagaagtggccacaaaggacacaaggcccaaaggtgtgaaagtggttggaggattcaggaaacagggccaaccacagggatggaaggtcaatggaaggcgctgcgggagggaagggctggccaaggcttcacgtttaagaagggcctcaaatagagattcctcaatggtctctccaaatgagggcagacatacaatcactacgccgtgtgtgtatggatgtgggtgtgtgttaaaaacattggcttgttaaacgtgcacattaaagctgtaccacaaattcagttattctgcccccaacaaacttggagcctcaacaaaaaaagaaggaccctcctcatctgtcagaaatacatgctgaagtattttcagatgaaaggacatggtgtcttggattggctttaaaataatccagtgtggggtttggagcggggatgggtggggacgtggaggtgatgagattgggcacgtcctggaactgggcaatgggaatacggaggcgcctcacatcactgactctgcatttgcttacatttgaacatttccatgacacatctttttttttctttttttttttttaaagagagagagccccttgttctgagtcatcccgtggagctcaggatattcagtatagggagagagaaggatgaatgatggggaagcggggtgggacccagggctgaaaggtagatttggagccaaattgtaaaaagcctcgtaaactattctgagaagtttggacttaatcctgcaaatagtgggaagcccagtaaagaatttttagtaggggaatgacaccattagattctcatttaagaaagaactcttctctggctggtgcctggaagatggaaggggtgtgtgtgagggaggcagggttagggagaggaggggttggggtcagggagaggaccctgcccgaggcttgaggagagcttgtcagctgcgagtctaggtgggcgacctgccttctcctctatgctgtttctggagcaagacctcttctatctgccttagtagtaggcactctattgtgattacttatcacaataagtaattccttattgcaatacatcaataaggatcacttagtgactctctctctggctagactaggtgtagccacatcacgcctatctcagtcccttcttatccccggagcctggcatgacgcctggtaataaaccactgttaagtgaatacggaaatgtatagcacagggctctccctaaccactaaatctttgatgatcgaacggacagatccagcacagtgcctgacacagagtcgtagagtagcccctcaataaatgttcgggagccaaactgagctcgtgtgaaattgtaggaaactgatgcctgagtggggcgaggagggttcaggtctccccttaggaaaaagcaatttcctcccagcacgagagcttccaaaaaggcagtggtttccaagctgaaagtggatgggaacaaacaaaccgggcacaaggtttgtctatgaatgtgtcagccctcgaaacttatgtctccacatctctcttggctccttgatgaggtgcttcctccatttcagatggatggtgtttctttcccccttctaaaaaaagcttctagatgcttttaaattaggcaaatgagcaagggcaatgttcattttcccccctttcattctgaaaatgtgtggcgtgccagaaggcctttggacggaatgttcagaggctgcataatagaacaagagaggctgccaagctcctaaatcactaaccagacaatctcaggccctgggacttagagacccctgggacaacatcatgagctgagtccgcaacaagtgaaaagatggcccacagcccaaggtctcagcaggaaaggaagcccctaccttgaacagctgaaagttcaaagtgggccacagctccttaagctcagctctctaggagttgcctggtgatggaggaccttgggcccccttctgtaaaacctcagggagtagatccaatgccaacactttctttgtgaagctcagtttacccactggtaaaatgggtctaagctgaaggactgcaaaataatagagaggactctaaatgcaggtgtttctacctgtgacctcctctctatagaatctgtgaggtccagagccttaatattgagcatttggttgcagggccagcagcatcagcatcacctgggctcttgttagaaatgcagactctcaggccccaccccagaccggctgctcagattctgcattttcacagcatgcttaggtgattcatgaacacgttgaggtccgacagcactggcctacctaaccatatgatcgtggctaagtcgctttaccactggattttaatttattcatttgtaaaataaaagtgattaatttaaatggcacatagacctgaaatcctataaagttcatagcctgctaataaataccagcctttgatcccaaaatgtacataggagttccacccctgttctgaaataccaggttttgaattgggtcagataatcaacagtggaggtcactgggtcagactgtgctagagtgatgtggaggaataaatgtgaacattcattctggagggtctaggacaaacccatttgaaatactgtgttacactatgagcccttaaatctcaaattttggtttggaaaatagaggctcccatagcatcagacacagtcccaactcatgttaggttgattgcactgatagtatcaattactgactttcctgtgtccatgacctttacaacatgactatgcagttccttccaccaagagaaggcatctgttttcccaccctttgaatctgggctggccttgagactttctttggccaaggcagtgcagcagaagtgtcccagttctgcctaggtccccagagacattgcatgtttcagctctctctgggaccccgtaatcattttgtgaactagcctgggttagttggctagaagatgagagaatacgtggaagagtgcctactcatctcagatgagaacagccaggactggcttacagccagctgacctccaaacacaggagagaacccagccaagatcagagctaccgacatgaccacaactgaccaccaatggatgaataagaccagctgagactagaagtgccacttagctgactcatagatttgtgagcaataatacattcttattattttaagccattgagtttttgggtggtttgttacacaccaatagctaaccgatacataaaccttaaagatcttaaatctggttggaaaaaatttcaaacttctaagattgcctctagcttgaaaatgccatggttctttacaaaagaaaggtttagaatatggtgtcaaaagtgaatgccttcaggggctttgagtgaagagagccagtgtactccaaaaactttttttttaatacatatatgaatcacgaaaggcatatttctctacttccacagggaaatcttgtggcttccattttccttgaatcctctcagtttgccttttgtttcttcacttttggtatagacaaggtaaataagacatattttcttttctcctaacgataaggccaaccaaccagcagcctcagtatgggggaacaacctggagtggtggggactggggcaaaataaggagcatatacctggtttcagtgggtcaatggttgtcttaaaagaaagagggccccaaattgccagatcttctcaattttcaagagaacccggaagcctgcatttttggatatgaacttacctaattttcaaacttgagttcaaattgttttaagaagcttcacaacccaaatcactcttttttttttttaaacggaatctcactctgttgcccaggatggagtgcaatggcactatctcggctcactgcaacctccgcctcccgggttcaagggattcttctgcctcagcctcccgagtagctgggactacaggcacgcgccaccaagtccagctaagttttgtatttttagtagagacagggtttcaccatattggccaggctggtctcgaactcctgacctcatgatccacccacctcggtctcccaaagtgttgggattacaggtgtgagccaccgcacctgaccaacaaaacacttttgatggctgaagttggtcaacagctagagactcctggtgtggactgctaatgcagaagggttctggagcaagagcacatgaccatgtaagacatttacaccagatccctccatgctcccttgggctcaccaggagagcagctccagtcagggaagtctccctttgctgggccacttgtgttaaatgatggtactgcagctttaggagggtcaggcaggctagaaccacgctgagggccaggtaaagctggtcctggtaacttttgccttttttttttttttttccattttaggggcctcgctgacctgtgacttcatgatctcatcaccccagtgacttcaggaatgaaccaggaacgtatgctccaattttaccccttattaggcattttagaggggataatgattcactgaaagactggggctctaaaagaaaaaccatctcagatggagggtgggcaggacagcttggattttgtgactgctgtttacatgtgctgtgtgggtgctggtctgcacaggagccctgggcttgggggtgagaaaaggcagatcttgccaagcaatgcacctggtgctgggaactgcttctcggcctgaagcgagtgctgcctttcccaaatttcccttacagggggtgccttttacctacctcacccaaggtctccctatgtgctaatctctatttcagagagagggagaaagacattatggaatctcctctgttaagcgctgcctgcagcatttcgaagttaggtaatatggccatttcacagaggggaaaactgaggctcagagaaattaagagactcactcacgttcacccagctaagaagtggaagagcaggcctcctgactcagatctatgtgtccatcccaatgcccaggtgagccttgctgggtccccagaggtggggctgaggatggtgacagataggtataactcctgatataactcttctgcttgacctgggcacctcatttcctcccctacaggaagggtggagtgagctctgtaagtacaggctaggggtggggaatctgaaccccacaaaaggccctgtttgcttacagtccgcacagctgggctggattagtccagcttcgtaaatagctttcgaaaaccagccgactggaaaagtccactttgtcctggagaatgcacaaaggccccacccacattcatcactgtccgctgccctgtctccccaaccctgacctctctatcttgtggcccatctccacctcctcctctgggcctcagttgaaaagaaaattctcaaatccccgttcccacctctatcaaactcttgaaagacagaactggaaggagaggcaaggaaaaggaaattcctttgaggtcgagctgcctggatttccttctgcatcctgcctcatttccatggagcctacctttattgatttgggacctgggtcttgaggaaactgggggctgaatttggggccattagtgaagcccagggctgcttccttcctgaggggcagctgagggggaggcccagcgctggcctcagaggagagcagctggaatgtgttttctcacagccacacttcggttaacattccagaaagtcagagctgggaggggcttccagattagcaagtccaaaagactctgaccctgggttcccttgttgagctgcaaaggggctgtggatctccagaaatcggatgcaaaaaaaaaaaaaaaaaaaagtttctctgtactagtgaggaattggatttttgcagggagaggcttcaagcttcgttttcttaaagggggctgagacactcttcctacaagttaaggacacaggatgtttctagtttagcttgtgttttatgtagaaggggaaactgaagcccagggaggggacatgacatgctcagggacagagatgtgactgagctcatttgagagcacagcagaagtgtagtttaggggagggaggggcgagggagacttgttcctcctgaacacattttccgaaagtggggccttttcaacagtgtctaccacaacagattagccaaacagctatttaaaaaagggatcagactttaatggaaggagcatgaaagtgagattgtgaaccccagggagagaaagttgtcacagattgtcaaaggatagtttttgcttttttttttgtcatagtttttttttcaatggagacaagatctcactctgttgttcaggctggacagctggggcatgatcattactcacttcagtcttaaactcctgggctcaagtgatcctcctgccttggtctccgtagtaggccaagggactacagatgcatgccatcacagctggctactattttatgttttattttttgtagtgatggggtctcattatgttgctcaggctggccttgaacccctgagctcaagtgatcctcccatctcggcctcccaaagcactgggattacaggtatgagccactatgcctggccaagtttttgaaaatatgtattgtgcacttccagcaatcaatggcggtcttcccataaccccaacctgcctgccctgcctggcctgcaggcctagctggcaaacctggatatgctcctggatccctggaatccagacgtgccacttcccactccattcctctccttgccattcattcagccaatatttattgatttctttaactctgtatgagatgttgtggatacagtggtgaacaaaactccatcttcataggacttattcaaattgaggaaactgatggcatttttctaataataagaggggacttgggtccagggtggggtggctgaactctgtcggaaaaacgcttctctgtgagtgccgaggtgtcccctcccaccataaaagagggttctgacgggaatcgaggacaccaatgcccatttgtttcagattcgacattctccatcttgacagggtccccaaggttctcctgagtccaaggacaccgctgcctcccagctcataacaaacgatgctcacaagcatgccagccctctccttctatgaggcaatcctcggaggcccttgccaagatcaactgtttggacttctgccttgaaaactgatcctcttccgagtccggttattgcttttctgaaacatggggacagtgacatcatcgctccctccctggcttggggatttggtggtcagcatgaagtcagggtttggaacggtgcctgttctctgccaatgcccagggaggcctgggttgggggctctggagtgaattgggcttgctggggaagtccccagaggctgggtggggggtcactttcaaacctgttgccagcatctgggtctgccttgcagtccccaggatgagcagcattctgaggagggctgaactgatggtcggtggatacacacctgcccggtcatacccattgtcaggctattgaaatactttcatctcattggtagtcatttaccgggaagacttcctgccaccttagctgtactggcttctcccctgggccacctctccataactcctaccatctaacacctgtagggacctgtccaacagtactctgattgttggtgccctgcaccacacccatggataaagatttcggcgatgactccaggatcggagtggagctgtgagaacttgggctgggcctttggtcgctgggcacctgctggaaggcactgccatgtggaaagaggcaaggtccacatctaaagttcccaggtctgggccctgccaacaggaattctctcctgccacggtgggacccattccttgcacagtcaccggttagcatttccttgccagaggctgaaaggcatctcaggggtattctagtcctgcccgctaattgtacaaggagactctgcagctcagaaagaggatgtcacttgctcaagtcaaataagctggtgactgacctaagccttctgcctaccctctaggtcatgattctcaaggcacacaaagatcctggcttcagagaccatgaagacattctaaaccttctcctatcacttgcccgctgcctttctatgcccagggttggtttattggcatacccagcactttctctagttgggtggattttagaattagcttcagcagggagcccgtcacagtcatgtcactccataacctggcatgcacctaggtaggaacctcagtctggcagcccacaggctgaatgtggacggatttcactgggaccacccagtgttgttgatttttctttctaatggaatagattgcccacacttagaaagtgagggatttcatacaaaactgtggatatggggctttttggaacaatggttagatccagccatccatgtgccacgtttctgcaggcaagaccagctccctataaatgggacagatgctctagtttgtcaccaaccacccctttctcccagctggctttggtcctttgctggcctgaaggcacccaagtttgccatccccagcccagagttatctcagtacatgacacggccttgctttttgtttcttggaaaagttgtggtccagacggaataaatagaccactttagcatccttcttctttcttcacacattcaggccattttggataagggagatgtttggggtctcaggcttatcacagggacagtcattggttgaccacctggctgtgacttccaagactccttccttctgctcttcccacctcttcccctgacagtgccatgatctccaaccaggctacccaactcctgacattccatggctgagctttggactgagttgtgcagatgcttactgagcacctgcaatgttgacgccatgtgaggattcaagcaagagcaagacacatttttggatgcttagtcttaaggatctaagtcttcttgtgcacaacagataaagatatcgataaccgtaagtcaaggccaaatattctgcatcacaggaaaggtttcaaatcagacagagctcacgtctactgggtggggaaggaggaatcaggaaaggcttaaggaaggaggaatcaggaaaagcttaaggaaggaggaggtgtttgagatggaccttgaaatgaccgtgaaaggaaatggttgggggtagagggaggaaagggtgttcccagtaggcagagggaatggcttgagaagaggctgggcttgggaggagactgtgctgagggtgcctcttgtgcaacacagcttggccagcactcacaggcaggacacaccacacatctttcctgccaccctcctctgcacccagggacacacacgcatctctctgggcaggggcacactcagaagctgagacttctgtacacctcccaaacctgacaacaatgtgtgctgagatgttagggatgatgtgggacctaaggtggcaaagatgggctgcggtcatttctgggagggctctgatcgtcctggtagaaagtggggttagagtaaggcagggaacctgttcaagtgtagacaaagagagaagagttcattaggaatttacagctttgagtaaacaaggaccgagagtaggtttttcagaggggaggaaggaaggcgggaaaggaatgagcacttgggcagagctgagaaagatggggactctgttgacctgccccaaccggggaatggtggagcagggagaagtgtgggagcacagactcatgaacttgccacaaaagaatcacagaatttctgatgtggaagaggctttggtgctacccagtttaacccccttatgttatggaggacactgggtgccccgagtgtggaggtgcgggcaccaatcctagggtgacaaagctgtcgttttatcttccacagcgtctatcatgtagtaggtatttggtgaatgtgtgttgaaacgatgaaaatgttgacttctacctagaactgacctcgtaaaatggaaaatgaggtccctggacacctggttggttggcaataatttccatgtaaaggtgttgtctccctgcacccccagctttggaggaagcccccagatgatgctcttatgcccccacacagagtctcagttcccatggagggcctgccactggctggggcgtcgaggggtagcgagctgtgcggttcctccttccctcccacccaccctcccggggtcgttgtgtaagtggggggtggcagtgcggcgggcgggtaacttcctgcaacagcggcagggctgggcatccgagctggcacggttcaagtgcaccacagcattctgaacatttgggaacacaggaagggctgcgttttttaagctccctttgttttcaaggaggggccagagtccatggggaggaaagaaacaaaaccaggaaaacagatgacttgctttgcaaagatagtgtgtacgtatgctgcagcttctgtgagccctaatgctctgctgtccctctacacttatgcacacctacacaccctgacgcacactcacggcaggtcacaccacacatctgtacttccatctttctctggcacccagggatgcagacacacatctacctgggcagggacacacccagaagctgagactttgatacacagagacacctcccaaacctaaccacagagggacatccacacacatggatgggcaagtgcaatcatacacacatgtaggagtatgaagctttcatgcatagacatccagacacccagacacacacagagacatgctcggaaactccaagacccccatacttatagaaagatccagactgaacacacacacacacatatgcaggcttgtgtacacacccatccctccttgaagaagctccacctgtacaaacacagaggagcattttttttgtttgtttttgtttttgtttttgttttgagacagagtctcactctgtcgcccaggctggagtgcagtggcaccatctcggctcactgcaagctccgcctcccgggttcaagtgattctccggcctcagcctcccgagtagctgggactacaggcacatgccaccacgcccagctaattttttgtatttttagtagagacggggtttcaccgtgttagctaggatggtctcgatctcctgacctcgtgatccgcccgccaaatcccaaagtgtggggattacaggtgtgagccaccgcacccggccagaggaatgtttttaccaggggtccagggagcctgcacaccctcagccctgctctcggctaccagaagagtgtgggcaggcaagatacagttccaaaaggctccacagagaggggccaatgagtccttttgcttttccccttgctcttgatgttagtgtttctagaagcttccatgtagtgccctcatttaatttacaagtttgaattcttctttcacaaggtatattgaagaccattactggaagtgaggggagatgaggaggaagaggccctggaaggacatctgggactggtgggaacagcagctggattacctgctcctgcctggggatttctctacattcccaagctggtgctgacaaagtgcagccccaaagaggctgggccagagagattggaagaagagctctcaggggactcccacaattcctctgacaataaaatgagacagagaggttaaaagtcatttaaatttggccgggcgtggtggctcatgcctataatcccagctactccggaggctgaggcaggagaactgcttgaacctaggaggcagaggttgcagtgagctgagatcatgccatcgcactccagcctggggcacaagagcgagacttcgtctaaaaaaaaaaaaaacctcactcaaatctttagttacaagctggaagatgccgggctgttccccctgtaagctgtgctggccgctggtcatgcttcctgtggtgtgctttcaatttccctcgttgtaactgaaaagtgggggccttttctctgaaggaagaggctgtggtctcccaggtgccctgttgggctctttagggagggacttagacccaggagggctcctagacctgggcaggtagaattgctccgcctgatagaaagagaacctggagctctccaggcaagctgggcaggtttatgagctcggagcctgagaggtgaaaggtgaagctcctccccttctgctctgaccctgtcgtgtgtgctccccaaatatttggtgaaatccatcccactcagaaatcgctttggatttgagcgtgggatctgggtcagtgatagcaacagagcagccctcgaggtaggaacagaggcttccccatcctctaggaatttgcataaatatactaggagattgtgaaatgaatgaaagtccaagaaaatcacatctagatctgtgaggcaaggagagaggcccagatgccatctgggtaacatatgggaaagtgtttgcaaactttaaccactacgtaatgcaaagaatcatttgctatccttgttatatacaaaaatcttcatcaaaatgtttgcattgagcagttgaacctaatgatgaaagaggcttgcaagagcaggctggccgggtcagccctgggacagccagcccaggctttctcaggcaggcggcacggtgtggacgagaggttggtgggcagggattggcttcctgggtccaaacacctcctttttctcttactatctttcttgtctttcacaggtttatttaaacgctttataaacttttttctttgtattttgccagagccatcccctgggagcctctttgcaatcttccttctcgtccagctcccagtataagtcacctccttcaaagctctttgaatcctgatggtgcccttgactgggagaggccacatagtggggtggttaagagcatgtaccctggaggggaacagagctggatgatcagggccaggactagggtaaggagggtgagacctgaaaattaaataaaaatgaaaatgaaatgagatgaaaattaaataaaaatctgagaaggtgcctgcaaactcataaatcaaaataaatattttaatgttattttatataggtatgtatttttttttttttttgagacggagtctcgctctgttgccaggctagagtacggtggcgcgatctcggctcactgcaacctcggcctcctgggttcaagcaattctcctgcctcagcctcccaagtagctgggactaccggcgcccaccaccatgcccagctaatttttgtatttttagtagagacggggtttcaccatgttggccaagatgatctccatctcttgacctcatgatctgcccccctcggcctcccagagtgctgggattacaggcctaagccaccacacccggccgtatgtatgtatttttagagatggggtcttgccatgttacccaggttgggttaaagtgatcctcctgcctcagccttccaaatagctgaggctacacgtatgtcccactgttcctggccttattattgtgatatttaagtaaatgaatatcaatgtaaataaattcatgatgagcaaaatactaatattttaatgaagataggatccaaccctacatttgcataaccctgtctcacttgcctgccctgatctggtcctttctgaatttgtatctcggctctgcctcttattagctggggcacacttttaaaaaactgatgtgcacgttacaaacagtaaaatgaatacttttaaagagtacagatcaataaatgtttatatacgtgcacagctatgtgaccaacacttaatcaagacataggccatttccatctctgcggcaagtttccccttaggacttcctcttgcttaaaatgcttcagtgggtgttcactgctgtcaagataaacatcaaatccttttgtcctggccccttcacaggctacaggtgtgttccctactgttctatgagaagccaaatacaggtgtttgacctgaaaacaccagtatatctagcacatcccactgctgagcctctcaaagctgaccttggctctgaatttaacagcaactcggattccaaccctaatgctaacctcagccagagggatgtttaaaaatacctgcagagggccgggtgtggtggctcacgcctgtaatcccagcaatttgggaggccgaggcgggcggatcacctgaggtcaggagttccgagaccagcttggacaacatggagaaaccctgtctctactaaaaatacaaaaattaactgggcgtggtggcatgcgcctgtaatcccagctactcgggaggctgaggcagaagaattgcttgaacctgggaggcagaggttgcagtgagccaagatcatgccactgcactccagcctgggtgacaagagcgaaactccatctcaaaacgaaacaagcaaaaaaaaaaaaaaaacccagaaaaacctgcagaggccagatgatgtttgagatgttgggtttttgtgcgtattttcaaacgcttgtctctttaggctcttaaatcattgagcacatcctctgtatggctctgcttaaggctgaagtctgcaaatcctaaagttccttcagggacaagaaggaaagaaaaataaattcacctggagtcaagtaatttcacagatctttaaagcaggaaggaccttaggaaaccacctgatacaactctgggcttttgaaaatgagcaaccttagaattgctgtgtctttcctaaggttgcagtagtataataattacaccttttattgagaaactactatgtgccaggcatcaaagtgctttacattcaatatctcatttaatcctcccaccatcctatgaggtaggtactgttaagattttccgctttacagatgaagacattgaggtccagagagggtgagtaacttgcccaaagtaatacagcaacaagcggtgatgtattatttgaacccagcatgatcagactccagcacctccactctaaagcctgcattgcccaagccagagcccttttatgtcaccaaaggcagggaacaaatagtctatgaggtgaggaatttgcctttggctcttagattgacttcctataaaaacaagacagagagtgaagagccaggatctgtgggtttactaggcgccggagggatgctgaaggggaagatagtggctgccctagacagataaaggtcttgtggcaattcctggactgggggcctcattgctcaatgcaggggtattggcagtatgtgagtgggcctgcgcccatatcaccaggcagggtgtggagccctgggtgttccagcatacactgccaggaggggttggtgaatctcccaggacattgcaggcagcagcttaatgttaggaaaagagacttgaactggcaacctggacctgggcttctgctgtccactgggcagtgtgctatggcggtgagagctcttgcctgggcgtttagaatcccagctctgatatttacttgtatgggatcttgggcaaattacttcctcttcagggtctcagtggctgatccacaaacaagacatgtttgtgagtggtgcagtgtttgataaatcctaaactaatgggaagtagcccttgaccttggccgagacaccttccctttggggccttcgatctttcatctgtgaactaatgggagatgggccagagaatctccaaagttccttcctgccctaaggtttgatgactgagaatctgcagcttggtgcttaaaggtttggggcaggaagctaggggcagagcaaaggccctgtaggcattcaacagctgtttggcaatcatcctccttagcctttcccttcctatttacttctcagcctggctcaaggtttgattgtattactggtagaagaattaaccccaaacccagggaaatcgccacttcactgtgttttcttactgtcattttctattaacgtgacgcatacagggtttgcaagacccggggaccgccgtggatgtctttggcttctaattccattagttcatcgggtagttatggataataacacaaagcctgtcatttggccagcacttgagaatttatatagtggtcaagcgtgttcattccgaagccacaacccatgggttctcacccggctccttcacatacaggctcatgacgttaggcaaattacttctccactctgaaccttggtttcctcatttaccaaatgggaggaataaccgcacattgcctcatagggctgctgtaaagatgaagggatttgacgtcatgtacggcacttagcaccagactcatagtcataactaaatcatcagttattatttttacgaaatacttcatattcattttctgacttgtcacacccatcacctccatcagactgctttgattttattatcctgatttttgagcggagcaaacagactccgaggaacagtgacttgtcccgggtcacacagttaagtggcagagcccctggggttctaacctggggttcctgaaacctaggataggccatgttccactgtctccccctgcccttcccccaggaccaaatttctctgtggaataataaggtaatattggatgaagtacccccaaaacaaggttggtcctacgtgcgtaggcattaagaaaagaggggaatcctagttgttgggaaggcctttgggcctcaggtggtacgccgaggacagcagattttgacctccgaggcagagggagcaaggaaaggaaaaataatctttttttaaattttgagacagagtcttgctttgtcacctaggctggagtgcagtgatgtgatcacagctccctgcagcctcgacctcccaggtccaagcaagcctcctacctcagcctcccaaagtagctgggaccacaggtgcgtttttctcaatctcattttttttttcttttttttgtagagaaggatttttgccatgttgcccaggctggtcttgaactcctgggctcaagcaatccatctacctcggcctcccaaagtgctaggattacaggtgtgagccacccaacctggcacaaaaaaaggcatcctaggagggagctggcaccggcaaagacttggttttagaaatggacagcctacttagaggaccatcaagggactgccactgggacagagggctcttggagggaagttgtaagagataaaaatggaagcaatacttgctaacatttactgaatgcttacaaggtactgctctgatcactttatatgtatacgtaataacttactaaagtctcataactgtttttccaggtaggaaccaatattatccctgttgtatagataaggaaactggaggcacagagaggtttaagtaactcatctgtggctacaaagctgataaacagccgagccactattcaaactcagcaggcagtctggcaccagaatctatgttccgaaccactagacgatagcatctgactcaatagaagcatgatcacccaaatcagttcaggattcttggcatcttctgctacttgctgtggcactgaattcaaatatatgttcctgtattcacagaggcaacgtagagatagtgcatatgggaatgaggggttgacggcatccgtgaaaaggattctcagttaagatctaaaatgcatatctgaccagggcactctaactcaaaatcactagacagctcggcaccacctccagaaatacaagtgtctgtggttccctccctgcgaggggtttcatggcttccttgttttttgttcacgctgttccccttttgtcctcttcctcatctaactattacttctctttcaggactgccctccagcatcacctctgccccaggaatcccttcttggtttccccaggctggcttccaggccctttcagtgctccggaatcccttggccacctctgccttcccaccctgggcagaaattatgtctactgcaagcttgtccaacttgtggcccgccggccatgtgtggcccaggacagctttgaatgtggcccaacacaaatctgtaaactgtcttaaaacattatgagattttttttgcaacttttttttttttagctcatcagctatcattagtgttagtttattttatgtgtggccctagacaattcttcttcttctaatgtagcccagggaagccaaaagattagacaccccggtctactgggagaaccctcatgatgttctcaactctgtgcttgttgtatatcggtctacatctcccatccaaatactaaccaggcccgaccctgcttagtttccaagatcagacaagagcggtgtgttaagggtggtatgtctgtaggctaatctttctatctatctgtctgtctatctatctgtctgtctgtctatccatccatccatctatctagtctatcagtcatctatcttctattttctatatgtatctatcttctctcttctttattttccatcttcagaatctggggctgtattcggcctgtatttgggaagctcagtagatgttggttgaactaggtggatgagcattcccagtgactatgatacagggaaatatttactcacagctgatgctgagttaacccactaccttcacttatttcaacccaaatcagaacatatctgcaaacattggggccagatatttgaaatagggacattctaggatattagagcaaatatttcacagatgctttcaaggtccctggtgcaatgctgggtttctgtggatggtgaatttcctggcatctggcttagtactcgttgtagtgcaggtgctcagccggtatgtgctggatgaatgacagagccatgttatacagaaaacgcagtttgacggttgctctctgggactctgttctccaaatcagatggaggagacaactaagtagactcccaaataagccatgcaaatttcccgaatctcccaaactaaacccaaacgttatttttgttttaactgagttaacttttttctttaaaaagacttaagaaagaatgataaaagaaagagaaaaaatcctcctgatccctcctttgcttgaaatcattaggcagctgctcattggaacaaaacaagattttttgaacttgaaactctacatacgtattttttcccttaaggtatcgatgtagaaggaatctgacatttttgaatgttgtccccaaagaaatgaaccatatttgtcattctgaggagcctgctaagaaccctgacaaggactgttagaaaatcagaaccacggccgggcgtggtggctcatgcctgtaatcccagcactttgggaggccaaggcaggcggatcacaaggtcaggagattgagaccatcctggctaacacagtgaaaccccgtctctactaacaacacaaaaaaatcagccgggcgtggtggccagtgcctgtagtcccagctactctggaagccgaggcaggagaatggcgtgaacccgggaggcggagcttgcagtgagccgagattgtgccactgcactccagccgggacgacaaagcgagactccatctcaaaaaaaaaaaaaaaaagaaaagaaaagaaaatcaaaaccattttgctggaactgctgttcccaccttcaccagtcattggtaaaagagaagatccaccttaaaagtggctgtccccatgacgggccattgctagatggacttgacaccttgacctctcgccatctgcaatcagtgaggctcagtaatggtgaccttgatcctggggggataatcatggctgaacactcagtatagttggaactgggcagaaaacttggcctaggatctagacactctgaattatttcatttttctttgccttggatatctgagagccccagaaagagaaacaggctctctaaagcagtgtcaggagatttggacacaggctcagtcctgacattcatttgctatatgatcctgcaatagtcgctcaactcttctgggtttcagctcctctatctataaaatgagatggtcagattagacaggtggctttcagttttttcttttaaagcaattaacctctttttgaaaaaataaaattatagccagtgtcccagtatatagaacagataaaagtaaggccactccaccctgtcccgcctccaccataaacttgactcatcctgcagaggtggaggtgcacagtctgagaaccactgaactagaaatgacagcaacaacaacaaaaatgaatctttactgaatgctcttctgttctacacagggagtccctgcagggaggaagacggttgtgcctgcaattctaaatcttaccagaggcaaagtgaagtgttgtaatagagaaccaatgtctggagccagactgcttggtttccatcctgacactcctgcttgctagctgtgtgaggctgagcaagttttctaacatctctgtgcctcagtttccttaacttcaaaacgaggatgatgacggtcccaccatcatagggatgttgtgaggatggaacagagttattatatctaatgtgtttaaagtctgccgaatacacagtctgcgtggtggatatgtcaggtattatcattaatttccaccttctccctgggtttttggttttgttgtttgcttttctttttcaacttgtcttttagattcaaggggcacatgtgcagctttgttacctgggcgtattgcatgatgctgggatgttgggatatgaatgatcctgtcactcaggtactgagcatagtacccaacagttaggttttctttttttctttttctttttttttttttttttttttttttgagacagggtctcattctgtcgcccagactggagtgcagtggcacgatgccagctcactgcaacttctgcttccaaggcttaagcgactctcctgcctcagcctcttgagtagctgggattacaggcatgtgccaccatgcccagctaatttctgtatttttagtagagatgggggtttcaccatgttggcgaggctggtctcgaactcccaacctcaaatgatccacccgccttggcctcccaaagtgctaggattacaggcatgagccaccgcgcccagcaacagttagcttttcaacccttgtttcccttccttccctcttccctttagtagttcagtgactattgttgtcatctttatgtccgtgagtacttcatgttaggtcccattcataagtgagaacatgcattgtttggtttactgttctgcattaacttccttgggataaaagcctccagctgcatctatgttgctgcataggacatgattttgttctttttaatggctgcatagtattccatggtgtgtgcgaaccacatttcctttatccaggtcactcttggtgggtgtctatgtgattccataactttgttactgtgaatagtgctgcaatgaacacgtgagtgcatgcgtctttttggtagaatgatttgtttccttttggatatatatccagtaatggctgggttgaatggtagttctgttttaagttctttgagaaattttcaaactactttccagagtggctgaattaatttacattcccacagacagtgtataaacattcccttttctctgcagcctcaccaacatctgttgttttttgactttttgataacagccattctgaccgatgtgagatggtatctcatggcggttttgatttgcatttctctgatgattagtgatgatgagcagtttttcatatgtttgttggcctcttgtatgtcttcttttgagaagcatctgttaatgtcttttgacaatttttttaaatggggctatcggttttttggttgttcaattgtttaaattctgtatagattccacatattagacctttgtcagatgcatagtttgtgaatattttctcccattctgtaagttgtctgtttactctgctgattgtttatttagctgtgcagaagttctttagtttaattaggtcccacttgtcaatttttgtttttgttgcaattgctttttaggacttactcataaactctttcccaaggcctgtgtttagaatggtgtttcctaggttttcttctaggatcatatagtttgaggtcttacattgaaatctttttttttgagacagagtctcactctgtggcccaggctggagtgcagtggcgcgatctcagctcactgcaagctccgtctcctgggttcatgccattctcctgcctcagcctcccaagtagctgggactacaggcgcccgccaccaccccggctaatttttttgtatttttagtagagacggggtttcaccgtgttagccagaatggtctcgatctcctgacctcctgatccacccgcctcggcctcccaaagtgctgggattacaggcatgagccaccacgcctggcccattttggttaatttttttacatggtgaaaggtaggagtccagtttcattcttctgtatatgactagccagctatcccagtatcatttagtgaataagggagtcctttccccattgcttatttttggcaactttgtcaaagattagatggctgtaggtgtgcagctttattcctgagttctctattctgttccattggtctatgtgtctgttttgtaccagtaccatactgttttggttacggtagcctcttttgcttctttcatgtttgtgaattaagttccttttctttttttgagacacgttcttactctgttgcccaggatggaatgtagtagtgtgatcatggctcagtggtgctatcatagctcactgcagcctcgatctcctggctcaagtgatataccatctcagtctccctagtagctgggactataggtgccaccacagctggctaacttttaaatatttgttttgtaaaggcagggtcttgctgtgtttcccaggctggtctcaaactcctggcctcaaggaatcctcccaccttggcctcccaaagtgcctggattacaggtgtgagccaccatgtcccttttccttggatgagtgctgttgtcagaatctgtggtttagcactgaattggatgacactttgtgtggctattggatgttataaagtcctatcctcttcccatttgatcctgatccaattcttcagtctcatgctcttgctgccactcctttcttcaatccatatgttctagaactgcaaaactgttctctccacaaacacacaggccactcttgcctatttacctttgcacctgctttcctccaactgaaatgctttttctctcctccctctgcctggtgaaggactatactgtcttcaagtctccactgaggcctcacctcctccaggaagccttccttggtaccccacaaatcacgctggctgcctcctctgcccatactcccaggaatgaacctctattgtagcatttatcccatgcctctctgctagattgtaagctccttggaggcagggactgtgccttgtttattgtgtactcagaatcgaccaaagtgctggcacaagatggctgtttagaaagggttgatgaattaatgagacattattaatctcatttagatcaaattctccttgagagatgactttaagctcctaggccagcggtttttaaactgtgttcttcagagaactaggggttccactaagaagctgcaggagtaccactggggtggagtaggggctaagcagacaggactccagccccagctcctcacagtcttcataaatctattcatatttggccgggtgcggtggctcacgcctgtaatcccagcactttgggtggccgaggtgggcgggtcacaaggtcaggagatcgagaccatcctggctgacatggtgaaaccccatctctactaaaaatacaaaaaaattagccgggcgtggtggcgggcgcctgtagtcccagctactccggaagctgaggtgagagaatggcgtgaacctgggaggcagagattgcagtgagcggagatcgtgtcactgcactccagcctgggcgacagagcaagactctgtctcggaaaaaaaaaaatctattcatatttgtcagatcacttggattcatctttgatttagaaacagagtcacaggggtattataaataagcatcgggcttcaagtcagaaggctctggtttgctacgtagcttaagctgggtgtgcctgggcattcgcccaggtctctgcctctgcagcaaaacgggggtgaccaaaccagccccacagattgattatgaagagtaaatgtggtcccatggcatcatcatatatgagaaacacctcaatacattgagcacgaacgtcaacaatggtgattaaattacaggcagtcaggcagggctggcctctttctgacttgtgatctgaaccgtggagctcacgtgttcagaatgaacatcacctcactggagttcaaggctctgcaactcgtacgtgcttcagaatccctgggaagctaaacgttaagatgtgagttctggggccgggcgcggtggttcatgcctgtaatcccagcactttgggaggctgaggcaggcggatcatgaggtcaggagatcgagaccattctggctaacacggtgaaaccctgtctctactaaaaatacaaaaaattagctgggcgtggtggcgggcgcctgtagtcccagctactcgggaggctgaggcaggagaatgttgtgaacccgggaggcagagtttgcagtgagccgagatggtgccactgcactccagcctgggcgacagagcaagactccatctcaaaaaaaaaaaaaaaaaaaaaaattgcctagggctgttggggtgtgggaggagggaaggggaatgactgcttaatgagtatgatgtttctcgctggggagaggaaaatggtctaaaattgaaggtggtaatggttgcacatatctgcgaatatactaaaagccacttaatactacacttaaagtgggtaaattgtattgtaagtgacttatatctcaataaagctgatattaagaaaacgaaaaagtgcttcctgagaaattgggggacctcattgtttgagaaacccttttcaggggtacagattgcccctccccagcctccaaagatggaaactcccatatttctagagcatttcctctggcaatcctcacactgtgctggttaagtttccggttaaggcccgggtgcggtgggtcacatctgaaatcccagcactttgggaggcagcggcaggtgaatcacctgaggtcaggagtttgagaccagcctggtcaatgtggggaaaccctgtctctactaaaaatacaaaaattagccaggcgtggtgcaagcgcctgtaatcccagctcctcgggaggctgaggcaggagaatcgcttgaacctgggagacggaggttgcagtgagccgagatcatgccactgcactccagccttgggtgacagagcaggactccatttaaaaaaaataataataataaagaagtttctggttaaggattccaaccattttctagaagggcaatccaaatcacaagactgtgaaaggacttaagccacactcagtgtcctaccccaaacttttttattttgattttgattttttatctttttattttatttttttaattgagatggagtcttgctctgtcgcccaggctggagtgcagtggcgcaatcgcggctcactgcaagctccgcctcctgggttcacgctattctcctgcctcagcctctccgagtagctgggactacaggcgcccccaccacgcctggctaattttttgtatttttagtcgagatggggtttcaccgtggtctcgatctcctgacctcgtgatccgcccgcctcggcctcccaaagtgctgggattacaagcgtgagccaccgtacccggccttatttttatttttgagatgggggtctcactatgttgcccaggctgtctcgaactcctaagctcaaatgatcctcccaccttggcctctcaaatactgggattacaggcttgagccactgtgcttggccctatcccaaactttttgatcaggccccctatcaaaaaaaggtgaggatgcatctcaatatatgatgagttatttgttttttaaatctacctaaaagttatacttgtattaatatgctgatccatatggacattataaaatgtgcacacaatttacacttaaaaagatgagcttataaaagtgatagggaaaccttttttgaggaagttatttgtttgtttgttttttgtttttgttttttgagatggaatctcactctgtcactcaggccggagtgcaatgatgtgatctcagctcactacaacctctgcctcccagattcagcaattctcctgcctcagcccctcctgagtaggtgggattacaggtgcacgccaccatgcccggctaatttttgtatttttagtagagatggggtttcaccatgttggccaagctggtcttgaactcctgaccttgtgacccacccacctcggcctgccaaagtgctgggattacaggcgtgagccactgcgccccaccaagggggtgagatttgagcagggatgtgaaggatgtttatcttcacactttgcgttgccacctaatctcgccccacaggggtcaacttaagccttctgccaaaagcccagagagtccttgaaatcactgtaagagatctctaagaataatgagagggcaaattagaaatggtgggggggcggggggggcagaacagacccataaaggaaaagataaatgaagaacagaggagggaaaaaagagttatagtagaaataaatcagaagaccccatgttcaaatctcaatatttcaaacctctaatattttatgattggtatgaatttgaccttgagtttagccttctcatttgtaaaatggaggtaacaatacttctcctataggacagttcagagcatttactgagaggatgtgcttaaagaaagagacaaggggccgggcgcggtggctcacacctgtaatcccaacactttgggaggccgaggcgggtggatcacaaggtcaggagttcaagaccagcctggccaacatgaagaaaccacgtctctactaaaaatacaaaaaattagctgggcacctgtaatcccagctacttggaggctgaggcaggagaatcgcttgaacccaggaggtggaggttgtagtgagccgagatctcaccactgtactccagcctgggcaagcgagactctgcctcaaaaaaaaaaaaaaaaaaaaaaaaaaaaagcgacaagactgactgatgatgggagaaaggaactattcagggagggagatgggagacagagtgcagtttcacaaacatatactgaatacccactgagtgccagaaactgtgctaggcaggacatacaaaatggaatttgaccccattgctaccctttggggagcctgaagtttagcagggagacgagacatataagcagatagtcaaccgtacattcagggttggaggctggcagtggaggggaggggtatgaggtggggaagaggaagagggaggtgctctccaccagtccctgaaggcacactgaggataaagatcctccttctaggtggcaggtggcagctgtcctgccacgtgagtgtcaggggccctgggaatgccttttcagcatgccctggctccacgcaaccctcccaaataaacgccttccagcccagacaagcaggaagtgtgctgggctggcggatggactgacgctcgcacatgcaggcacatgcacaggaaactgaactgctgggcaggttattttcgtttttccctttccaccaccactggagcaatcagtgacattcctttccctcctaaacacacaggtttgtgtaccagagcctggcaggaagtgaagaaatcccctttggaagagcagcagcggcctctatcccgtggcctcctccctcattcctggggtggctgcctggggcctcccagtgctgtggccttggtggcttttctcctctttttctgactgttccgggaaaggggagggatgggggagaacctggttcagacctctttttggaatcacagtgcctttggccctccactgcctagctctctccagcctcagctcagttcttagaatgatgtcgtagcaggaagtggttggggaaagggtggtgagaggtggcagacacaggaggagagaagaggttcccaggtccgagagaaaacaccagaggggagaatccagagaggactcagaggtgaaactgtgccttttgacagtgacattccttccttcaaaacacttttcctaagaaaattaagaaggcaaggacaagggacccagaatcctccctaaagccagacaataattaaatgagagctaagggccgaggagggcagatcacctgaggtcgggagttcgagaccagcctgaccaacatggagaaaccccgtctctactacaaatacaaaattagccgggcatggtggcgcatgcctgtaatcccagctacttgggaggctgaggcaggagaatcacttgaacccgggaggcagaggtggcggtgagcgaagatcgcaccactgcactccagcctgggcaacaagagcgaaactccgtctgaaaaaaaaaaaaagctaagggcccaggaatggcagaaaaatacctccttgcatcttaaacttgtctgctttaataatttactctacaagtaatacgtgctttcgtgtgtgtttaaagcttgtgaggctggatgatatttctgaaacgttaattggtaattgtttccacctggtatgtcctttctcttgagacccttctccatttgagccagtgggctgctctgtggctactgctttgggaaagggacgtaactgctccctgccctctgcttttgtttccaaaacccaagttcttaggaaaaccaaaacaactcttggcataggagacaacagatttgggagaaatacggtatgtaagagcagggcttctcacctctgagatgagacaagaattccctgtctgggggaaaggggaaaagtggaggtaaatccacaaaaggggatattttgggggttggggtggggtggggagctgtaccccacttctggcacgtgagccttggaataaggaacaagtcccaaggagattcaggcaaggaggggacctgcacattacttcctggtagaactatgtcactggagaagcagcaggaccctagagtggaagtggctgcttgaaacgtccaggtggatggagccgcggaaagggtgcctactgaggtatgagaatagcaggaagattcccgtgcatccaggaagagcacagagcagtggagatgcatggaatggatccctggctcaacagcaacctgtgtggaccatcagctgagcacctagtgatggacatctccatgaatgccatttggatcaataacattggtgtttcctcccactgtcttggaactaactcaagctccaaaagtctggcgcaactctaggagaaggggagggaaccccaaactgacttttgttcatgctggtgcttaaaatagaaaatgaaccttagaaaaatccacttacatttcttgcatctgagtccccctgggaaggtggatggagaacctgactcataaggtcgcttatttagtgttggcagtttccataaatatttacacctgagttttaaacatccggctagcgcttctttgtgctagatctttttttggggtaatagagggataaagaaggagcagatgtgttataataggtgctccaagaagattgcaaatacagcgttatgggagcaggaggatgttgagaaagtctttccaggccctgcaaactatgagtaagggttttctcgggtttgagtcaaggattgaggcacttctgatttgactggctttgtgagcagagactgagaaacaatgaaacagtggaaagaatggaggcagatattgcagaaatacaagaatagcaaatggcaaggccccctctccctctgtggttctgttttggatgagatattccagatggagcagctgaagtgagtggagacctgtttggcttgtggaagaggttttggttctgtatggagagtaaaaagccatcaggttaagagacaagggctggctcccctgaagccccctgccttcgctggttgctgggaaccaagtgaaactctcttgaacttgagtcagcttgaatacaggtctgtgtgtccctgtaactgccaaaggcttgggggcttgtctggtcacctgttttatgtgtctgggttttacctctcctacttatattctatgtcatgagaaaactggcctttggtcttggaagacaccacccagaatgcccctctgcatgtctatgagttccaaatccaagggggtcagcagaggagggacccagggatctccagaaggcctcttggtgttcttttctcggagcctactgtgggctcctcttccaaggctacaggcatatgaggtagggacagagatcctggtggcatctgagatgatgtttggtgatgcttgaaaatagcatcaacagactgaatcatatgctgagaaagttatttccttttcagtgaattttctagctttgagatttttctttttctttttttttttttgagacagggtctcactctatagcccaggctggagtgcagcggtatgatcatggctcactgcagccttggcctcctgagttcaagtgaccctcctgcctcagactcctgagtagctaggactacagatgtgtgccactgttcccagctatttatttatttattgagatggagtcttgctctgttgcccaggctggagtgcagtggcgtgatctcagctcactgaaacctccgcctcctgggttcaagcaattcttctgcctcagcctccggagtagctgggattacaggtgcgcgccaccatatctggctaatttttgtattcttagtagagacagggttccatcatattggccaggctggtctcgaactcctgaccttgcaatccgcccacctcggcctcccaaagtgctgggattacatatttttaatatttttttacattttttttgtttttggtagagatggagtctcactatcttgtccaggcttatcttgaactcctaggcacaagtgatcctctcacttcagtctcccaagtagctgagactacagacacacttttagaaaagtttttgtagggattgggggggtgtctcaccacattgcctagactggtctcaaactcctggcctcaagcagtcctgcacacttcagcttcccaaattgctgggattacaggagccgctacacctggcttagcttttgagactctattaaggagagtcttagtttggttcctgtgctctttcaacacctccccaatattagcaaacctcccactttcctggagagcttggagcccatagcaagcaagagtatccagcatgaattcaataatattgctttgttcttgtgttttttatggttattttcttttgtcaggagatactggttttccatttatggtagtcatcagtttctttgaaaataggtttattgaagataaaacttaaaaatatcaataattatatgaattacagtatacacagtacataaatatggtaaaaattgtaaaggttgtgaccaacgattgaagtttgggaaacccggacttaaagttttggccccagtgaaaatcctgcccttagtagtttaatggaaagagcacagcattggttagaaatatctgcatttgagacttggcattgtaaagccctgtttggcacatattagctacatgaccatgggcaggttgattaacctctcaaagcctcagtttcattagctgtaaaatgggaacgtactacctcttgaggttgctgaaagattaaatgacatcacacacacagagtatacgctgagctcagagcctggctcacagcaaacaactaagatggacaattatgatttttgttgttgtccaagaagcacctcttttactctgaggtgccacacaacagtcattggccactcataccaatgaatgtgcattttacattttctccctgcagggagtttggatgggcacaaagtaaaacaaagaggcccctggatgtgaaggagtgtatgaaattaggaaacaagtatctcctgaccacctattacagttgattgtatcatcgttcctaattcttcacccctctctgtatcaatacctgttgtcaggtgacttgatagtttcttccactagaggcggagtatacttcccctatccctaattctgggcttggtcatgtcgcttattttggccaatgggctggtagcaaacgtgacacaaacagtggcttaaaatgtgcttgtgaatttgggtatgaccctcttgtactgctgcagttagccatgtcctggctagcttgctggtccactcagcgccaggcctagagcagccaattcccatctgacctgtgagagcaagaataattattttttaagccgccgagctttgggatggtttattatgtttcaaaattgtgacaatagatgttaatgacccctagtatgtaccgagtacaggcattttcgtatagtctatttaatttcatcttcaaacatccccatttactaatgaggaaattgagactttgagaaagccctcctggtccaagatcacacagaaaggaaacagctgagcttggaggcaaccctgttccaactcccagaacatgctcttcttactacaccacggaagaatggggtggtgggaggcggaacacaacaaaactagcttcgcggctgggcccaaggctggtcccatctagagtcatctttgagaccacaagagccaacatcataaatctagaattgtgacaacacaggatgactcaggcagggggtggccggacagggaagccctggtgaggggctggttggttataaaacctcagtctaaatagggacagggcggtaacattagtagacagggctgggccacagaatcgggtggtttaggacaaataatgacttgaaatttattttggaaaatattttcccaagtgtctcactgggccttgtgggaatgagaaaatcagtggggaaaaagccaggagaaaaagctgatgaggctgagaaggggctcatgactagtaggctttgatttcataaaattcagagcattagatgttcctggaggtgaactcttactcatgctatagaactcttcccccaattcccccgctctgtgagttatcccatcataagacagacgcaatctcaaatttctctattcattctccaacagttatgacaacggccagcattcattgagcatgtactaattgccagacactattctaagctctttacacttttctttctctctctctctctctccctccctccctccctccctccctccctctctctctctctctctttctttttgagacagagtctcactctatcacccaggctggagtgcagtggagcgatcacagttcactgcaacctctgcctcccagactcaagcaatccttccacctcagcctcccgagtagctggtaccacaggtgtgtacctccatgcctggctaatttttgcatttttgtggagacggagtttcaccatgttgccccggctggtctcaaactcctgggctcaagcgatcccctcatttcagcctcccaaagtgctgggatggcaggccactctacctggctgcactttacacttttattggtcctttcaatcttcacaataatgctaagcagaatatgctcctactctttcccattacacaaatgaaggagaaaaacagaggcccagagatatgaactacaaagcccaggctcacacagctggtcagaggcagggttggaactctaatttgagagagtatgctctgactcactatgccgcgtgtttactgtacagcgctgtgacaatctgagtctcttattaaatgagataatgcatgccaagcacttagcttcttgcccagcattagagacggccaaaaatattacaataccaagtattcttatgctgatatgaattttattttattaccttataacagctgcttccccagtcctccttagagaggaaagtctttgtggggaacatacttagcgactggaatagaaggtcagtcacttgagggtctggggtcagctgcagccaagtcctcatgggtgggagggactggggagaagaaattggagatcttggccaactgtgaggggtctgaggagtagagatggaagagcacagaaggccaagaagacagacaagggctctgtattgtgagataagactcccttcttgggacctcactaaggaggtcagtgagtctactaaacacactgctcttggtaggagacattttcgcttgtggcgggagaaagagaagccactgaacttgatgccagcattgatgtgtgtggggtgatggccatgggggagtcagtgccccagaggaagttcagaagaagatgagcccaccagtgattagcaagaatctgagaaaggccagggaattttccttgagttaggaggtctccagctggcctctgggtagggttgttattttcgatggtgtggctaacattcttgcccctctccatgatatgcatgtttctggagcacacaggtggggcatgatcgctcctctggctcccccagggccagctcagtgagaagtcaggaagccttggatgcatgcttgaatgaatgaatgaatgaatgaaaaggctttaaactgaggatggcccatgcttgctcagatatacatcaactcagccacgcgtgataccccatcatcagaggatgctttagacatctcagttcgccatgttcctaacctacaccctgcttcccaaactgctactgatgctgcaaccaactccatctctgggttgatccctcagatttacattaggggatggtgacatatgggcctcgtggctgccctttcctcctcctcacttgggctgacattagagcagtgtggttccaccatgagccaatgtgtggagacattcttggttttcacaatgaggggaattgctactggcatctagcgggtagaagccagggatgcatctaatcctagaatgcacaggctagcctcctgcaacaaagaattagcctatccaaaacgttaatagtgccagagttgagaggctctgcattagagtgtcatggttcagagcacactcactggaatttaagaggactggtttgattccagactctgccacttaggttgagacagagatgataattgtatttacccgtagggtcatcaaaataattaaattgggtctatcaacaaccaacttctgccatctcctccccgctagtccccaccaaaatgcacacactcaatttagaacagccggccagatttcaccatggcccaggaacagaactcgtatgggttctcaggcccagcaggttctttgttccacgagccatgacatgcttcagtccttccacgctaagggcatctttcccacacctaagtctgcgatgcaagtttttttttttttggaaaaaaaaaagttttcttttttggaagaaaacaaagaaacaaagtttctttgttggaaatggctaattgttttgctttcatcgtctcaactggggagttgggtttgaggtaacaaagttgtgaatgcaaatggttatatgcaactaggcaaatcagatttatataaaaatctaattttactaaagggaacactttctggtagggggtgggggaccagcagctcaattctatgaagcagaaggtcagttcctcggaatttatgctataaaaacttaatgcacatccacagaatgtcagaggaagtgatgtcagagaccattttgtcaaaccccctttgagaaattgacgcccaaagggaggggaaacttcctcagggtcactccctagttagcggcagagaggagatcagaaccgagaggtcctgacgccctgtccaggctggctccaccccacagaattgcctctccctaagggaaatccctatgagcttaggtgtcgaggaaaagatgacttctccctacgttttcagttcaaacctcacagtcaataagaatttaatgttcagaatcatctcttgcaatggggctttcattgcacgtgtttttttcttctcttggcctagaggcaatattaaagtaattccctctgtgggtgctttgctccatatgtaaacacatgtctaccatctatacacaggcacatgcatttgtcatttcttcccagaatgacttaatgatttccatgtaacgaatatgttgcagctgttggttttcttgaggctgaagcactcagaaaatcatcagttatcaaattgctttcccatcactgtttttcccaaactggacaaattttctccccctttccttaaaagaaaaaaaaaaaaaggtatgatgggccaagatgatgccccttaggctttagaattttttatcaatggcaaaatcacggctaaaatatccctatcagttattttctgaagttgatgtctgccttacctttaaaaacaaaggcttgtgctgccaatgaaaaatgaaacaaacaaaaaaggtttacaagaaaagcatgaaaaggaggttagaaaacaaggtaagaaaaaaatgctagggcttcatttccagccaaacccagagtcctttatgggaggggctgcagggaccaggctcatggtgtatttttggggaagcttctttggaggagaattttagtttgctcacacatggcagccagcttccagtcagaagatgcaggaggtgaaaagttgggggtcaggaggtaggaagtggctctggggaagacagtgtgttgagttaacgggatcaggaagactcgggtccaaattctcatagccatttagtagctttgtaactttgagaaaatggttcaacttctctgaatctcaatttttaaactccacatacagagccttttctcattgggtactgaggattagaatgaatgcccaataaaggtatctcctctctctccctgcttcctttccagccttttgaagtctgaactctggctgacagaacgtaagaggtaggtgtgttctgtgaacacgtgccactgcaccattagttcctgcctggccttgaccccaacacgttctctgcttacctggaccagggacagaagaagatcttcctgctataatgccagggcccagtacccacactgggggcctgtggtgcccaaggtgtctccagccaggcctatgcctgagagttaagagaggacacagcaacaaggtaagtcggcccagagcagcctggacctgccaggttgcctaaagccctttttgtctgtttcatttcctccatcccaccctgacacccactcccctccctccactttctcagttccttggtcctggcagtttttcttgtctggactgtactactactctcaactccagcctgctcactctgccacatgtgtcttctcaaagcctggctccagtcatacctgattgtaaaacataaatctgtcaatggcgacctcctcaagtgatcccccaaatcaagttccttggctctgcctccaaagcctcctgtggtctggccccagccttatcttctgctggtccttttcctgtcccctacatgccacccagacgggacagcttgtcccctgcctacgtggctcagagcctttgccctggctgggtcactcttggaggtacttctgtctctctccacaccgagatctcattcatgtccatatccagctcagagaccctcacagaagtgtgaaccctactgtgaactgcacatgcaagggaactaggttgaacgctccttatgagaatgtaatgtctgatgatctgtcattgtctcccatgcatgcttcccagcatgcctgcctagccccattccacgtgttcggcagccatttgctgctgctactctgggctggggccaggctccaccccttgatattctaggtgcttgtccctttctctcctgacatttaccatgttctatgtccttttgtagttacttgtgtatatgtcacatttcttctactgttgtcagctcttctagagcaggaaaggaagcctcatgcattttcccctaagctacagggcaagcatagaataatggaagaaattaagacttgaaatcacatgacctgggctcaaagctgctatggtttgaatggatgtgtccctccaaatttatatgttgtagcttaaaccccaaggtgatggtatgaagagatggggcctttgggaggcttcagagagctgcttggctcttccatgtctcatgctatgtgaagacacagtgttcatttcttttatgccacttctgctgcatggtgacagagcaagaagtaccctctttgaggcagagcgtcctcaccagacactgaacctgttagcaccttgaacttggacttcccagcctccagaactatgaaatacatttctattctttataaatgacccagtctgaggtattttgtcacagcagcaggaatggactaagacaggggtctccaaccccttggccacagactgtggccttggtaccaatctgtgacctgttaggaattgggccgcacagcaggaggtgagcagcaggtgagccagtgaagcttcatctgtatttatagcccatttataccccattgctcgtattaccgcccgcactctgcctcctgttagatcagtagcggcattagattctcataggagcgtggaccctattgtgaaccatgcatgcaagggatctaggttgcatgcttcttatgagaatctaatgtctgatgatctgtcattgtctcccatcacccccagatgggaccgtctagctgcaggaaaacaagctcagggctcccactgattctacattagggtgagttgtataattatttcattgcatattgtgatgtaataataacagaaataaggtgcacaataaatgtaatgtgcttgagtcatcctgaaaccatccctccccatccctggtcagtggaaaaattgtcttccacaaaactagtccctggtgccaaaaaggttgggagtcgctggactaagacaaaaccccagcttcaccacttcatgaccattggagaactaatctccctaagcccagttacccactctacttgtaaaacaggggtgcaggattattgtgaaaatgagaggatatggtctctgggaatgcctgctgtgtggtagatgcacaaaaaccagtaagtgtccttcctttagcaaggggttttgaacggctcataatactaccgtctactgtttcacaagtatatccttccattctgcaaatttctgcagggcaggcctcatgtcccctttcagcacagtggttatgagtcaaacatgttgagctccatttctccatttctgactctctcacttacttgctgcttgaccctaggctaaagaagcctcagtttgctcatccataaattgggaaaaataacataatctaccttacagactgttgaaaggattaagcgacatgatgtatatcaagtgcttggttcgtggtaaatctcaacaaatatgagctgctgtatcaggatagtgcttttgaaacatgatgcagaaagagctctcctttgcatctccttggatggaaacttacccagcatgtgcttgtcttggggaggttgaggtttgaggtgttagcaaagcagagtggtagcggatcgatagtcaatgtttaacattcagagtaggactttttgagtctgtaaaaggagtcttgtcttaagcaaaatcagaatttctaaattattttagctgctattgacttagagggagcaggacatagttttttgttgttgttgttttgtttttttgtttgttttttcttttactggatagagcagctacctcttctattcaggctgagcaagaggctgaatgcccgtaggaggaagacgggatgtagggacgtccataccagagacaacaaagaagaaagcttttcactgcagggcattgtgggagggagacagggagagaggggaagagaagtgagaagcccctgtgtccatgaggtctctgagctgaagcattagctaagggcaccttgttgggtggagaagaaagctggcaaggtgggtggggagcttctgccccattctggcttggaattctgggaagagatcccctcccaggcatccccctccctacctactcagcatcagtctcagcctgagagactctgcatttgccctcctgagccaccctcacttctcttttcttttttttctttttgagacggagtcttgctctgtcacccaggctggagtgcagtggcgcgatcttggctcactgcgagctccacctcccgggttcacgccattctcctgtctcagcctcctgagtagctgggactacaggcacctgccacctcacccggctgattttttgtatttttagtagagacggggtttcaccatgttagccaggatggtctcgatctactgacattgtgatccaccctcctcagcctcccaaagtgctgggattataggcgtgagccaccgcgcccggcccgagccaccctcacttcttgtctgacatggaagggaaccagaggctcccataagccactgagagagacacagaagttagctgagactcagacaggggtgctggccaaggaaggttgttgccccagggccaaatggccttcaaccaggggctactcgcattcaggctgcccgggcagagcagagtgggggtggcatcattctgagaacaaggcagggcttggtaagaagggctgcagactgtgctctccggagccttccctatgctcaaaggacacagcagtcatgaactgggctccagtgtcactcatcagctgaatgcttgggacaggatcaggccagcccctcctcaatgcatgccagccaggcacaaccaaagtgcagacctacagccccccagtggagaatggccaaggaccatgtcagaagaccttcaccctctctccccttgccaccctaagtctctggcattgtgctggcaccttcaacaaacacttctctttcccctcctgtcttcctaggacagtgtttgcatcttactcatcctgaatctccctcagtgccctgcagagagtaagtgcctcacacagtgcttgatgagtggatgaaggtagccttgttaaagcctctgggatggatttgaggacgttaaagcatgctgagggggaggagagagaaaaaaggagggtgggccgggagtcgggaggagacctctccattcttacggtgaacaggccaagtgaggcagaaggagaataaaggcagagcctagggtgagggcaggggggctgcagacacccctagagcccaggagaaaccaaaggaaggtggtcggtgacgagcaggtgggagatccctgggtaggctgtgctggcagcaccctgtgctcatagctggtgtttgacttcccccaaccccgctttcgggtggatgggtgagagaagcaagtgtggcccagcaggctgcagagtgagctggtgtctgtgagaggcaggggtcctcctggagactgggccttgggtcagcgagggacatgctgaccctgccttggcaggttagaagctggacagccaacagcccttccatgatggcaaaaatacacatctctcacgctcattgaaggctttgcaatttacacaggctacaggatgactgtggagtcgcccatcccatccataaggcatttcaggcaggtaccatgatcaacagatgctattacacccccatttgatgagtaaggatgttcgtggtgacaatgggatttagggtgaacatggggtcgggatgtgtacaaagatgagggtgcacttaacttcccctactgctaaaaaagggacgttgagctggagcttgaagaatgagctgttgtccatctgagggagaaggcagagaaaggacatttcaggcacagtgaacatgtgtgaaaggatgggggcgtgaggaagcatgttatatgtagcgataataacaggaatgattgctaacatacattgcgagcataccacatgacaggcgctattcggacttcacatactgaactcaaatccattctcacgacagcccagtctggtagatgctagcatgaactccattttatagatgaggaaatgaaggcacagggaattaagtgatttccttaaggtcacaatgagagcaagtggtgaagccaggactggaacctacttgagggacaggcgtcctaacagtgtaaccaaggtgagtaagggctaagcaggaagggatgaagtatgtagctaaagagttggagtggggtgatgataagggaagatatttagattttatctaagaagcaatagggagccattgatggtctaagcagaagagtgttagaaaggtccatgtggcacaggaaagagggaaaattgagagagagaatgaagccacgaagagtgtgctggggagacagccagatcctttattgttacatgtaagccagattgcttcttccatctgggtaaccatcacccactctggagctcaacttcagaacatgggttatactatttcacaaactcttcctgggagacaagagctccacctggacctgtgacatgactggtacctcccacatcacattctgtgcacccagtaactgcatttggctctgttttccttggattgctagacattctttacctctttatttaatgcactaggtggtgttccttttcaccctaggagcacaggatagtattagagtccttgaaaaggtgtttcagatattcttagtgggaagctcttccactgggtgtgaccctggacaaatgcctcctccatactttttttgctgcctgtcttgtttctcatatatacatgggcaggcaacctggattctgccaggcaaccaggtggcaagttggcccgcccaccagtcccagttctaaagagtggctgtgtgactttggtgaagtcactgtgtctccctgggatgcatctgagaggaaggaggctgtactagacaatacaggcaatacctaaactgtcctccagcaaatcatgtttgctgtttccagaatctttacttccgagagtctaattttattcaatggttcaatgtatatttgtagagtcaggcatggtgctagggatatggtggtgcaagatagaaagaacccttgctatcattctcactgatcatattcagtaactgatcccattgaacatccatgcattgagcacccattacctcctggatctgctgctagaggctatgagaggcatagagaagatgaagatatggtgcctgctctaaactagcttttcctccaagttcacctccttaaagggagacagccagctgaatgtggtcaggaggactccttaaaaggcgctccttttgctcatcacctgtaacttcagtcaaataagtagccgtgccaaacctggtttctttggggcatggcttccaggtcagtgcgtctctgacacttgccccaggtgcagcaaagttgcgaaatggacacggctccgtgtgcccaccagatggcggcattctagcatattccctaacagctggggtcattgagaaacagcaccctgtgttggtggagggaagagaccacttcctctctaatccagggcccattcatactgatcttctggaaagttctggggttaaggggctggcggggaaggaatggtggtcgggcaaaggaaaatggcgctaaatgctccatccaacaaacatttctggctgccttctggagctccccttgtccccaagtctgcatttggtgataaatttgcatcattacttatttacctgtcattctcttttgtccagttggcgccatgtctatttcctcttgggatccatggtgcctacgcagagtctggcccagagcaaggattaagggtcttggccgaaaaaaagtgaagcttattttaagcaagaacttaaaacagactctcacctaaggaccaccacccaggcgagggcttcttgggccattaacatccttgacctcaaagatggaaattgcaagatgggagactgagagtgccgttcaaggttccctaatgtgagccattggagacatggctgggatcaactttaacctatctctgctcaaaaggtgtcaaccttgtccacatcagccaggatgtcaaggtggagaggatagaaattccggatctggctgagtctagtgcccaccagagaaaactttggcctttaatctgggatttttacatcattttcttctctaacagagggagagagaggggcatgagttgggtccaccaattgggacaagcaggtccaacctgcttctctgctgtcttcaattccattcagacccctacgccctgctgcctagcacctccaccttcccctctggggctccagcaaagaggaaggcagtcagaaccactccaaagggtccaatctccttgcattccagccctggccaaagtcagcccgggaacaagtggagagcccctcttgaaggaagtgattcagaaaccatgatggcctggcggcccgccgtgactcacagcacatcaatgggggaattgtctgtagaagccgagaattccaaagctcttttctttcctttcttacttactttcttttttttctttctttctttcttttttgccctccccttggcggcattgtgcaacagcagggctgcccagaaacatgtggttttcatcattggctccacagctgccctagagcactgtggagaaaataagatggagagggaacaggatacaaggggacctgtcgcggtcaagcagggtccttctctttccccccacctttcttgtcaacaccaacatcctcaaagagcatctggaacggaagggaatagaattttggatctgggagaaaacttagagtatgtctcatccaataactctatgtacagatgaggaaactgaggcctcaagaggggacgtaagtggcttggcaaatgtccacagccaagttgcatcttgcatcttgctgcagtgactgacttttcttagcctccaagtcaggaaatgtagtttgacaaaggataatttttttccatggaatgtgacagatgaaaagtcataccaagtttagttataaatctctccattgtccctttccccttatctaccagtctagggagtctgttttacccggagtcatctgtggggacacgtgcaaaatctaaaggtctttttgcagttgtcatctgattggtcatctctgtagcatgtgaattaatgtccacaggtttccaggtattccccctatgcatccactcctacctctgcaacgtctccttttcggcattcttttctcctcccttggctctcagatgccttagttctatagggctgtcttatcttaactcatatccatgttcacggtttcagtggctatcattcagctgaggactcccaaatcttatctatagtctgttcatcattcctgagctacagacgtgtacatacagctgccttctcagtgcctttcttggattccccagatggaactcatcatttccctccatagctctttgactactttgattttattaccaagtaactatgggaccaatatagtcagtgttccaaagcacatgctttggcatcttattgacctgggcctgactcccagatatgccacttaactggctacgggtctttggccaagttactgacctttccaagttcctcatctgtaaaatgggggtaataaaaatacctacttcataaggctgtcattaagaggaaatgagttaatacaatagcattaacacaatgcctggcacataataaatactcaattactgctgagctgttatttttattatgtacctcagcatcctcccaacttgagccacactgaattcttagcacttaaaatatttactgaccacatatgtgttccaagcactgtgcgtggtatagaattacatgagtggatagatgaattttctgttttaaaattgccttacaaagtatccccattttacagatgaggaagacaatcactttctgagaaaagcaaacaaccaaccaagagattccctcatgttccttcttactagccaataatttatactgaatatgatgacacagaaaaaaagaaaaaggtaggccaattcatagttcacttttcttttagtccttacttactcaacagtaagcctcaagtagagggggttggaagaatgtgtgtgcatccagaagtgaaataaaaacagttgagttagttttgtgtagcatggttgtgtaagaggaaacccctttcgcttggctctcattttctcttgctgccgccatgtaagacgtgcctttcgccttctgccatgattgtgaggcctccccagccatgtgaaactgtaagcccattcaacttgtttttcttttcttttcttctctttttttttttttttgagtctcactctgtcgcccaggctggagtgcagtggcgccatcttggctcactgcaagctccgcctcccgggttcacgccattctcctgcctcagccgcccgaatagctgggagtataggcacccaccaccacgcccggctaattttttgtatttttagtagagacggggtttcaccgtgttagccagcatggtctcgatctcctgacctcgtgatccacctgcctcggcctcccaaagtgctgggattacaggcatgagccaccacgcccagcctaaacctctttttctttataagttacccagtctcgggtatgtctttattagcagtgtgggaactgactaatacagcatgtaggaactatgaaatatgaattgtgtaattttattgattctgcttatgagttcaatgttttcatatttgcatttaaaattttgcattgcacaatgtaaaagtaaatggtaaaatccacgtgaataatgtaaaatttcatttatttattttacctagaatgatattaaatagcaattaaaacagcattatgacaagtcaagagagagatagtggaaggaaagaaaaagctttatatttagtatctttaacagcattccccccccacactgcacattttgaaaaagggatcctgcaaattatgtagccatccctgactaagatagggaaatgtctttgaattttagacttgagaagagactatgaaaagtctctcagagaaccctgctctgctcaccacccatcatattgtatgtgaagatggtaagagctacagggagtcttaaggtcacacagggagcaagtagataaaccaagactggtgcccatgccatctgactccattccttcctagtctagcattcttcacctaatgtgtgctcttccttctgtcagaaatcccaccttatgacttggagataagatttcccctttgcaattgaaaccatccaatcagtacttggctgatgatgtgcaattgatatgccttccatccaaggccagggagacttggccagcacttggttaaaagtaataaatagttttcaggggaaaatctagtggtcggtgttttagtccttgtctttcttgacctaacagcagcatttatttatttatttattattttttatttccataggtttttggggaacaggaggtgtctggttacatgaatgagtcctttagtggtgatatctgagattttggtgcacctgtcactcgagcagcatacactgtactcaattggtcgcttttttttttttttttttttttttttgacagagtctcgctctgtcgcccaggctggagtgcagtggtgcgatctcggctcactgcaagctccgcctcctgggttcatgccattctcctgcctcagcctcccttgtagctgggactacatgcgcccgccgccaagcccggctaattttttgtgtttttagtagagacagggtttcactgtgttagccaggatggtctcgatctcctaacctcataatctgcccgcctcggcctcccaatctgcccgcctccacctcccaaagtgctgggattacaggcgtgaaccactgcacccagcctaatttgtagtcttttatccctcaacccctcccaccctttcctcccgaatccccaaagtccattgtataatgtataattcttttttttttttttttttttttttttggggcagagcctgttctgtcacccaggttagagtgcagtggtgccatcccggctcaccacaacctctgcctcctggttcaagggattctcatgtctcagcctcccacatacctgggactacaggcatgttccaccacgcctagctaatttttgtatttttaatagagacagggttttgccatgttggccaggctggtcttgaactcctggcctcaggtgatccacccaccttggcctcccaaagtactaggattacaggtgtgagccaccacacctggcccattgtatcctccttattatgccttggcatcctcatagcctagctcctactgatgagtgaggaacatatgatgtttggttttctattcctgagttacttcatttagaataatggtttccaattccatccaggttggtgcaaataccattattttattccttcttatggctgagtagtatgccacagtgtgtgtatatatatatatatatatatgtctcacatatatcacagatttttatccattaatttcattgattaataggcatttgggctggttccatatttttgcaatcgcgaatttttagcagcagaatttaatcacgcgctcttctgtcaaacacttgtgtgttttggcctttaggacccaacctcctaccttgctggctgccctcccttagtcgccatcacagattcccctctaccttcctgactttgtatcagtgaagtgtctcaggggtcagctctcagaccttttctctttttctgtccatactcattcctttagtaacctcatgtagcctaatgactcttaacactatctatatgctgattactcatctgtttatacttctagccctgacctctccctgaatttgttctaacatgtctaactgctttcttgacatctgcactctgatgtccaacgaaatcacacactatatctgtaactgagcccttgaatctctcccccagctccaaactaagtcctacttcagttaatggcagcatcaggtcaaaaccctgcggctctctcgatgctttctcatctttcacacctcacacccaatccatgagcaaatcctaaagcctctaccttcaaaatacattcagaatatggtcattttcctccaccattactgcttcaccttggcccaaatcacctgcattatgccagtaatctttgaattggtctcattttggtcctcatctctcttttacccagaagggtctccttgaaccacatgtcggagtgtgtcactcctctattcaaaacctctcaatagtttctcatcttactctaaagaataacccaaaccaaacaatccaaacaagccacagagcctgacaccttcaggcattcagcaccagggccttaggacttcagctctcttgtcccctttgtcccctctctcactctgctctggccatgtggccaccttgctctttctccaactcactgaggactctcccacctcaggcccttcgtccttgctggccctctccctggaatgctctttccccaggaatctggaaggctccttccttcacctgctatgggtcattatcagatgtaacccctctcatgaggccttctctggtcaccttgtttaacacggtggccccttctgctccccatgcacattccccatctcccatccctgatttttattccccataacacttatctccatctaacatgccatccagttgactttattttctgttcattgtctgtttccccctgttggaatgtaattgcttatttgtctgtcttgatgtattttgttcaaatatctaagcctgccttgcggtgggctgtggtctaggtaacgtgatggccaaggatttaccaaggaataatgaaccacctccccacctcgaccaagctccatgaatgtctttgactccatattccagcctctacctggaatgtcctttgtctgtttctctgaataccatgccatccttcaaggtctggttgaaaagtgatctcctcacggaacacaaggtcaggagatcaagaccatcctggctaacacagtgaaaccctgctaaattatgcccctttttgttttattcacagactttagaaccaaatctcagggtaacatacaatctctcttccttccttcctcccttccttccttccttctttcattccttctccctcactcgctcactcctttcctccctttctttcttctccattccttcttcctcactcactcactcccttcctcccttgcttccttctttcattccttcctccttccctccctcccttttcccctttctttattctctctttccttccatcatgctttctgtaagactgaagggatcatactatgtatatcatttgacacttagtttttttcaagatgacaaatatcttgacatatttttctatcagcatggagtagcctatagtactaaagtttattaaaccagtccctgctgatcacacaaaagtattgcaaagtcttggcacaccgtctttgcgcacttgcttaggtttttgggtaggtcaagttccttaaagtgggttgctgggtcaaaggggatgcacatttttatttgctaaattgctgggttgccttccaaatccataccactgtatactttagtatgtgttcatttttatctccataaggcatcatataagagagctctccttctgcatttcgcttaggtttttggaaaagtcagtcagtcaaggtcgggaaagaagaggatcggggaaggcttccaagaggagatcacttttctttctttctttctttttttttttttttttgagacggagtgtcgctctgtcgcccaggctggaatgcagtggcgccatctctgcccactgcaagtccgcccgggttcatgccattctcttgcctcagcctcccgagtagctgggactacaggtgcctaccaccgtgcccagctaatttttttgtatttttagtagagacggggtttcaccctgttagccaggatggtctccatctcctgacctgatccgcctgactcagcctcccaaagtgctgggattacaggtgtgagccaccgtgcccagcttggttgttctttactttatgctccttcacagtgtttgaattgtatacaaggacacttttaccacaaggagtgatataaatgtttgaaaaatcacctcatagatgcagaagtagaaagtatacatgaagagtgtaaattaggttttactttaaaagtaatcaattgtttagaagtgttaaaagaaactgtggatgagaaattgttacataattatcttttcaatgaaaatgacaatcggttttgtttctcctcacttccctcatttccacccccccttccttcactcctttccccttctctttcccctcttcctgtggatgagaaattgttacattgttattaacttttcagtgaaaatgacaatcagttttgtttctcctcacttccctcatttccccctccctcctcccttcactcctttccttcctttctccttctccttctccttcccctcttccttcctcctccttcctccactcctgccttcccttcttcctttgttgttgttgttggaagctgcaggtatttcaaggagccagcaatcccattgcagaactgatgtaaagggacaaacagcatggaattagggctgcccaaatgtaatgcatgctacacaaaaatgcttccagtgagtctatctggggatgagggcagggagaaggaggagaggttggcttttagcttcacattgtccccgtgcactcctggacctgccatctgccccatgaaaggccccagtgttcagattgctgctgctgaaactccccttaggatccagagtgggcccaggctcatggtgccctgtgttctaggagccacatgatttcacaaactcacccttgcatttgctacattcttagcagggccctggaacaaaggagacattgaataaaaacagttgacatttattaagctcttactattatgtgcctgacttaggttaccttttataatttctcaaaaatcctatgaggcaggtatgtaaatctatattttgcagatacagaaactgagtcataggctaagtaatttccctaggcttgtagatctgggatttgaaaccgggttcttagacactaaggctagtcctttaactacaccctttactgcctccaaaaattatgctgaatgctctgatatcctgtcaggagatatttttctctaataaaatagggatgggaggtgtgtgttgggggagctttctagcttgtcattccttatgggccagcaggttggtgaggattagagccaaaaatctttggggaagagaaaaatggaaccacatggtctgttcctgaattctccaacagatccctttggtcccaacctccaagtgaggctcattttattctctctagctctacaccctagtttctctagtctggagtcataaacactggtgtatgcaaattaggcatcagagaaaagagaacggctgtcatttgctacagttggagtaaccactagaaagatggcagaatctgtaaaagaagagagcgtaacagtgacagcagtggtgggcacgttgttctctaatgcccattctcccttgttccaaggttaaagaactcctaatttgtagttttatacatggttgtccagagtcaaagctgtatattccagactgttttcaaattagttgtgaccatatgattatgttctggtaagatttaagtggaagtgtcatctgataactgctgggagacttccttaaaggggagctgacacattctctcccttcttcttcatcctttttttctttctgttggatgaaatgcaaattggatggcaggatagggcagccatcttgggccatgaggcaggtatagcaatacctgtacttttcagataagaaaactgagaatgcaatgaaagcaacaagctagaaggagcttgactccctgaggtcttcatggaacagtgtcattatactagccccagactgcttacttctggacttcactgcataagaaaattaaacttgtatcatgtttaaggaatattattttgggcctctgttacttataccatttaatatacatcatcacggcttcttggaaagatttcaggattggtaatgagatttgttttatttccatcttttcccctaacttatacgcttctaagttctcttgttcccaatatagaaattagaactagatatatctccctcacatgcattgatttttatattatagtaaaatacatttcataaaaaggagaatagagatttgaggagtggatgcaaaaaagtctgagggaatctgattacactggtatattttggctttaggctataggggggaaaagatcctgcttaattaattaatataagcacaaaacagagagaggactaaacattcaagttacagcaagaccagagatgacgctgggtctctgaaaagctggaaagagggatcctctgctgtcttttaaccctacttctctatcgtttggattcagtctttgttatggtggctttgtggcttcttccacaaggtgagttttgtatcttacagcattaggcattgaagagggatgactccctttcttcactgtgttgtgaggactctcagggaagagctctaactggccaatcttggttcagctgctcttcctagagacctatcagtcattgccaggaagcatgctgtgcaaaagaactgttcttgcagaatgtggctatgtggattgtatataacgagcatgtgctacttttatcgtaagtgatgagatgaatgtctggagtaatgaggtaagtgtgggacgtggtgagtaggagggcatggggggattccccccttcctaaaaaggcagcgctgacagcacacccctaggtgaccactacggtgttcaggaatagcaagagcaattctattgacaacggagcaaagtgtggtggaccgggtggaagtcaagagacgcggattctagccctggcaccataaggctatttggcacatctctttcttcagtgggtttcagtttacatatctgtcaagtgatgatgttaaatcagcttgaactagctcagttgttttcaaagctttttttcgtttacagaggtttttggggtgcacgggttagggtgctagggatcctcactagatcttctttccattctctacaaaacccgcccattttcacacacacacatgcattgacatgcactcttacacacttacactcccacccatgctcacagacacgcacacattcacacacctcctgtcacatacacacacccatccacacccacactcactcttacttcctcacactcacctgcacactcacccgcatcctctcacactcatctcacatacatactcacacatccacctaaaaacacaccctccctcacacacacagacacacccacacttacacacacatgctgtcgcacaggtgcacacacgctctcacacagctacacatacacacgctctcacgcaggtgcacacacacacacatgctctcaaacaagtgcacacacacacgctgtcatacaggtgcacacacgctctcacacaggtatacacagacgctctcacacagatgcacacacgctgtcacacacgctctcacacaggtacacacacgctgtcacacaggtgcacacacatgctctcacaggtacacacacatgctatcacacaggtgcacacacactgtcacacaggtgcacacacacatgctctcacacaggtacacacacacgctgtgacacaggtgcacacacatgctctcacaaaggtgcacacacacgctctcacacaggtacacacacacacgtttagtgtatgcggagtcacatttgttctccagagcttgttggattggatgatctcaagtgtccctcacaagttgtcagcatccatggttccattcaaattgggaactttccagggctttgagccctaaattctggagagcagcagttgttacagagaaaagtcataatgaagagagtctaaacaactatgagagactttctaccctcctttgctcttcctcccccatccatcatggccagcaggctggatgtgtcctttcactagtgatggaagatgaagaacatctgtagatccccagggagctgcatttattaaaaaaaggtctgcatagccctattaatacacaatgtcttgcccatccttgggtccatctatacagtactgatccatctttaaatacatgtaaaaataaaatgcaaacatagactatctggcaaaaaataaaataaaataaacatatgtagatgaggaataaaattaagatgcatggtatgttttggtttggagctattttctcagtgagcagtcatcaacgtaaagaaactgatgtgtggggctgcagagaaatggattgtcttggagaagtctcagcgctaagtctggagtcaggcgtcttctcccctagggcaggcgtgtgcttccaatgttcctgctgcttggggcagggatggccccgccatcctttgctatctctctgatctctccacaggctgctatgtccctccgcctggtgagaagacagactctcccaagcacaaagccacgctgtcttgagctggcaccttcctgcgtgggaacccagaatcactctcaacagccctttctttctccctgcagcctgtgagctggggaggcggccagctggggtggttcccacattgggaaactgggtggggcctggggagccccttggccttggtcaagaagacagacccaggcccctccctgggaattctatataatgcagaagtggcgagagaaagagagctttgtggatagtcgcctcccattgggacatggattggttggccactgacactgatgtgggcagaaagaagtggctgttgttttaccagggctggcacctggttaggacgaagcccaatcccctttggagggccccagatggggttcaagtgggaaaaaatggatctcagggcagaatctgatgtggattcctttctgggtgttgagaaaaacacaaaacaataactcttcctttcgcctcctaagaagtagagtaggttcagcaggatgaagtaggtttcttgggattaagggtacgtaggatgttctttggcaaaggtggtcatgctttgaaaagggggatgctctatggagctgtggggaagagggaagaggggaggttcccacatatagggtgttgtgtcagaaatgaagagggaggcagcttctccttctcactatctcctcccccagagagggacccagcaacaggagtcaagggttgcccccaacacagctgagcaggaccctccccactgtgggtcttgatgcagagcatgggccgttcggtcattgctcatggatgaaacgaccaagcctgtcttccatgtttcaggcacaataaacaaaagatttcaagaagctcactgtgtactagggaaggcagacaagccaacaggcagatctgacatagtgccatgatagtggaaggttggcagccatgggagttcccaggagggtaccccatcaggacttgaagagccagggatggctttctcgaagaagcaacatttaagctgagagttcaaagatgagttgggcttagtaggatgaaggaggggcagagggcgtattctagacagaaggatttgtacgtgcaaaggcttagggatgagagaaagatggtgagttccaagagttcaatacagctgaaggttttaccatatgtaagtttccccaaatgaggtgatgccagagaaatgagcgtggctctgatgtgcaggacagtgctgaggagtataggctttctcctgggggcaaaatcatctcctgggagccctgatgggtatggagctccagagtggcacgattgcatatgagctactctgtggaggtgtggctactctgtgggagttggactcaaaggggataaaggcggggaggctgttgctgaaacccaggcaagagatggcaagggtgagagtgtggatagtggcacaggggatgagtgctgggcgggaggggacccagatggagggcagcctagatatgggtagagtaggagagggagaaggagaggtcaaaggtgatgccaggtttctggtttagcagagactgagattgttttccaagctgtgaattgcacccttccagctttggggaagccatttctgcagccagtcttgtctgtccctgagggatggttctggagttggaattggggtggggaggcacctgggaaagcgatgttccagtgaagatagtggttctgatagaaagactggactctggcctgcatatttctcatgcaaatctgccaccagaatgttcatgtcatgagggaaggggctttgcttctgttgctctcttttgttgctacaggtaatgcctatcagtgctaccagttgctagaataatgcctgacacacaggagatgcacagaaaatgtttgttgaatgggaaaatgatggtggctacaggtacaggattgggaggatttaccattccaatcagtgaaatgggataattggatccctttgatatgtcacagaaacgtcactctggtttcatcattccttttgatcaaagggtgtctaagatggtgcagatgaccagaatggagagaagagggataatggcatatgtatgcacacataggtatgtaaagtacacgccctagatgataaacaaggcaatacaccatgatggcttaataactttcattgtcatcatcagcatgggtatcatcactagcttagattgatacgttaacgtgtaccagacaccaaaacttgcaggcgctttatatccattatctcatctaatcatcacagaaaccctatggaggagatcctgatatgattatagttggactcatgcagaaactgagactcagagaggtaacagatgtaccccttgtcacacacctcagctgtgccgggccaaagactgaacaaagttctgtctgaatctaaggccactttccctctagtctgagctcttgtttcatggaagaaacaaatgtggttgaaacagaaactaagggtagagagaaaactctgcaatgtcccaggaggcctctaggcttggtaagagtccaaatgggccggagaactttctttggcccctgacctggctggacagtcagcaggaagtatcatcttgtgggtttgttaatttaccatccacctgcaagccttgtcatatatcttccagacctgacaaaataccctcacctaacacaaccctgtccctgcttagtgtcttttcaaaaccaccaccaaatctgagaagggagagccaggagcaggtgcttgccacatcctctcctggaatcagagtgcagcaacctagggctattgttcagctgcctgggacatggcatcttaggttggggtgattctggagacactgggagaacagctggcatctggtgtgctgggctgatgctggagacgttattaaaaagtgcctcctgcaactctgcaccccaccccagccccagagtaacacgtttcttctctttcacccaagggtaccctctagagagatgagtcactgctctgggggaaggaagttactatggaatctgaaatcaaaggtgccacttttctgattattaagctaaaagccagctaagctgcatgaaggctgacagattcagttgcctgcttttgttgtttttcttctcactgcaaacttgatgaaagtctccctgagctagcaagtggtgagcgggaggcgagatcacagacagggacccagtgagggggaagaatttcccctttgccctaggagccccatgatggccagaaacctaatcagagcccaggtgtcctgctggttgttgttgcatgaggaccacaggtgaactggaggaaatatctgtcttgaagacattgttcagctctcatccaaactgtcattgtgtggtcaatcccctatccagtggtccagagcactcttccagccccaggatgaactctgaggatgaagactacctgaaaggtatctcagatgatactggcccaagatctcccctgaggagccctcccagcccctgcccttgagcacgcatattgaaagaaatactgtctttcatcaagcctcctgccttcacagtgtgtccacttgcagagaagttctgggtgatgtccacaatgctggttcattaaggcgtatcccagggctggaagccagtcatctcatcagggaagggcctgggtatttggaaggagctgggcagaggcaacaggtcccagacagcttggcaccagcaagatttatctgggcatttgtcagaactgccagcttgtcctagggagtttccctatctgcagaagcccggaggtgtgtggacagggccctgtgccagtgcaaagtctcagtgtagcctccttctccagacaaacaccaatcataacagcttccattttctttcttttcttttctttctttttttttttttttttttttttttttttgacagagtctcgctccgttgcccaggctggaatgcagtggcacgatcttggctcatgcaaactccacctcctgggttcacgccattctcctgccttagccccccgagtagctgggactacaggcacccaccaccactcccggttaattttttgttttttttttttttagtagagacggggtttcaccgtgttagccaggatggtctcaatctcttgatcttgtgatctgcccacctcggcctcccaaagtgctgggattacaggcgtgagccactgtgcccagccaacagcttccattttcaaatggcacccacgtgacaggccttgtgcggccagctctacatgatgtcatcacatccttctgagaaccatgcacacttgggaattattcttcccctttacaggtgagaaaacaaagctcagaggctggtgacagaaccacgacaatttgaagtctaatcagtatggtttcaaagctcaaattctttgcaattaaactcaacacatacatattggacatacatgttgtggcagacgcaatgctagactcaggggcttcagagatggataacgctgttcctatcctggaggagcttaccagaagctttgacatacccctgaaaatgctctagcacctgggattaaggaggcttagaggaaggaggaattcactctttctgggtaatcggtgatgagtttttcagaagcagtgatcctctatccagctttcgaggagtgtgccaggggaagaagacccttccaaatgcgctagtatgtaacacatctgtactaggatgtttactgtaccattgttcatggaagactgcagggcagtgtgcataccataaatcctcattggtaggggactggtggaataaattgtggctcaatcacatcaaagaatattttgaaaccattgaaagaaacaaattagagtcatatcaaaatgacacaagattgactgggcgcggtggctcatgcctgtaatcccagcactttgggaggccaaggcgggtggaacatgaggtcaggagatcgagatcattctggctaacacggtgaaactccatctctactaaaaatacaaaaaaaaattagccggtcgtggtggcgggcgcctgtagtcccacctactcgggaggctgaggcaggagaatggcatgaacctgggaggttgagcttgcagtgagccgacatcgcaccactgcactccagcctgggcgacagagcaagactccttctcggaaaaaaaaaataatcataataaaataaaaaaagacacaagattgagtgaaaagcaagctggagagaagtgtgtgtgtgtgtacacagataggcatgtatgttgataggaattcagagcaagggattccctgcagaagacacagcatggtcaaaggtaaggagatgtaaataatgtctagggaactacaaagagctcagttctgctggagtgtcatgaggaaggtgaggcctcagagggaggcaggaagttcccaggagctgaatagtaggtgtggttggaatgagagtttgatttggcaattggataggcatctttaggaactggcccaatctggggagattcgtggctgaattcaggctgggattgggtgttgtaatggtcacagccttacagaaaaggtggaaatgaatttgactctagaatggaagtccagtcaatggagtgaagcagaacattggacaggagaatccaggcacctgcggcccagtccagtctagcacaaactcactgtgggctctcagatgtcccttttcctttctgaatctctcctgtctattcccacttctctccaaatgtgtgatgtcagatcacacagaacgccccagccacatccaggcaaggtccctcaacaattagtccaggcaggacaacaaactctaaccacatatctgtccccacagcttcactgaaagtactcttactaagatcatccttgtcgttgaaagaccttcctcctcctcctcctccttcatcctcctcctccttcctcctcctctcctcctccttcttctccttcttctccttctttcttcctcttcttcctcttcctctttttctccttctccttctccatctcctcttcttcctcctcctcctcctctttcttctttcatcagaagcatttgactaaggagccatcctctcctttgcaaaacactattcatctcagcttgtgtgacaggacaactcttatggtttttcttctcttccttcatattctttgctggctcttcttttttaaactctgaaatttaactgctactctatttctttgactattttagatgcctcatataaggggaatcatgtagtgtttgtctttctgtagctgacttatttcacctagcataatgtcttccagatccatccatgttgtaacaaatatcaggattttttctttttttaaggctaaataatattccattgtatgagcagaagacattttcttttttctttgtttctttcttttttttttttttttttttttgagatggagtctcgatctgtcacccaggctggagtgcagtggtgcgatcttggctcactgcaacctccgcctcccaaattcaagtgattctcctgcctcagcctcccgagtagctgggactacaggcacccacaaccacatccagctaatttttgtatttttagtagagacagggtttcaccatgttggccaggatggtctcgatctcttgacctcatgatccacccatctcggtctcccaaagtgttgagattacaggcatgagcaccgcgcctggcaataccacattttctttatccattcatctgtcgatggacttttgtgttgcttccatattttggctattacgaataatgctgcaatgaacatgagagtgaaggtatctctttgagatcctgatctcaattcttttggatatatatccagaagagggattgatggatcatacggtagttctacttttatttttttaaggaacttccatactgtcttctgtagcagctgcaccattttacattcctaccaacagtgtgtaagtattttaatttttccatagcttcatcaacacttttgtttttaataacagccatcctaacatcctaacaggtgtgaggtgatatctcagtgtggttttgatttttgtttcctaatgattagccatgttcagcatcttttcatatatctgttagccatttgtatgtcttctttggagaaatatctattcaaggtttttgcccactttaaaactgggtgaggtttgttttttggctttttttttttttttttttgctattgagttttaggaattccttatatattttggaaatttatcccttacagcttccacagtagttttcttcatgcttattttactaaattaccttgattatttaccttgtctatatctttcttctctgtttctcccactagaatataaactccatgagggcagagcctagtctgctttatttatgtcctcagcacctcaatgcctgacatgtaatagaggttcaggtaatattctgtaatcgaatgaataaataattattgatttctacttctaaaagtccttctttatttacttctaaactacagctcgccatggtgccttggataaatctctcattctagccacatcctcagatattctctttccttttctgtggctccagctcaaattcaattttctccatgtggtctcctttgactttttatggcagaattatgcactcccttctctgtgctcccataccctttgcctctgcctgaattcatgcacttgtttaattctacttgatagtactgtttgtttttcccttgtttgtcttccccagaagactgtcaactctttgaggacagaggtcatgctctaattttgtctgtattccacagcatctagttcagtgtgtttttcaaatcaagacaccttgttgaatgggatgggatctggctgacagcactctcacaccgttgcttgcacagactggccaactggtttacctggtttgcccaacaaagcctccttagatctaggttgactccctgttccagaaggcaatcctgtgtactcaacttgctagtaggtttcatcctttggattcagaatttcctatttgttcagagttgtaaatttcagtgccaagctacaagtccaactccattcattatcctctcttttatgttcatggcatatttcaaagtcaacatctaaagtcaaaaatcaaaggatttccaaacttagtttttcctctctcttgaggttccttccatatatctaggctattgctaacatcaaatgtcccagctccagaaatgcaggctgggctgacttttttctatgctctagaagaaagctgtgaaactcagcaagatgtgattcctccccttctccacatatcttcacttgttaaattctacttcttatttaaagctcagcacaatcaatcttttctatgtttcacatatcacttgccatgataagggaggtgggagcttgcctggcaggctcaaggaatggcaagaagggtgatgtagcttggtgaagtgagggaggagagagtatgggagatgaggtggcagagtcgacaggggttgcagagggtgtagagaagtggttctcaaccagggggccattttgacctccagggatatttggcaacgtctggagacatttttggttgttacaacttgggagtggggggtgggatgctactggcatcgagttagtagacaaaggtcagggatagtgccaaatggcttgcctggcaggtttgagggtatagaggaatggttctcaaccaggggccattttggccccaggggatatttggcaatgtctggatatttaccttgtgcctggatttgttctagatacactttcacctacatgtcctctaatcttctcaacagccatggaacacacatatgatcccatttaccatatgagaaaaccacgactcagagaggctgaggttcctggtcagtatgtgaccagggcaagactggacttcagctcacctgaccaggaagacagtgctttctccaccctatttggctgttgcagctgctgactcaatccaccattcacaatagtacctcactttattcaacaaatattttgcaaacacttcctatgcaccaggcagtgttctaagcactcagaacacattagtggatatagcaaacaaaagcccatgaaggcatgtagatagttatattctagttgtgggagacatactaaaaacgatcaatagataaaacaagttatgaagtactagaaagtaaaaagaggtatgaaatgaactgcagggcaagtgggatagagagtcctggaggtatgggatggtggacacaatttcaaatacagctgtcacgaagccacattatgatggtgatgtttgagccgagacttagcagaggtaagagagttagtcatgtgggattggggaaagacgatgtagcttggtgaagtgagggaggagagggcacgggagatgaggggcagcaggggttgcagagggtggagaggagtggttctcaaccaggggccattctgaccccaggggatatgggcaatgtctggagacatttttggttgtcacaacttgggagtgggggtgggatgctactggcctctagtaggcaaaggtcagggattctgcaaaacatcctacaatgcacaagtctgcccccacaaaatagaattatccagctccaaatatcaatcgtgtagagactgagagactggttgagagccaagatcttttgaggatcttgaacagaggagtgacatgatttgacttacattttgcaagatgcctctggctgctgtattgagaatagactataaggataagggcaagggaggaagcagggacaccagtctggagattactgcagtcacccaggaattagatgtaggacgactcatccccttctagggtggaaggccctggaagccagggaggaagggcagtagcatttacggagcacccagagggtgctaggctttcatatacattatctctttagaccccatctgatctttattagtcccagcacttggattggagttaagttgtttaagtagtttgacatcgctggatgtaaatgaggctttgagtagaaagaagagaaggtttttattgcacagcgtttgacgaatcagtatttattctgggtgatgttatttttcaccaatagggtggatgcctggactgcaggtaggcacatgcccttgtaaaggcacacgaagaaactcttggagaagcccagacagagctctcctgtggtacccatgtgttatcatttagcagatatgcccttggaaggtgccttggtgaggctagctgtgacacattccgttaagaataaacatttgcatagggcacctgaagccaggcacctgtggccacttttcctggaagagccaagctcttgaaaatatctacattagggtctttcctccaagaactggaaggtcatccatgcaagagtggacaaataggtgtgatgcgggttgcagaggagcaagaagctcagccaataaaatgccagatggtgactcacagcaagtgatgatggagtgagcttgtttgtgtcatgccagtgaaataattcatgaccatatcaatggtgtggtcctgctctttcttctgcggaggggagcggggtggggggcagtgcaggagatgatgttgatgacattttctgcctcttaattgccttcccccttcctggggtaggtgatcaggctgaccaaacccctcctccttagaactctctcctctctaggcttccatggccatactttttatgccctcagctccttcctggtgccatttcttctgcctggaatgcttgtttcttagggctcctgtagctctgcttcacagatcgggtggtttaaaaacagcagaaatgtattctcgcagttctggaggctggaagtctgaaataagtaggggcttcctcttcctagcttctggtggttgatggcaatctttggcgttccttggcttacagctgtgtcactccagtctctgcctctgtcaccacatggtgatcccgtgtgtttctattttcacatggccgtcttctataaggacaacagtgatattgtggtgacatctataagatgtcttcatgctggtcctaatgctcagtacttcagaaggaagtatttacttggaaatagtgtccttgcagatgtcattgtccttaccttttttatgtgtgttggggggaatacaatttaacccataacaatacccttctctactttcccctcatagtctagaagtacactagcaagcaagctaacactgcagtttctgggagaattcttaggttctcttgctactggggccctcactgaatggatggatgcaagtctcttcagattgttgttttgctgcattcgtggacttttggtccactagtattcattcctaaaaggaacaattcctatcccacccatgtgatcccaattgagcatcaaatatgatgcatagattcccaaacaacagtggttaatcagagtgctgcatccctcccaggaacaatgattgatccagtgggggaacatgacccaagaagggacgatcacagttcttctgtgaaatactgaaataaggcgttaggagagtgagtcttcctttcttttgaacacagttggagcttgcagaagccttcttgtctaccacataaagtgatctaatctaaataatgaagcaggaacaagcagagcagagagaggagacagagatagagccctgatgacatcatttcaggtcctagatccagctgtgcctgaagccattggccctggaattctaagaaacaaaaacaatgactttcctttttctcttaactacttggagttgggttttttcttatttcatttgaaggagtttattaattcagctgccttccaccatcaccaagctcttttctaaaacagcaaccacatcattgtcaaacattgcattaacactaactctttacaatgcaaggcactctacagagcaatttcttgcacttgaaagcattgaattaggattccccttgctgaactctgagccctcaagcacaccatgcatttggcaaaatgccttggatgttttttacattcatggctttttaactgtcactgctacacgttcatgaaaaggggctcataatgcaataaagagagctctaaaacagatgtcagaaaatgtgggttcaagttccggctcttccaattactagcagtgtgaccgtcaaaaagttacttggtttctctgagccccaatttctctatcagtgtaacaggcacactcatttcctgccctatctaattctcaagattgttgggaggacgaaatgagataaagtaggaattggcaaactgtggctcatgggccaaatatggtccactgcctctttttttataaaccaagttttattgggacacagccatgccccattgtttatatatggctacattcctttcacactacagcagcggagccaggtgacagactttatggccggcaagcagaaaagtaacattatgtcaagggcattttcccattctatttactgtctggactttacagaagaactttgacaattcctgctctacaaacacaaggtagggtttctgttgacagcagggtttcctcaggtgattcctatatccctacctggaaaacttcttcaaggagtttttctaaagtgataacatcccaaaattagcaagatgaatgatgaaagtgagaacaaactttctggagggcaatttgacaacacttcgaaagcctcagaaatatagtcatgtgccacataacgacactgtagtcagtgatgaaccgcatatacaacagtggtcccacaagattgtaatggagctgccctatacaggtgtaccacttcttatcttgtggccatatttttactgtaccttttctatgtttagatacacaaataccaatgtggtaccactgcctgcagtattcagtagtacatagcatgctgcataggtttgtagcctggaagtaacaggctgtatcatctagcctaggtgtgtagtaggctagactatccaggtttgtgtaagtgcgctctgtgatgttcacataatgacgaaattggctaatgatgcattgctcaggacataacccagtcattaactgatgcaatactgtataacattcgccttgacctcatcatcccatttctaagaagttgtcttaagaaataatcagagttgagatgtatctacaaatttaagaaatgatggtggaataattgcttaaattattcagcaaattatatagtctttccaaattatgtttccaaagaatttttaataggatgggaaaatgtgcctgttatagtattagtgagaaaaaagtcattaaaaaacacatttaatatgatcccaattttatcaagcaaaactagcaggaaacacaccccaatttcatggcgattttctctgggtattggaattacaagaggcttttataatgttaatttttatttttcttgttcttttttatttctttttaatctgaaaaggaataatttagcgaatatgggttggataagcttgagaaataactgatgatttgagttactctcttatcattatatagaaaaagggtattatcctcaacaggtgtcatgtggggcatgtgggtgagtggaaggggatgagggtcctggagcaggaggagagtctgtatcctgcagtgacagctgccactcaactctgccgaccatcgccatgtggggatctgacgtagactgagtgttgtacatcttctacatctccttttttttttttttcaagaaaagtcagagatttagattgctatggggatttaccacactgatatgtgtgggtcaaataaaccactccatgcctcctgaatccagcttcccaagtcacccatttgaaatgcctgctctagagccattgagtttggtgctgaaaggagagctacagattttccagtccagctgctcctccattttttttttttttttttttttttgagacagtctcgctctgctgcatctgggctggagtgcagtggcatgatctcggctcactgcaacctccactcccgggttcaagtgattctcctacctcagtctccaaagtagctgggattacaggcgcccaccaccacgtccatctaattttttgtatttttagtacagatggtgtttcaccattggccaggctggtcttgaactcctgacctcaggtgatccgcctgcctcaggatcccaaagtgctgggattacaggcgtgaaccactgcacctggcccagccgctccatttgattttgatgttatgaaatgccttatccagagtcacacaactaaatatcagcagagctggaagtggagcaaagaggagttgttgcttctcagaccagaactgaccattgcagtgccatcacctctcccctcctatagctttctccatctcagaaaactggtgccagcactgccccaggtgcccaggctgagtgttctccttggtacttatcaaacatgaatacccagtaggtcttgtttttatttatttatttatttttatttttattttctgagacggaattctcgctctgccgcccaggtggagtgcaatggtgcaatctcggctcactgcaatctctgtctcctaggttcaagcaattctcctgcctcagcctgccgagtagctgggattacaagcgctcaccaccacgcccggctaattttctgtatttttagtagagacagggtttcaccatgttcgccaggctagtcttgaactcctgacctcaagtgatctgcccaccttgatctcccaaagtgctgggattacaggcatgagcaccacgcccggccggtctcccttttaaatataccttgccttcatcctgtttccctctctttccattgctgcccgctaagtctaagcccccattacctcttgccaggcccattgcaatagcttcctaactactctctggtcctgtcattcttctgcttaaaactttggttggtttccaaagagtagataagaccctgctccactcccgcctccctcttgagctcaccttgtatcactctcccccttactatagtctttcaagtcctcgaacctgctgttttcctcctcgcttcaaggactttgtcatgcctcccaacctgtctggcattctctgttcacatctctccctattgttaattccaaagaatccctgtggtctctgaatagtgctggcccatcctaagtgccatgtaagtgtcggctgttgtgatttttactgttatcatctcagcccaaatgtcaccatcccaggtcaggtcatcctgtgattccccttcacagcaatcgcacagccatagttcagtcatcaactacccttatttgtttcccagacactgcttccttgagactccaggggacctccaggacaaagactgagtcagtcttgttcaattctgtatatccccagtggatgtcagactatatttgaaagcactcaatacgttgaatgctgctgagtaaacgcttacgtctatatacatgtatcaactctaatgtccagtggtaccttcaaccccacttccatgttgggcatgttcagatgaggaaactgaaggtcagggggtcataagtgactccatgcgtctgtggctcatgagaacataaactcccaatcctgaggccttagcgtggtgctctggcctgtgcttctggttctactggctgggtgaacagttacttctgctacttcccgttcaaaattggtcaacatatatatttttcagtggcaggaagtcttgcccgaggtgggaatgttactgggttaatatctgggggaaagagaaatatttttccctttgttagctggctctgggcagcctgaaaactcttgatcctctctgtctgctgcttgggacataatgacctgctttcaatccctttcaattacaggatttctgataggaatttggaaaacaacctaaatcccaaagcttggatggtagcccatgcttcattccacgtctctgtacccagtttttcaaagagatttttttttttcacctgctcctcaggcagagccttgtcctccaccactcccattcctcccaaattccctgcctggggctgtccagccacgcttcttgattttctcgctggatggaagcctccttttgcctcccatgctgggctgtgtttttcggtgctggtggttgtcctgaagcagtcctcagcgggtaaaatacttgggctggtgtctagggagaggcagccgtaggcaggggcctgggggtgagcaaagccaggtttgaatgcttgctcttccttgtgttagcactggggccttgggcaaccgacctaagaccccaagcctcaatttctttaattgcaaaatgggaataatcatatgtatctttgggatttgtggtggaaacacacagcacataataggcaatctaaaaaatcatttcttttctcatctaacttttggtacaactaggggtagtgggggtagcaggtacattgaagactacagtgatggcttagggaagggagcatctctgcggagattgggcagctgaaaagtctagtctagggcagagactacagcagtctatgccctcgctgcatgtcagaatgagtggaaagtgaggagtggaaaatgaatgacttctggacattggagccagacagacctggtttgaatcccagttttgccacctaatggccgggtgactgtggaggattcaactgctctgagccttcgttgctgcatctgtaaaacagggactcccgtgtcacggggtaccatgagaattggagtaagatacaggaagccatttattctgcccagtgacctttactctgtgatcttctcctgctctaaaggaatggggatactctggccctgagtttgctccagggcgtctcctggggaggcacaaataggaactggaattcttacctgctttctttgtttcctaaatgacaaaagttacagcagcttctctttattgggcaccgagtgttcttagtgttttttaatagtgaggagactagagcccagagaccgtggcttgtccaaggtcaccaagagggtcgaggagagagctggattgtctggtcctcattatggactgaatgtttatgccctctcaatagtcatgcatttaagtcccagatcctaatgtgatggtgttaggagatggggcctttgggaagtgattcgtcatcagggcagagtttttcatgaatgggttctcagtgcccttataaaagaggcccaagaggccaggtgtggtggctcagcctgtaatcccagcattttgggaagccgaggcaggaggattacctgaggtcaggagtttgagaccagcctggccaacatggtcaaaccccgtctctactaaaaatacaaaaattagccgggcatggtggtgggtgcctgtaatcccagctacttgggaggctgaggcagaagaatcacttaaacctgggaggtggaggttgcagttagctgagatcgtgccactgcactccagtctggccaacagagcgagactgtctcaaaaaaaggaaaaaggcccaagagagatccatctccccttctaccctgtggagatacagctagaaggtgccatctatgaaccaataaacaaaccctcacaagacactggatctgctagtgccttgaccttggacttcccagcctccagaatgatgagaaatacatttgttgtttcagcctcccagtctatggtatttttgtgatagcagcagaaatggattaagacactcacaaagcacatactctttctccacaccaacctcctctctgactctcttctcaccactgtgagcctggattcctgaggctcggatggacctgagccagctgttatggccttatttggatggggtcactctcatgggagcagcagtttcatcccctttccctgtgctcaggagctccttccacatctcaatgcccccagtttactaactgcactgtccccagcatgtcaggcaggcgatatcaggaggtggtagtggtgggaattctccaccttccctgcatccctccaccaggtgggagctgtggcaggaagaaaggctgatcaggtgctcccaggaagacagggaggaagaagctaaagatgatcaaggaaggataccaggggacagttctgattctagggcagagacaaatttaccttcatttcttctgcccacatgggaagcgagggctcatgagcctgccccctgcaaatgggagagagaggtccataagcatcacactccagaggcagaggctggactggtaggaaagaggaggtggcagtgaatttgagccccacaggatggggaggctgtgggctcaggctgctgggaaagccaaaatgtgatgaagagagagcttggggtgacacatttgtggaataagcccctcctttaaagcttggtttctcagtccatgcttgcctcccttttttctctcctacagaacgtcactcctcttcattcccctcccactcctgcagtctcacagaaactgaccagtggccttgctgggcgccccggttccttcacccataccctgggctctgtggaacatcaacacagcttgattcaaaatcaggaagaagactactgccaggacagcgctgtgcttgtcatattggccaacaggatgccacccatgaagactgagcaagaggcagctggtcaccctcttgagctcctggttagttgtaagagagaacttcccttagcaggtggatctgggaaggagtagccagggacatgggctgcctttacttttctggggaacttttaaaaacaagccatatatttgtgtgtctggcaggatttaggtaaggtcttgcctaacagaagagaaatagatgtttgccttcccggaaagtatggttacttctacatccacccgcccataatctcagggcatttcagtgaatcagatgagggtgaagactgggattgggagactttgcagggggtactccagatcagaggagaatgagagcaaagtagttatgggggagaaacgcttggctaagctgccttcagaatcttgtgagccggcttagttctgggggtggtggcggggagagaaaaagccaagtataagtgaggcatggggcagagagagaggggcaaacaggaagaaatgcagccacctgctaagatacccaccaataagggcagagtctagaagacacctgtaggccctcaccacattctctgaaaactgtctgtcacctccatccatggaatgagctcctggggtgaaagtttattttccctggtaggaaatacactggtagcaggtgggaccagggttggaccctggagtcatgcaggccaatcagatcacctctcttgaagatttgcaacaaaaacaagaaaacaactggggtaattggtagccttgcaggaaaaagtgatgttactctagagctgctgtggtcattgttttttttttgtttgcttttgtttgtcattgatacaaaaaagaaaagacaaaaagacaaaaaaaaaaaaaaaaaaaaacaggacggtctgcaaagagagaagagagtgcagcagacacacagctcaaagaatcttaatgcaacacatgagctagtaggtccttcagtttagaaactgctgcaaacaaccactgcctggtcctgaggatctgagactcagagcagcctgggaggtggggaagccctgggaagccacctctgcatccccatcagcctgctggagctcagaggatggccagcctttggtcctctacccagaaatgacctttgctttattctgcatcatttctgactccagcacagcgtgtttattagcatgcattcaggccctgggacgagcagactaagcctccgacgcaggccaccaacacgctcactgtgggctccaaccaccctggaggccttgtcatttgtgaaagacccatgtgcttttctgtctccgctgcttctgctttgtctgcttgatctgaacctcaaaaaatgacagccattctttaaagttcagctcatgtgtcactcgctcttctgaagccttttctagcttcctcaggcataattagtcataattagttcctctctcccatcacttcccaaagccctgtctttgtagagtctccattatggcatttttcatattatattatacacacttgatatttaaattacatttcaaaatacaggtgtactacatgttttcggcataaagtgaagaacagaatccctctcctcctcaaatctttccagcaccatttcccaaagctaatcacaattagcaatatatttggagggctcccagaaatttctatgtataaataagcatacataaggacggctggatgtgcagtagcccccttatctgagggggatacatttcaagaccaccagtggactcctgaaacctcagatagtactgaaccctatatatatatatactatgtttttccaattacatacatacatatgatgaagtttaatttataaattaggcacagtaagagattaacagcaagaactaataataaaatagaacgattataataatatgtcagtatcactacccttgtgctgtgcggccatgatgaagtaaaatcaagccccgtgacaccaccactgtcgatctgataacagatggctgctaagtgactcacaggcaggtagtgtagagagcgtgggtacagtggacaaagcatgatgcatgtttttgggagaacagagctggacaggacgagatttcgtcgtgctactcagaacaatgtgcaactgaaaatttatgaattgtttatttctagaatttttcatttaatgtttttgaactgagattgagctctggtaactaaaaactgggaaaagtaaaaccgtagataaggggaattaccctgtataggtagttgtttggcctaaatcgggtaatataatattatttttctgtagcttgtttttttttttttttttttttttgagacttgctctgtcacccaggcaggagtgcagtggcgcaatcttggctcactgcaattccagcctcccgggttcaaatgattctcctgcctcagccacctgagtagctggaattacaggtgtgagccaccatgcccagctaatttttgtatttttagtagagacggcatctcaccgtgatggccaggctggtctcgaactcctgacctcaagtaatccagcctcccaaagtgctgggattacaggcatgagccactgtgcccggcctgtaacttatacttttattgaacatctttatttttgtagaaatgtacattctgtttccattaatgttctgttggatatatttggttgaaatctgtcatcttattttattctcttttttaaaatgaaatgtttgttttctactttttgttatatttttgaagtttctgttttttcctttgttttgtttgtgagctatttatttatttatttatttatttttaatgttttctctctttctaatgatttggaaggtttatagtctggttttcattcttgaactggttaccattatgctttaaatagcatactgaaacacctatttcttgatttaccaattttattctacatccacagactctcgactatgaaagatgtagaaactcgggcaagcatacctttccccatatcccttcccctgccacatataagccatttctttttattctctagtggtttaggatatttaccttctgttctctaaccaggagcccctcagctgtttagccttagtttggtatttaaatggatacaatgtttaccatcaatgaatgcttactttctacagcttttctattcctaaattgataatattgatacagttgatcctggaacaacacagggttgaactgtgttcgtccactcatatgtggattttttccaataaagatagttggccctccatgtcccttagttctgcctccacagctgaaggcagttgaaaaatatggtattctcaggatatgaaatcgtgtacaggcaggaccaactttttgtatccacgggtttcaaggggccaactgtaggtgctaaagtatgcatggattttggtatgtgtggggatcctagaaccaatcctctatggatactgagaaatgactatatatttttggggggactagatttcattatcaagttgtccacctcctctattgaacttatgagttccatgcgctattttctctgagtctgtgctggtgaatgtctttcagctactttatacatgaaagtcaaccagactggcttttaaatttgaaatgtgtttgttacaatagcttcagaattttgtacctgttccttttggcactaaaggataaagagaagttggaggccagctttatttttccttcagaattttgactgaacattctccgtcaaagttctatggtatattaagaccacttttaattctgtagaggcatttctttagttcagaaaagttttcttttataatatctttgaatatgtttctgtcttattgctctgttcctttctttaggaatgtccagcatgcatattcatatttcctaagtatttttcattattttatttcattgtttttattatttctccttttctttcattaaaaaactcttactatgttactgactctattatcaactgaataaatcccacattctgctgatgctaattttctcctctgtaatggctttcattatcattttcattttttcatcccatgttagatcttgtctgcttgtttgtagttttactttggaaacgtcttgttgtgttctgttattttctcagggatggagtcaagctggggctaccagcagattccatttgagtttggtgtctcagaatttatcagatatgctcttccctggggacacatttcccccaggttttgaagcattcccatgagtatgaggtcagtgtgggtcaccagaaagccccacagattcatgggtcctctgactggccatttaatgtttatgcatctcttctgctgacaagctgcaaggctgactgctgctccctttctcttccacctcacctctaagacatttaagcaatggaggtcagggtttgtactactggctatccacatagtgccttcctatccacagccctgtctcccttgccctttgccttatagaaatgagtcactacagggaactttactcttctatgactcacctacctctcttttcctttttttttctccaataaatgattatttattcagcctttagggatcttttatcttactttcaagaaaatctggtaacatataggactcctctttttgtcttcctctgatgaaacccaaacttcactgaatgtggcagatatgggttttagcctgttttctttagagtaatattagcttctgtaacaactgaacacacctccaaattgcaatggtttaacatgttatatattcatttctcactagtgtaagggtccagtgctgatgttcctggtcagcaggtagatgccatatggtgagtcagaggactgggctccttctcttttgaggggtcttggagtaccctgaattctactaggggaagggcaaagagagagagtagagaaggtgttcccatctcttgaccatgctggcccagaagtgacatagatcacatctgttcacattccagctttgagaactcatcacatggctcaactaaatgcaaaggagtggctgagaaatgtggtccctgcctgggcaattgttccttacccactcctctctattatggaaagacaggaatgaactgtggtgagcagttaatcatcttagcccatagccattttctagttgtattgaagatggaattttctgttatattttcattctttttgttgctttcagtgggtttcagagaagggagtacagtaaacatcttttaacttgtttacaagtatgtcttttccacccatctgtgatctcctctaaatggggaccatgacttaacttgttttctattttccagcacccagcatgatggctgacacagagcagatgcttaataaatgtttcttggatgaaaaaatgaatgcattcctgtcctgagtgggtgaaaacggctcttcccaccttccttattctcaacttactcttcctatcccctctctctcctctctgtaggagaaaggaggaattgtcaggatggctccattcttttttctctgtttccccttcttatcatggtttggctcaaggcttgtgtctcctgtctccagcattgatttacctctccccagaatgaaatttcattctagctttgcctgtggtgcagcctgcttcctgctgcccaaccgtttaacaatgtcctccttgcagcttggggaaagacactggggaaagaaaaatctctctctgtccacagaaccataactcactggtaaggtagccagctgccctatcactccagctggtgttaaaagtcatggacattaagtgggactaggatgtggatcgaacatgtatgaaggagcctgcccaagaggagaccctctcctgctttaaatgccctgatctaagtgggccactctattaaaatccacctacagtggcaagttacttttctaaaatagagagtcctcaggaggaaacatcaacagaaatggagtagaatgaaggagctcagagcatgatcactggaatccaacagacttgtgtttaaatcctgctctgccatttactggctgtatgactttggacacattatgtaagcaatttgagcttcagtttcttcattcataacactgagataattatatctatcctgttgggttgttatgaggatgaactgagttcaattctaggcatgtaagaggcattccatattttttgaatgaataaatgccaaatgtacataatgtaatgcctggcacgttgataagcaatccatataagatggttgtatcagtaatgataggctaggttggctaggtttacaaaagtaccaaattccccaaatcccatgtcttaaaacaaagaaagtctattcttgatgatgcaatatgttcactgagggtcagctggggactctgcttcaagtcatcctgaggctgatagaacagccaccacctggaatgctatcagtcactgtgcattcacattcacaggcaacgtatatttttctagttcttgattccgagtctggtcacttgactgactctggccagtgggatttgaagcaaatacagacttgaacaagcactcacacatttctgcttgaactttgatactctgccatcagcatgagagcatgcctgagctagcctgctggagcaagagagatgcacggagcagagctgagatgcccagtcccccgggccattctaagttagttgacatctaggtggcccccagctacgtgaacaagaccaggcaagatcagaagagtcaaccctagctgaccccagattcatgagcaataaacacttattgtttgttgtatgtagaggtttgggggttgttggttaaacactattattgtggcaatagataactgatacaccctgccttggcttcaagttctgaagtatatagaactctgcacctcttcacattcctcagaaaaaattcacacagtagattctactgacaacttcaaggtggggtctgaaggggtttgacatcacatatctgcatgaatctctattgatcatggtttttctcccccgtttctttggctgagatgctaaccagagcttctctatcactcttaccttatcagaattgtgtacaaagttctgccaacttatatccactctattctctacctgttcatctcccataaaatctcttaccgtttctttcacagaacaattcatccttgccccagatgtggaagccccacattccaaacccaaaaatgtggcaaagtgttttttttgctgttgttgttgtttgaaggacctacctccttaaaagctagtgttttataaataataactcttgtttgtttttcttcatcattagaaagtctgtaaagggcaatgatggtggattattagttctgttatccttagtacctagcaaagctccagaatcattttaggtagttagtaaatgcaattggaaatacacattgttattgaaagaattttagagcatctatatacccttaatatcactctttggtgattaactgagagctaactgtaggaagtaaatactatttatcttctctgtacttgaagaagatatgggacattaatttctgcaagtactcagtggcatgagatggaggagggtagataatgtgttccaggatgggggggtgacacatcatcttcattttatctacccaaggttgtgaggccccagtaggtcatccgtgtccaaagttagaaagccaataagagattgaccggagacaaacatctggacttactctccactgaaccagacattcagccttggcgctagacgctctgaaacttggccgggcttcccacagagcttggcccagggtctccagtggctccattgagcttggcggagcacattgacagagttggcccagaaagactccaggacaacacccaaactccacagtgcccccaccatggagtacttgttttggggggctttacgtgatggagggcagggtgtggacagcccctggcatgtaggctgaagttggttctgacaacccagacctccacatgggccgttgggctcccctgaaccctgctgggctcagttcaggagaaatgctcttgccaatgggcagggaggcttagcattccacccctgctcttttaatcccctctgtgcaggaatgttccactgcagagacagcagagcttgcagagacaggaggtggtgccaaaagggagagagtggtggagaaacagttttgatgagatttagggtggtgtgtgtgcagggatgggggtaggtgctgagttaggctctaccatggactcactgtgtgaccttgaccaagtcacattgctctcggggcccaatttgtttaccttcaaaagatgaggatagacaaaaaagatacaagattcatttctggataaagctgtaaaattctaaaagctgttttacttgtgaagtccaaagtaagattctgtttttcatctacagggcctctcctctagagagatttgtatacaagtgcatttgtaggaaacagggtgtctgtcttaatgggaatatcagagtctacctctcatctcagttctagaattttaagcaccttgaggcaaggtctatgactcataccgcccaggacatagaattcctctgaatgtaataaatagaagagcactttgaggtcatcgaatccaatcttcttagttttagatgggggataatgggaccagagaagggaagttgttctctcaatattatacaatgaatctcaggcccggaactcaggttctctgctcctagaacaaagcttgttccaacaatcgaaaatttctgcctgaaattttgtatacggtctctgaattccaaggctttcagatgcttcctctttttaaaataggcttgactcctccctcctttgggcaactttcaggttaactcagggattgactatggagactataagagtcttaagctcatgtgaagtctgtgaaattccacaggcttaaagtatcccttgggaatctgagagattttgcccaagtagcccaagccttggacagcagcctccctggaagggatgtggctcctgcattatctggtcccaactccagctccaggataggatctctgagctgacataatacggccctattgtaaacaagggagggtcatgaccctccacaaatgactaacatgctaatttgaaaagtctgcctggactagaaaaacaaacaagaacaatgaaatttaaggcaacattttagacaaccaggaggcaaggggaaactcagaaacatgaaaaaaggagtccccaacagctattgtccctttcataaacactcactaagcaccggtcacgtgccaaccaatgcatcagccaacacaagaggaaaacacatcaagccagccctctaagacctcacaattctaggggattagacaagcactcatatggccagtgcttctaggctgtaaatgaaaaatagctttaaacaccatgtaataggaagcagcctcagcccagatttctgtattgaacttcagaccagcagcctgcctaacatcaaccacttggatgtctcataggtaacgcatcttcaaaacagatctcatggtttttcaccccaaatttccactgttctgttagaataagtgacaccatcatttactcagttgctcattccagaaatgggaatcatcctcgataactacttctccctcgttaactcctcatattcattcaatcaatccctaagtcctataaattctaaacatattttaaatatgccccatcttaactgctgcttccctgaaagcaagtcaacatgatcacttttctcaacagactcagaattagccttctagaatccactgttgtttctaatctgttctctgcagagtaataataagactgatttttaaagaaacacacacagttgattgagtcacactcttgcttaaaaagcttcaatgaggacttgtgattccatccatgaataattagctgttacagaaactgccctcccactgatgcaattacttaactgctcatcagaacaaaatctagtattcttgaaatacacacaacaaaatccaccacctaagaacataaaaatcacaatacccagcatccagtaaaaaattaccaggtatgtaagaaagcagaaaaatataacccataaccaggagaaaaatgaatcaacagaatcagatcaagaaattataagaaggttgaatttgtagacaaggaccattaaaaagctgctattaagtcttacaaatatgtccaaggatataaagaaaaacatgaagctgatgaagaaagaggttaaagatgtaaaaggatgctcatagaatttatagagataaaacatataatatctgaaatgaaaaatacatttaagtgaaattaaatgcaaattatatactatagaagacaactgaagttgaagctgtagcaatagaatctacccaatataaagcacagaaaaacaaaacaaaacaaacagtgccgcagtgagctgtggaacaatagcaaacagtctgacattatgtgttattggaatcccagaagaagagaggggagtacagaaaaaattatgaaaatattaatgaaaaaaatgtttccaaacaatggaaattttaaacccaagaagctcaatgaacctgaaataagaagaaaaaacacaaagaaaaccatactgaggaacttatttttgtgtgtgtgatttaagtattttcttgattttctttcaggaataaattcatgtatttattttcaatattttggtaacacataatagatatggacaatgtagacagtaaacaacaaatctaattatttacgtattatcttctgaagcgtagagacttagtgacaggaatgtctaatccattgttgagctcattgattcccaagataaaaataaagtaatagaagcatcggccaggcgctatggctcatgcctgtaatcccagcactttgggaggctgaggcgggtggatcacgaggtcaggagatcgagaccatcctgcctaacatggtaaaaacctgtttttactaaaaatacaaaaaaattagccgggcgtggtggcgggtgcctgtagtcccagctactcgggaggctgaggcaggagaatggtgtgaacccgggaggcggagcttgcagtgagccgagatcgcactccagcctgggccacagagtgagactccgtctcaaataaataaataaatagaagcatctaaattaaggtagttatttttcacctatcttgtctgcactatttatcagtgattctgaaactaagagccctcagacctgaattcttttcgtgttacaaaagatcttctgatatccacttaacatatgttaacctttagcatttgacatttattagtcatggctttcaaatgaagtacttaattaaaatcaaagtgccattgtctttagcaatcctgaaagaactgggtatgaattaaaattagaaaaaaaaatgacagtggttttaagagtaccatagttcctgtgtgaatattgcagttgtttgaaaaattttataaaatattcttattatcaaaatcgaatttaaagtttaatgatgcagtaaagttgagacattcacaaagaaactagaataataacagtaaaaatttagtcatagctaagtgcaatctaaccaaaatgttctggtcaattggatttcgttgtgctaaagactgacaaactacacaagtaattagaaatcaaatattagtgagtgtctagatgctggggttagttagaggcattttatgctgccagatattttttaaaatcacttcttgggtctccttaaatcagggtagataaaattattgcaatttttattttcttgaaaaagttatcactagactatttaatacatgtgatttatacagaatttactctttgctcttttattttccttaagaggtagactttgctttgggttcaaaattaataaataaattagagcagttaaatggtctaacagtgacaattcactgggaaaattaaatctggtattatacacactcaggatctgtacatttctgacccaatggagttaaataaagagttttgcctggccgggcgcggtggctcatgcctgtaatcccagcacttttagaggccaaggctggcggatcatgaggtcaggagactgagaccatcctggccaacacggtgaaaccccgtctctactaagaatacaaaaattagcttggcgtggtagcggatgcctgtagtctcagctactcgggaggctgaggcagaagaatggcatgaacccgggaggcggagcttgcagtgagccaagatcatgctactgcactccagcctgggtgacagagggagactccatcgcttaaaaaaaaaaaaaaaagagagagagagttttgcctatgttctaagtctcatccaaaggggaaaaagagaagaaaactgatggcaaaagtcttgaggtgcttttcataatgtccttaaatgcatcccacccaatgtaatttcatctaaacaaaattttctaaaatcaatctactcatcaggagattggctttattaggaaaactcatagtctatttatttcaaatgcatttttgataaaaatcattgaaatatttttggttggaggtacataattacacttaactaatgtaaaaagcatacaacttatgtacctaaaataaatatttaaattttattgtattatttcagggtagaaatggtaatttttgtattattagaacttatccttgaaactgaaattatattgtaactttttttcttttaagataattttaaaagacttttaggttcaggggtacatatgcaggtttgttatataggtatactcgtgtcacaggggtttatgtacagattattttgtcaccccagtactaagcctagtaccttatgtttattccttctgattttttttccctcctctcactctcctggctcaaacaggctccagtgtctgttgtccccctttgtgttcatgtgttcacatcctttagctcccacttataagtcagaacatgtagtatttggttttctgttcctgcattagtttgctaaagataatggcctccagctccatccatgttcctgcaaaggacatgatctcattttattttatggttacatagtattccatggtgtatatgtacattttctttatccagtctaccactgatgggcatttaggttgattccatcatatctttgctattatgaatagtgctgcaatgaacatatgcatgcacgtgtctttatggtagaacaatttatattcatttgggtatatacccaataatgggattgtggggtcaaataatagttctggttttagctctttgaggaatcatcacactgctttccacagtggttgaactaatttatacacccaccaacagtgtataagtgtcctgcacaacctcaccagcatctgttactttttgactttttaataaaagccattctgactgatgtcagatggtatctcactgtagtcctgatttgcatgtctctaatgatcagtgatgttgagctttttttacatgtttgttggctgtatgtatgtcttcttttgaaaagtatctgctcatgtcctttgcccactttttaatgggttgtctgtttttcttgcacatttaagttccttatagatgctggacattagacctttgtcaggtgcatagtttgcaaatattttctcccactctggaggttttctgtttactaggctgatggtttcttttgctgtgcagaagctcttacgttgaattagatctcatttgtcaatttttgcttttgttgcaactgcttttggtgtcttcatcatgaaatttttgccagttcctatgtccagaatggtattgcctccattgtcttccaggatttttatagttttgggttttacattttaagtcttttatccatcttgagttagtttttgtatatggtgtaaggaaggggtccagtttcaatcttctacatatggttagccagttatcccagcaccatttattgaatagggagtcctttccccattgcttgtttttgttgactttatcaaagatcagatggttataggtgcatgactttatttcttgtctctctatttgattacattcgtccacatgcctatttttgtaccagtaccatgctgttttggctactgtagccttgtagtatagtttgaagtcaggtagtgtgatgcctcctgctttgttcttttcgcttaggattgccttggctattcaggctcttttatggttccatgtaaattttaaaatagttttttctagttctgtgaagaatgtcattggtggtttgataaaaatagcattgaatctgtaaattgctttgggcagtatggccacttcaacaatattgattcttccaatccatgagcatggaatatttttctatttgtttgtgtcatctctgatctctttgagcagtgtcttgtagttctcattgtagagatctgtcacctccctggttagctgtattcctaggtattttattcactttgtggcaattgtgaatgggactgtgttcctgatttggctctcagcttggctgttgtaggtatataagaatgctagtgatttttgtacattgatttgttttctatgctgaaactttgctgaagttgtttatcagcttaaagagcttttgggctgagaccatggggattttctaggtatagaatcacatcaatggcaaacagggatagcttgacttcctttcttcctatttggatgtgctttatttctttctcttgcctgactctcttggccaagacttccaatactatgttaaattggagtggtgagagaggacaaccttgtcttttgccggttttcaaggggaacgtttccagcttttgcccattcagaatgatgttggctgtggatttgtcatagatggctcttattattttgaggtatgttccttcaatacctacatactgaggaacttttaattgaattgcagaaaacagtgaaacaaagaggaatttttcaaagcagccagaaaaaagcgacaccataagtacagagaaacaaaaacaagaatgacagcagacttctcatcagaaactatgcaggccagaagataatgggatggcgtatttaaagtgttgatgcagaaaatgctaaaattagaattctgcacgcaacaaaaatatatttgaacaattaagaaaaaatgaagacttttacacatctataaaagccgagataattcactaccagtagatttgccctaaaagcaatgttaacaggaattcttcaggcagaagtggggagaccaaggtgtagaaaaagggagaccatggcaaagagacggggcagctgaggggcagatgggggacctgagaagggagactcagaaagaattaatttgcagcacactgactttgatctgactgatttagagccttttggtgctgaggcaccctttgctccctgaccagtctctttcatatgtaccccactgttttcttttgcctcttttcctgtagagtcctgaatgttgtcccagggctgctccttctccttctctctgttcccaaattgctcaccccaaccctactctctcttcaccttcttccctggcccctggaattccctagagggcaggacatttctctctgcctgcccacctcccctccccaagagaccatcttcctcctattgtctcctgtgtcagcatactcacatttaaatgcttgctcaccctttaagatgatgtccttctatgacttttactgtttgctgtcctcccttcagtatctgttgaatttttctcatgtgcatacattgcttcaatcatattaatgataaaataatgatgatattgataaaaacccatgatgggtaatgaatgaatgagagaacgcataaagactctcagtcccagactatcacaaatgatgcaagcttagaggatacatgagcggatgtggacatgtttcctagcctcctctggagccaagggcacttgccacacaaataataagggactcatgttagtgtaagtcagaaaaaccccaggccatatggaggaaacgtcagtcatctctttcactcctagacctcaacttgtagtcacttgtgattctgagaagcatgggcctcagcctttcttttcccaaatgctctttgcttggatactcagggccactgtgaaaacacattaggtgcagagtgtcagtctcaaatggaccagggtttactttcagctctgcctcttatttgcctgtgtacctccaggtaagtaaactttatcttcctgggacttgattccctttcctgtgaactgggaataatccacctcttgaggcatctgggaggcccaaatgagataataagtgggagtaactggcatgaaatggagattttttcccttttcctatctgtgtcaattacctccaggtggtaatggtttggcctgctgcctcctgatagtcttctagacaatgccttaagccctggtgccacaacagacccatggggaaggggcttggaggcactctgtctcctttccataagggctcctgggctgttcacttcacctgcctaagcctctgtctcctcaactgcaaaatgggcatcactgtgccacttcatagggccagtgtaagaattcagagggaatttttgggaaaacactttgtaatctgccagtgctctgcagcatagatcagaaactaagacttagagcccttagatgatctgctcaggatctccccatctatgacattacagcttagcattcacatctgacagttggattattagtgcatatgaataagagccaattacatataattgctaatactgtttagtaataaaaaaagcactgtgactaatggagtgtgtgatctgcagcaggcagtggtgtggccacgttgggggctgtcacggcagtctacacggatgatgaagagtatttattactggcattgtttagaaacggtggtgcgtggggataatacaaagcagctcagattttagtaagctttataatggtttttaaattatctgcagacaatgcagccccttcttgcctgcactccaggcggcccattcccaccacgatgtagtaggcagtttcagaactttctctaaggctctgacaaccccgtgcaggaggtgtacttctctgctggtttaaaaaaaggaaactgaggtgcagttgaagacatttttccaaggaagacacagttttaaaaccatcgtctctccctgctgaggcttagatggtctccagaaaagcctcaagggccagggtcttcaatgagccctttggggaccctacccggtggtttggggagagagggctgccccattcatttcacagaagcagcttgcctgaggcaggaactctggggtcccctctggtctttatcactcttgcctccctctcctcaccttcacaccttcttccaagaggaaggcacccaggcctcgacacagccagagagcacaccttaaaaacctttaaaaaggagcaagatgcatgtgctgttggtgagcagctcagttacccctcacggggcccttgagccagccatttcctggcgtgggatgcatgatgactccgtgcggaaggacttttgccgcaggctgcacagcccagatggagctgctttgggggctgtgcacgggcctggcatggaagagagaatcactcgagccctgcggggcagtgatgggaagtggggccagctcctgtcttgcagcagcaagcagaggctaagagcacagaggagctgaggtcccagggcagcgtggctctggccacactgtggttggggccaacaggccttctggaaatgtcccagctgtggctttgttctgtgcccgggggaaaatgacctcttgcaggcccttccaggatgagacagacaacaattttctagataattcaggctccaaaatctctctctgccttcattccaatgattcagggttgttgtgggaattctgaggaacaacttgaacggcatcaaaccaagaataggaaccaatggctcaaatggctgaatccagcaccaaatcccaatattaattttctataaacgtaatacagatgaaatcaaagttgtttttgtttttaaacaaaaccaaacccaagtggatcagttggaacttgcatcaaacctctgcgtgtcctaaaattaacaaaccagaacaaaattggaaaatagaaacttttttgagtgaaaacaccatttcatcaggtttgttgaaccagggttttttttacgcccctttaaaagatagaaaaaattccaaatgtgaaagtaataatctcagtacaaaacattcagaaaaacccaaacagtttaaaaaaggaatatcacctccaatcccaccagtgggatatttccaaagctttttcctttttctttttttttcccccacaactcttttcaatgcatctttttctttcctttttacataaatgggattgttctataaaggctatcttatcttctgctttagttcattaagactgtctcatggagaagttccctatcaatatctagaaagccaagttattattcttaatgttgaaaaagtattccattggacatatgctggtttatttcactaatcggattactgtacaggtagttatttaggttacttccattattttacttttacaaataatgtttcagtgaatggctttgcatataaatcttcataacctggactgattattttggatacattaccccaaaaaagtgtttctaagtcaaagaatatgtatatatatatatgcacacacacacacacacacacacatgtgtgtgtgtatgtgtgtgtgtgtgtgtgtgtatttacttttcatacatatttccagatatgccctgatatggtttggatctgtgtccctgcccaaatctcatgtgaaatgtaatccccagtgtctaggtggggcctggtgggaggtgattggatcatggaggtggttcctcatggtttaacaccatccaccttggagctgttgtcaagatagtgagttcttatgggacctggttgtttaaaagtgtgggctgggtgcggtggctcatgcctgtaattccagcagtttgggaggccaaggagggtggatcacctgaggtcaggagttcgagaccagcctggccaacatggtgaaaccctgactctactaaaaatacaaaaaaagtagccaggcgtggtggcacatgcctgtaatcccagctacttgggaggctgaggcgggagaactgcttgagcctgggaggcagaggttacagtgagttgagattgtgccactgcactccagcctggctgacagagcgagactctgtctcaaaaaaaaaaaaaaaagaaagaaagaaaaagaaagaaagtgtagcacttcctcctctctcttccttctgctctggccatgtgagacatctggcttccactttgccttctgccatgattttaagtttcctgaggccttccgagaaaccaagcagatgccagcatcatgcttcctgtactgcctgcagaaccatgagccaattaaacctcttttctttataaattactccatttcaggtatttctttatagcaatgcaagaatgaactaatacacgccccccatgaaagatcataacaattttcactcccaccatcagcagatgaacatcgccctttctctataccctgcctaacagtgacatgccggagatgctcttcactcttcttctccttccacatctccaaagggagctgtcctacccacagctgtagagtgactaattgtccctgtttgcccaagactgaggtgggtctttggacatgggaatttcagttttcaaaccaggaaactcctgggcaaactggaatgggttggtcaccctacacagcccataacagctgggtggccaggattttttgagtgcacatgctccagtgctgagttttgcctcaactgatcgaaccaggagtggatacctggccctaggatgtctaatgacttggcatggggagacgatctgaaccaattggattcattctcttgggaatttgttttgggaacaagaaaataattcatcagttagcagtgagaaataggtctgaaaggtcattaactaaagggtgaccaataaagtttaaacaccagccaaagtgatgggggagaagaagctgagggtaaagaagaggagctgtttctaagcaagagacagagagaggggcaagcagagtaattgtgttgtgtttatggagaagaaagattcttcaatgttcctgtccatcccaaggctctcttgctgtccttctccagattcctgtgcacctgtactcaaaataactgcctatgcctcttccttcttatcaacttgctaccactggaagaaatctcaattccttgcaagccaagaggtctattcaacactcctgggtatcatccatcactttcacccttgccaaccaatctgattggccaaaatggacttcttacctaattttgttagaatttgcatttcttgaataataccaagttcaaacatcttctcggaaatgcttgcttccaggagttggtctgtgggccaggggcaggtggagaacgaggtacagggcaagactcgctggatggtttgatcaggtgtctgatgccctcttttcttaacctcagtttgacaacctgcctcagctttccagcactgactctggcctggtgacctgagggtggtcctatgggccacagccctacatcttggtctttctggctttttaatcccaggctaacaacctcacgaagattaaacccatctctgctgccgagcaggaagaatttcaccttgactcctcaattgaggctgcctttgtccttggtctttcccctgccacttgtgctctttagttttctcatggccacaggctccttatcatttgggtttcagctcaaatattagctcctttgagaaggctaccctgactgtctcaactaatgtggcttctgcttcatgcactcttcctaatattgctgttttattttctgtatggaacttatcactatttcaaagcatatgattcattttcattgtttgcctcccccaccagatacaagcttcatgggacgtgtctagggtgtcctgctcactgtatccccagtgtgtaggacagtgccttgcaggtgagctgctactgactgcttgactgagctaattaattaatgacagacaaagaaaatttgctgcagcaaaagtggcttggcctcttgtcataatcagcccgagcggggatagctcacaagaccatgtgatttggggttctgatgtatttcccagaaactctgttgtggcatttctgcttgaaactttcagtggctctccactgcaattgaaataccagggctggcagggcttgacctctgttcatctgctcagtgccctctcctcccctttgcccctttctcactcagcttcagacccactggcattctttgagatccttgagtcaagaagctctgtctgtctctgagcctttgcatgcactattccctctgcctggaatgtgcgaatccctgttttatctgcagtccagagaaactttctgtgaccttcataccaaagcttcttccactgggcttggcctctatcacttccacttgctcacttccttcattgcacatgctgtgatagttccttattcatttgcttttagattatgtgcctctccccattctcttccccatgaattttaagtgtcatgagtggagacactgtattttttttcccttttttggtctatcactgtatcgtcaaacccaggacagatgcttggtcattatttattgaatggatggatgaatgaatgagctattctaaaatcaaagccagccactgtaataggccacctctaacatttaactgactcatggttgatcattctgtatattaaattaattcagttgccagaaaatgtctgcattcagtcatcctcaggggtacaccagaaagttataggcttaagaataaacactgtaggctttgtagaaactgttttatgggctttaagcttcacctacattttaaattttctgcccctagttcctccgtggtcaggtacactttcagaggcttgctttgcttctcatgcaagccttcagtgggctccagcatattgctgaagatcatgtgggttctgtctttgggtcattttaactatccttgccttggtggcctgtgcctccattcagacttgacaatatgtcctagaaaacagatatcccggctgggcgcggtggctcacgcctgtaatcccagcactttgggaggccgaggcgggcggatcacaaggtcaggagatcgagaccatcctggctaacacggtgaaaccccgtctctactaaaaatacaaaaaaattagctgggcatggtggtgggcgcctgtagtcccagctactcgggaggctgaggcaggagaatggcgtgaacccgggaggcaacgcttgcagtgagccgagattgtgccagtgcactccagcctaggtgacagagcaagaccccgtctcaaaaaaaaaaaaaaaaagaaaacagatatcccagggagcaccaaatctgcatcaacaccaaaggaaaccatgccaaagaaaataaaatgctactgtacaaatccccttggagtgaccttcccagtaacccagttatgtgtgactacgaaggagggaggattctttccagatgagcttgaggaacacagaaggaactatgtggcttgattctgtacacagctcaggacaatggtctccttgcaagggggagcatcttttcctgaatgcctttagctgataaggttagcttttccatggaaaagtggccaagcctcagttgtccaaaatgggtttggatttcagctgaaatcatatctgtttaggcagtgagatctgaaggcccctcatgctaagtggaaagggcattgtacaggagccaagagacccagactctagtcttatccagcaactgacagttatgtgactgtggtcaggtcacttccactctgtggacctcagtttccctatctgtaaaatgggagtttgtctggctggtctctaaggaccctttcataacaatttcagtggttctcaaccctggctgcaggttagaattgccttggggagtgggtagagccaagccaccagcatttttaaaaaatgcccaagagattcagaagtctggcatattctggaatgccagcccatagcagatgacaagactgaagactgtggaccagctgagactttcagtaacttttcttttttttttttcttgaagtgtctctggcaactctagataactagattctaagtatagctcatgacctgcatatgagctatttaacaaactcttctaaaatgattacctaaatcttgttgcgaatgccaccccactagacattataatctctgattaagataggctttgtgctgctacttcctggctgtatgaaattggaaaaattctttgatcttttgtttcctcatttacaaaatatgggcactatttgtacctcttctagtgtttctgtgggaattacatgaggccaggtatataaagcatccaacatcatacttagcatatagtagatgctcaatgaatgtaagttcttcccgctcatctcccatggtatttagtttgggtatctttgcatggaacaactttccccgaagtatgttctgcggagcgctccttcccccaagatgcttcccacaagataataaaggaattttatgatgaaatacattaggaaaacctacatgccacagtctcttcttgaagtggtattcagtaatgtgctggtaagccagctctctgaaaaaaacaaaaacaaagcctcagatatgtagcgtttgcttattttcatggaataaatactatcaccctggccaagtccaaattaccaaatttgtgtcactgaactataagagctggttccagcacactactaaagtaattgttggcattttctagtctctggtatgtcctgtaataaatacagctgtttatttagctcagtgtttcccaaatgtatggaacccttttgtctcctaatacctcttgacatcctatggcactggtgtttcctgaaacacactttgggaattgctgatgtgaaataacgtaaatatttgttcgtttctaaaaattcatcagcatgctaccatttttaaaaagtgaaagatggctgggcgcggtggctcacgcctgtaatcccagcactttgggaggccgaggtgggtggatcacaaggtcaggaattcaagactagcctggccaagatggtgaaaccccgtctctactaaaaatacaaaatattagccaagcatggtggcgggcgcctgtaatcccagttactcgggaggctgaggcagagaattgcttgaactcgggaggcagaggttgcagtgagccaagatcgtgccactgcactcctgcctgggtgacagagcaagactctgtctcaaaaaaaaaaaaaaaaaaaaaaagtgaaagcatagtctgcacaattaggagcagtgtgcaaggaaagaagtacagaggagacatgagacagcacacacaaagtgattggtgaacaacagctgtgctggaaccaagtactccacggaggctttgattgtcagtgcagagaatgagcccagaaagagctagggaatcctggagagccctctggaggaggtggctgtcagctgagccttagagcactggagggcttgggaggttttgaagaagatcaaaggagagaaaggatgctgcaaatgggtagagcccacacaaagatgtggatgggacaatgaggctgtgtttggtgatcctgccccaaccccatctgatttccttcagcgttttccctgaagcagttggtgtacccatctccaaagagtaaagttcccacttgagtacctcatcccttcctgtctgtctacttggacatgtgtctgtgtgtgtctttctgaaactgggcacatatctctgtgtatgtgtgcctgtgtgtcattcagagggctccccaggcaactaggtatgtgggtagaaccactgagaacttcagtttaatgttcttgggtaggagaagcttctggagctcaccatggagcctaaactccataatgaaggaggaggccattcctctgtccagctggcaagttttgatgtttaccctagggccccatgtggagctgaaggtggccccatcaaataataacatagctgttatttttgtttgtttttttgagacagattctcactctgtcacccaagctgaagtgcagtggcatgatctcggctcattgcaacctctgcctcccaagttcaagtcatcctcccatcttagcctctggagtggctggaactacaggtgcacgacaccatacccggctaattttttgtggagacagggttttgccatgttgcccaggctggtctcgaattcctgagctcaagtaatccacccatctcggcctttcaaagggctgggattacaggtgtgagccaacacgccctctctgaccttttttttaaagtgtggtaacatacataacaaaatttaccattttaagtatttttaagtgtaccattcagtagcatgaaatacaggacactcagattgctgtacaaccattaccaccatccatctccaaaactgtttcatctccacaaactgaaactctgtacccagtaaatactaactccccattcacctctcctattattacttttgaccactccttgggtcctaggcagtcttctaagaaacttacatatatcaactcatttagtcctgttataaccctgcaaggtaactatctgccctttacacatgaagaaactgaggttaagcagcttgcttgagtccacagagctagcaagtagcagaccagattgagagctcagctagatctgacccctgagcccacgatgctatactcctgcctgcttcagggaagtctgaactcacctaagattcagtaagaagaaagacccctgtaaggtcccttgagtctcctgggtagatgaaggctggaagccctcagtgtttggggcccaatatctgacatcaccaatctctcccatatcgggtgaatgaggccccagccatggtgatctggggtagtcaggtcaccctgagcagtgagggctgtgcatgtggctggaatggatgctgcttctctgagttgtcagccagacatgtccaggaaggagtgggggaccaggtctggcagtctcagcctctgaggtggctctttattctgggggtggtggtgggggttatgggtgatgtcagacttgggcaagctgagggctggggccaggaagcggctggcaagacaagctcttggcagagatggctcactctgcacttgagaacagccattgctgagctgaatccagctctcaagagtggtcaagctgaagagtgtggagagaggtgaaggattcttggctgtggagtcagactgctggagtctgactgacaaggcctgtcaaacgccttccactgcggatctgacttgaaatgggagctttggtctcagtttctgcatggaggcctggtatggcctcaccccgtggcggcctcatcttaaacctttctgtttgtgcacgcaagcatgcatgtatccatgtgggttcaacaggtttaagaatgaggctctctgtagctatttcagatccaatcacgtcaagcccagacagagatttaaggcgactagcttgtgttgtttcctgtcgaattccttggccttcttggaataagactcataaggttagtttacacagccaggatgtctttcccagctggagcagggtggggtggagattgattggtgctgtgctactcccagtctggcgagtaggcagttactatggaggggcccaggctggggagcttacggccttgcttcccatattctcccacatccccttctagggccctccctgctgccttgccctctccatcagaatcaccccagattctgctccaccaagtccaccatgatctctgctatgtccactgtgtgctttaaaggaacacttctctgacctcaatgctctgccaagggaaagactccaaactgcttctttgagcaaggggtggtcactggtaggacccgaggtgtgcccctgacctggaagcagccaagcatgctatgagacaagtactgtctcatagtccttttttcaaggactgaaaaaaaaaaaaaagaaaaaagaaaatgtagaaaaggcaatccatatattggcattcttagccatagactgtaacaattgatttatatgttcaaggaaataaatgaaaaagatggaaaatttccacatagaagtgaaactgaccaaaaaaaaaaaatcaaccagaaattccagaactgaataatgaaataactcattttaagtgtccaagagataggtttaacataactttagacacaaatgaagacaggatcaatgaacaggaagacagaaagataaaatacatgtgtgactgatcacacccttacaggtctcccacaactccacatgacttacctaccggcacccagcgttccttttaatattatactctcctgtcccatttctcctctacatccaacttattctttacccacataagaatgactactctctgttcccaaacatgctatgcatattcttgcttttatgtccacttcttattccaggaagtcttgacttccatttttatctggtcgacagatcagcctcatcttccaaggaccagctcagacatcaccttctctatgaagccttcctcaggcttttcctggttcttccctcatcccctctttgaggtcctggggaggaggggatcctctaaaacagttcttagcaccacatactaaaattactcaatatgtctatttctctcctagaataggacttcaccaacggtaaggtacatgtgttattcatcttttgcgtctcagttcctggcataattcctagcatacagttagtattaaatattataaggaagaatgcaagaaccaaactcttttggagcccacagataagtatcttacaacctttgataaacgaatactggtgaaactgtgatttggtgtttaaaatctcatttgtccatttgttcattttccccaccactccaccagaatataagttccatgaagatagggattgttttgtgtgtggctgttctgttcaccgttgcatccaaatgcccagcatatagtaaatgttcaagaaatgaacactctaacacttactgaggctgggcatggtggctcacacttgtaatcccagcactttgggaggccaaggtggaaggatcacttgaggccaagagttcaaggccagtctgagcaacacagtgagacaccatctctccaaaaaaacaaaaaagaaacaaagccaggtgtggtggcatgttcctgtagtcccagctactcgggaggctgaggtgggaggatggctttagcctaggagtttgaggttatagtgagctatgactgcagccactgcactgggtgacagagcaagactgtctcagaaaaaaacaaaaaaagagagagagagaagaaaagaaatatttattgaatgagggaaatagtctttctaacaccctggaggggaaggggggacaaggggacagctggctacccaatttgggcactttgagtctgctgacaattggatcccaggaagcaggtagatacccagagcagagaggagaagctacaaactttgaagaatagcctagtaacttagcacacactctggaatctagtcttttcagtttaagccctggtttcagctatttaagggcaatggtagtaccggccccatgtgctttttgtgaggatacactaagatctacagcacagagcatgggatattgtacccactctactattggttaccttttattgtattgtttgagtgtgagtccaacctgggtttgtcttctggtttggtcacagattgctctgttgcgtctaaggcctttgggctccaaccccaacctcaaacacctacccagggctagcagtttatgtgtctcttctcatttgaccctcattacatgccatgaggttgatgttattggtgctggttacggtggaggaaacagatgctcagaaatgcccaagtgacttgcccatgtgagaagtatcaaaattttaaggtaagtcctttttgctatccaaggcccattgcctcagcctgccttgccccgaatcacacttggctgaaccaaggctagaacctaggtcctcaggacctccaaatagtgttattttcactgcccagtgaatagcagtgttgggattctcactgatcaccaccactgtgctaactggctggaggaaactgaggaccagagtccataaacccggccttgtggcctcaaagcccgtggccttcccaccccacaggtggcactttggcagctctcagtacaaggaaactgttgttattattattaggcattgcctgacttggcgcccaggcctaaaaagaactcagcatgattggaagacccagagctcagaagccctctcccaagggctcctcttaactgccagtggggacattgctcttgcctctacccccacctctctgcaactccttcccctgccgttgaaatagctctgtggccccagagaaaggggaggaaacagtcccttagtacacacgttcacatccaggttcttgggggctttcctttgcctcctgggctctcagagctgcagctggagccagacaatctgtttctcattagctgtacttttgctgtgaaatgaagtgctctttgaacctgtgggagcaggaaacccatttacacccttgagaagacagggacgtcagctttgccagcacattccttcggctccttttatctcctgggtggagctcccggtggtgggcaggcagctgctgctgccacctcccctggtgcagccatgggtaaaggtggtccatggggtgggcacagaggaaagaggggatcatgcctctctctcacttggggtaaaagaagcacattctgactggagttatttgccccctttccctgcctccatcttgctcctgataactcctctgtcccaggtgtcttcaataaaacccccagaaatcatccatccatccatccatccatccatcccaagggcaacttgtggatccagagatccagaaaatgtgagaacaaagagaatcctttgatacaacccatttcattctcctttattttatcaatgggcaaattgaagcccagagagttaacttgttccaggacatagcacacttttgaattcattttacaactatttattgagtgctttttatgtgccagattccccccagctcccactggtggtacagtgtaaatatagctgtgaaaacatgcacttttctcagccttcattatcattctagtgaagggggcagatggtaaacaactgaacaattaagtaaacatgacaatgtcagatgataaatcgtctgagaaaacaacagaagtgttgagaagagtgagtgggagcagggaatgctttagatggggtggtcagggaaggctttctgagaaggggacatttgaactggaacctgactgatgacaaaatgctggctccaggaacatctgagggtaaagccttgcaggcagggaagtggctggtgctacacagtcctgtggtaggaaggagcttgtttaacttgcttaagaagcagagagaccagcatggcaggagcaaatgagcgagaggaagagcggtggaagatgaggccagacggttcaatgcatctcgaagggtctggagaccatgtaaagagcttagtctttgtccatttggaagccatagagggttttaagcagggagttgatgaagtattttcccaagcagatgcctttggttgtgtcaaggggaggcaggggacaacgtacccacagggtggtgagttggggttgcctaagtagactaaataaacaacgatggtggctaccagcacctctcccttgacccttgatggtgtaccaaggtggagaaaagacagcagagtcgggaaaaaatttggagatcgaatcaaagagtccacataatttgcacatggctcggatacaggctgtgaaggaaaaaaggtgaatggagggttttaggttgagcaacctgggtcatgcccctcactgagatagagaagaccaagggaagagtagatttcaagggggaaatcaagagttctgtttgggtggattaaattggagatgtctcttactcggacagtgccaaggagtcaggcggatagaagtctggaattggtggccgaggccagtttcccacggggctccacccgtacccagatgcctcacaggggtggggaggaagtgttggctctcacagggccatccactctggacagctgactcaaggctgctaagaagtcactgccagtcccccaaaccctatctctaggctaggaaggtggctttggagctgtcagcattccagttggaccttccttctggagtccctccctagtaaaagcagatctagctaataaccccagaaccgagggcgggagtaggagatgtgaaatatgggaataataataaaagcctatgttacgagactgcttgtcttggtcccgagcttcttcataaataatcttcacctcaaattgcctacacactatggcagatcaacaacatgggttcaactagctccatttcattgatgagaaaatggaggttccaaagaattgagtgactttcccaaggtcacgcagatgatgaatccaagactcaaacctgagccctctgagatcacacctactgcgccctgctcaatagtaagccatctgccgccagaaaggtcttattttgagagagccagcagcaagggctctggagccagatcaccagggttcaactcctgacttgaccacttgaaggtaacgtgagcatgggcaaattagtcaacatcacttgcttctgtttcccatctataaaatggggacaggaagagtgttcacttcagaggatcaacatttataaagtgcttagaacagtgcaggaagggctatacatgtgttggctactactgtgctcattactttcatatacactaaacagagacgtggggactgcctagaatctggagagaagatccagccctctcatgtaagatatggagaaactgaggcccagataagggaatggaggcagcctcttagacaagttgggcccaagaatctggctggtggaggaactctccctattctctgaaagtcaccccaagccagactattttcaggagatgaacttccaagctcgatatacccttaattcatgtggaatttcagctctgggctcggctcccaggaggagcccctccacccctttatgaaaatagagcggagtcattcggcaaaacctcaagctaatgcttttaaggaactggcaggttgaaacaggaaactgttctaagtagaaaccacagaaacagcacatgcttgccgctgccggctgccgcctggatccttgccggaggccccagggataggggagctgtaggccgtgccacgtgagggggcctcaggaacctagccctggtgctgctgaccgtacgtggccatgtgacagcaaatgccacgtcttgtgggcatatttaaaggtcaaagcaaggtggggtggtaaccaacaggctaccagcattagacacacagaaagctagtgtcggagcaaacctgctcctttctatgcaagcccctcatgttgtatctgttaaaactgaggcccagagaggggaagaaactagtccaagtcatccagcaaggagtggtgaagcaggataggaaatctagactttctagcacctaagccaatgctatttaacaacagtcagtgcatttcctgccttccatccattcacctcttccaatatagggtacttttctgttttgttttgttttgttttgttttgttttagagatagggtcttgctatgttgcccagggtggcctcaaactcctgggctcaagtgagcctcctacctcagcttcccatgtatctgggactacagaagggtaattttgtaagagcataaattccaggtcagaagaccagagttcaacaaagactctgcctattcccagctgagtgatcttaggcaagttacctaacctttctgtgcctcagtgtcttcttctccttttcctgttaataaaatgagggacagtaacattacttatctaataggatttctggaaggattcagtgtgataatctatatgaacctcttcgtatagtgtctgacaaatagtaagagctcaataaagtttttatttttttcatgtattaaatgcccagtaagtgacagccacattgtcacaaagagatcagtcaagtgtcggggacagagagagtaaattttgacatgtctagaaatggcgcaagagagggaaggatgccattaggactctggcatcctgaaaaacctggccccagggaggagagggctgctgagaggagtaggccaaacacctcttctgggccgagcgcggtggctcacgcctgtaatcccagcactttgggaggctgaggtgggcggatcatgagttcaggagttcaagaccaccctggccaacatggtgaaatcctgtctctactaaagatacaaaaaattagccaagtgtggtggtgcacacctgtaatcccagctacttgggagactgaggcaggatcgtttgaatctagaaggtggaggttccagtgagccgagatcgcgccattgcactccagcctgggtgacagggtgagactttgtctcaaacaaaacaaaacaaacacaacacaacacaacacaacgcaacacaacacacctcttctgtgcagagatgagaacccatgcccaagggtttctttccaccacagcaggttttttttgctactttggaggatgatcccagtaaagcatgccctggtttcctgggagtggggacacaatgcacagggtcatccccactccagagctggaatgccaactgaggccataaaacaggatttaactatttcttatgaaacttggcacaaacttttgctttcagtctttagaacaattccccgtccctccactccaaagatgcctatgtcctaattcccagagccagtaaacagatcactttgcatgccaaaagggactttgctgatgtgatgaagtgaacgatcttgagatggagagattatcttgcattctacgcgtgggctgatgggtccgtgaaattaggaggcagaagagtcagagtgagaggaggagatgtgatgactgaggcggaggtcagagtgacctgaggcaggggccatgagccaaggcatgcaggcggcctccagagctggaaaagatcaggaaacagatcctcccctagatcctccagaaagaaccagccctgctgacccagtttagacttctgacgtccaaacaggaagatcataaatttgtgttgttttaagccactaagtgtatggtcatttgttatagcagcctcaggaagcaaatatgcttagtcaatatttagtctgacgttggtcactgtagctctattctccgctatgtgtagtttgagtcttattttttgcataatccccaaaatacgtaaaagctcccctgagcatgacatacaaggccctgcttgctctggctccttcctggtacatgcctccttttcatcttttttatcctaggacagggtcttggagaaaacaggaatatgtaaggtgtgccatgtgaggtctagtcttcatatttcccatgaaatattcaataaagtctagataataataactagtaatccagtatagatttttattttttttttgagatgaagtctcactctgtcaccaggctggagtgcagtggcacgatcttggctcactgcaacctccgcttcccgggttcaagagattctcttgcctcagcttcccaagtagctgggattataggcatacgccaccacgcccagctaatttttgtatttttggtagagacagggtttcaccatgttggccaggatgttcttgatctcctgacatcatgatctgcccgccttggcctcccaaagtgctgggattacaggtgtgagccaccacactcggccccagtatagattcttttggggtactcagaggggatccgaactctatatccatatgggctttacagtgtcatgcccacaaaatgtggcattgtgatctggctgttgatgacaacagctctcgtctcctatctctgccactccctagtgcatctgaatcagccttcattttcatgtatgagagctcatgttttgcaagggggagggtgctgggatatgacatgggttggagaaaagaagcttgaacgggacaaaatggatctggacttccctggtctctttgtctgcattacatcctcaaaggccaggagggcattagaggaaaaacctgaagaaactatttaagggcaacggtgacactcttgtttcagctgaactggcctcttaagtggttcctcagcctccattcttactatcccacaacccattctcaacaaagcacccagaagatcttctacagatagaagacagaatcatttgcagtcccttccctgtctagaaccctccaatgcttgcattgaaactggaatgaagtttttttttttttttccccaactgttactttaagttcagggatacatgtgcaggatatgcagcttccttacatacgtggccatggtggtttgctgcatggatcatcccatcacctaggtattaagcccagcatccattagttattgttcctgcagctctccctcctcccacctccaccctcctgcaaggctcagtgtgtgttgtttcccccatgtgtccttgtgttctcatcattctgcccccacttatacgtgagaacatgcgttatttggttttctgttcctgcattagtttgctgaggataatggcttacagccccattcatgtccctgcaaaggacatgatctcattccttttaattgctgcatattattccatggtgtatatgtaccacattttccttatccagtctaccattgatgggcatttaggttgattccatgcctttgccattgtgaatagtgctttgctactgtgaatagtgctgcatacacatatctttataatagaatgatttatattccttggggtatacacccagtaatggggttgctgggtcaaatggtatttctgcctccaggtttttgaagaattgccacacaatggttgaactaatttatgctcctaccaacggtgtaaaagtgttcttttctccacaacctcaccagcatcttttgttttttgacttttcagtaatagccattctgagtggcgtgagatggcatctcattgtagtttggatttgcatttctctaatgatcagtgatgttgagcttttttgtgtttgttggctgcatgtatgtcttcttttaagaagtgtctgttcatgtcctttgcccactttttaatggggttgttcatttttctcataaatttgtttaagtatcttataaatactagatgttagacctttgtcagatggatagattgcaagaactttctcccattctgcagggagatacctgtatacctacaaccatccgatctttgataaacctgaccaaacaagcaatggggaaaggattccctatttaataagtggtgctgggagaactggctagccatatgcagaaaactgaaactggaccccttccttacaccatacacaaaaatcaactcaagatggattaaagacttaaatgtaaaacccaaaactataaaaaccctagaagaaaatctaggcaataccattcaggacataggcactgacaaaggtttcatgatgaagatgcgaaaagcaattgcaacagaggcaaacattgacaagtgagatctaattaaaccaaagagcttctgcacagcaaaggaaactatcatcagggtgaatgaagtttaattgcctatttctccagcttcatctcccatcatgctcccctgtgcttcctgtgctccggccataccagctgcctctgggcccagcccacatcagctccttcctgtcttagggcttgagctcttgctcctctttttagctggaaagccctcccctccagacctctgcatcttggttacttcacatgatttgcatctcggctcaaacatcagtttctcagagaggctgaccttgaccatgtatctcagtttggcttcctgccaatcagacaccgaaagagacttggtataggtggattatttgcaaggcaatctcagggagcacaagaggttgggggagtcatgaaagtatgacacagatgggtgtgttaacaggatgtgttactgagttggttacccttgagggaaactgagactcagtcttgttggagacccctgaggtatggtgtgaaacatgcctccaaattgtcccactaagagatagaggagttgaagtatttatccaacaggctcttgccctcatgggttgaaggttgccctgggggtgcggtgggtagtcagtccctgtgtgtgggcagagcacactcctgtggcaccagagaaagtcttcagaaggagaagaggagatgcaggaaagcaatgtctgtctgcatgcctgggaactgaccacagaaggtgccagtgagctcaacggtgggcccaggatacgtggggtggggttaccccatcctaactagtgcttctccagccagacagttttatttattttctttttagttctgaactctgtctgaagttgttttactcatttattcagctatccatttgttaattgtctgttccccctacccacaactagacgatcagctatacaagaacagggacctctcattctaggtcaccatcctctttccgggcttgagagcagtgcatggcacaaagcagatcctcaataaatattaaacgaatgagtgagtgaatgaatgaatgtactacttcacggtgtgggggcaaaagcgtgatcccgattcagtggacagttgactccatgtggatgatggacatggataagttgcagacagagccagtgggagaggaagaagggggctgatacccacacataattacagctggtcacctgctttgtgggcagatgggaggcaccttcaggggatcctccaaagtaactgggaactacagtgatggggactgaagtcccgctaccacgcatttagaaacttccaagccagcagtcactgtattagtaagagtactgatgtttgtacaaatacttcctcttttaataaattagagtgggttcaaggttacccccataatgacatcactctcactgacttgcaatctaatctattttcttgagtgggagagaaaaggttgaatttacagcatccacttgctcagcaggcatgtgaagtatgatccattttcactgtgcttcactagggcttgtgttgaaggtcattggaatcccttctcttccattcacttgctgggtgaccttgggcaaatgatggtaccactttgaccctcagtttcttctttcttcatctacaaaatacgagtgataaaactaccctataggggctgtagtaaaccttagtagtacttaatagtgtgccctaaacataggcagtcgttcatagataatgactgctttctataatactactactaatgctcacgagatggatgacaatgataaaggcttagattttcatgagggcaatgtgcagactctagactatttccctagataagtaataatagcccttgagatcagagcacatcagcactatagaagtcacctagtctaccgcccttagacaaggacattggctaagacaaagaataaccattgtaatggtggctaccatttactaaatgcacaccttgaatatatttcatcccattggcctgactaaacctactgtgaggtggctgcatcagaccatataatggtcgggtaccattaagcatgtgctttaattggttcccatcacttcgacactcggcttactgagcagccacctgggtaagctctggcttcccatgtgcttctgcctttagaatgggctagacactgcagattccaggatcttcccatttcagctgattttctcatcatgaatcaatagactggtattctgatctccatttgatttcctacataacttgatgggagaggatgagttgacagtgtgttcaagaggattctggtctaagtgttacttaaggttctcatctcacttttacagacaataatattgtgagtttgcttatcaagtatcccgacctgaatggtgtacttcctcaggatttgctgaaaaattcaggttctggcatctcttgaggcacagaaactgtgaggtaataagtgggtgttgtcttgcaatgctaaatttgtgataatttgttacaaagcacacagaactaatacagatctcaaagccttccgtgtcttacctttacctacccaacacatcacttgccactctcccttttgccatgttttggtttctagagtgccctctctggttgcacatgctgtatctctgcctggagcacatctgccacctcacctgcaacattctgtcaccctgtatgtgtcaccacaaacatcactttccaggatggcctttcatgaccccctggacaaggcatgtcaccagattgcacggtcccagagtccctgtgcttttctctccatgacactcaccccagaggtgattgcttgtcacctggctggcctatgagctccacaacagcaggacatatctgcctcatccacccaggcatccctagtgctcagcccagctcctggcatacagtaagtgatcaataaatgtattttcagtgaaacaatgactccaatgccacgcaggggaaagagtcttgggttgagagtcaagagctgccctttggtgtgtgatttcagttctctggccattacggcttcagatgccatgccaggactgggattcaggacacttgggggttgggggcatctttgcacccaactttactgggtgacctagaaaaagtaactttttttctgacacctccagctccacaatctataaatctgggatgaagctgccagccgctctttctggggaagctgatggaggacaagtgaggtcatatccaggaagttctctgaaagatacagcttcataaaagcctacgatcaggcttttagatgcaagatacaacccaggctcttggcttggccagcagtgatgtcaaggccagtggtgaggtaactaccaaggctgtggggccttgccagcaagtgtcatggggtgttgctccccagcctgtagcccaaagtctgtctttatgtctatagtagatgcaggatcaagaccaggtatagagacttgtgggctaaatcctccacggttaatgacaaagccctttacaaggcttccaaatgtttctaaatatatcaccaagaggcaagcaatcagaggcagtagcatgatgtagtagaggccatatggtgtgatatttagaactcaaggctctgaaagcaggccacctacaatggaaaaccagcttcactgctcaactagctgtgaaccaacaatgtctctgggcctcaggtttctcatgtgtaaaatagggatcaattataaggcctatgtgcaatgttttgaggcgactgagaaaatgcatgcaaagagcttaacatcgtgatcagcacagcaaaaaatgtttaatgcatgctcattattattgcttttattattgtgttgttttgtttgtactaagtccctgtagagatgcaagcaccttcacttgcttagtactaatggtgaacctctgtttgggaagtattcccaatgagatcttattctctcatttgacagtaaggcagggacccatttgtggccaaatcatggtctttctcaaagcttcatccccagcacttaggacagtgcccgacacacagcaagcctgctgaaccaatggatttaatcagatctactcaagaactctggaggcagtggttgttattggtgtaattttccaaacgaagaagcagagtaccttcaccattattgtgaagtcagattctcacctgctgaactccaaatccaaccctttccactaccttcagcttcctggtgactccccacactaacctagctcagcaagatggtgcaggcagcagagtgaagtggtaggaccatgggctctggagccagaaggacaggttcaaatcccaactccactgcttcccagctctgtgaccatggatgagtcattcaatctccctggacatcgtaatttcatctgtaaagtgaggattaacagtgtctacatatcctatgaggtaaatattactgcctgcttgacagatgatgatgtttcacacaggtgagcccagtcactaaagatcttaaggttcctgaaggtgggaaccatgttcatttacttcaccagacgtacttagaacttacagatggaaaccatatttactgaccatccactaagttccaggcaatgcactgggggttttacatatgctgtttcattgaatcctgcaatcaactttataaagctatttccataagtcttatattatcctttggaaaaaatcaaaacaagacaaaaatctgaggttcagagaggttaaaaaaattgtccaggtcttcacagctgataagtgattcaaactcaggatagttaaactttaaagtcatgttcttctccccatgccatggtatctttcaataaagtctgcccctggagcacttggagaattggctgatccctttacacagtggctgagtgtggggggcaaaggcaatggaaggaagaggctcccagattttcaactcttgagaagtctaaatctaatgccacaaagcgaaatttgattgaaggggatcacagcagcatcagcatcgacagaactttatcttacccaaccaggatttgtcaaggggtggggtggaaagaggacagccatatcacacaattatgatgatgcatagatatttcttgggcctaaaatgctgctcaagtcctgaggggaacagcatgaatacctcattgtacccatggaggaggaactaacaaagacgtcttatcttccagcttcctattccaggatcagaattatctctgacattctgggctgttgtgagttctcctctggctgtctgagcccaggagagtggttcctagtagctggctcttggtttctatctgatgtctaacatggccggcgcctggcggagctcagtctttgccatatctgtggcctccttaaggcaacagccttatcttattcatctctgtgttccagtgtctggcagaggggttggtgtggagcccaaactcacaaaatgctgaaccaaggcccaagagtttggccaagtacaaatggctgaaagttcatgtgatgctcttgaagccctcagtgtagacatctcagatgggcccagccaggatgctgactgataagagctggggggtgggttttgaggtaatgggcagtggccttcatgaggacactctggacaaggaggggcattataggatcacagcgccacacttagtcaaagcctggtggagaggacagagatttacaccagggaaaccaaggactgacaattattcaaaaggaccaaaagccaggctgagccaagcaaagagccaagactctaaaggagaggcaatctgagcaagaaaaggtccagaactaaacagactgtctagggccactgctgtcatggtctgtgggtgtattaagcagctgagtctgctgctttaaagggcctggggtgggtggacagaggcaatccctcatctggtgtctgagtgtcagcagcttggaggcctctttgcatgtgggagcaatcggaaaacttcctgagccctgattaggctggttaacagtatgagtggatacacgcatgcaggatatatcttacagggtgttcttagcctatggggccaacaaccttatccgctctatcatcttaaccaccaccttcatctccaggtgcaggggggagagagtatgggcagctgctgttttgtacacatccccggctgccccagccttcacgcatgtgacccgagggatgggggcagagacactgatccaaggttaaccaggtctcttccctgagaacttggaatgggtgatggaggagcagagaagaggcaggcaggcagacagacagacagacagacatcgccctgggaggatggccctgtgatggctgccatgcttcctgctgcatggatttgggaagcagcggaaccccatctgcagggacagagaaggataaagacgacacacagagtggggctgagatccgagatgaagagaaagtcctgacagtgtttgctgattctaggacattcctgggtttatttgtgcctctggattccacaggacattccccctaggtcttgggctaaatcctcatggaaccatgcttacactggtttctactacctgttatccaggagtccttcctaataccctgtgtatccctcatggcctttgactctccccaattcaatgttgcttctcagggtggatacagtcttcggcatccattctattctccttctaatgtgcctacctgttttggaaggatcacaaaaagctaaatccacatacctagactttttgggagctaaggctccaggggtgatttaggcttcccaatgaggggcaattgcgcaggatttgggggtggaagtgagaggtggttacactccatctgcctccactgccaccaatgggttcttctgtggaagtgtttactgagatcctcgtttctggtccctggctctgtgtgtgttgaggggcaggatacaaggcttttggcaggctcctggatcagatggagtgggatcaagccccatatctgcatttctagctgtgagactttgggtaaataactcatcttctctgtgccctaatttcctcatcagcaagatggggatagtggtggcacctacatgacagggtagctgaggtaatatatgtaaagtgcttagggaagtacttggcacgtagtaaattctcaatcaatgctagctattattattactatcactactattagcagatcaagcccacaatgttgcggtgggaagcaaaataatttgtacgaatgacctagtgcaggctggaacatcattcctgtatttgtttgtttgttttgttttttgtttgtttgtttgtttgttttttcccccagcttccctgcaaatccagccctggaatttgacggctctggaaattctgattatctagaaggggatctgtcttagtcccaacatgacagatcttcaagcatcaccatcagctgactgccctgaggcctcccacgctgactcctgaaacacggtcagcagcccctagcagccagagaggtcattgggtctcccagcccacagggaggctggtgacattttcatccttttatgagctaatatcttgggctcccactcatgtctgggaacttgaaccactccagcctgcacccttatgttggtttgctgacaaagcagagagcttaagctggctgacccgagggcagagaaagggaccaggacttgtggaggaagaggcccagaggcagggggatggcagcaaggggctcctgcccaggaagctctatttggtggggagaggagggggccatgcctggcaggatttcctagaatcagaggtaggctcatgtagttcaaccctctcattttattgtgtttttgtttcttaattttaaaatcgactttactggagtataatttacatgcaataaaggcatcagttttatgtgttcagatttcacacatgaaatactaatggactaatggatacacatatgggaccatgaccacaatcaagagatagaacatttctaacatccacgaaattccctgatgcccactgtagtcatcccagatcccaggcaatctcttatctgttttctgccactgtagagtaattttgtctttgctagagtttcatataaaagtgcaattatgtgcaactggcttgttttgctcagcatgaagtttttgacactcatctatgttgctgcttgtatcaacagtttgtcctcttttgttactgcatagtgtagagtacttaccccattattttgataatattatccaacattgtggattcatgtcagacaaacacagtgttaatgctttgtataattttttttctctgggtccccacaatgatcttatgagaccataaatggaaaaaactgaggctcaggaatgataatataattgtcccaaaacaggcaatgggcaaaaaaattaaaacctacatttgaaccaagacaatctgagtccagaatctatgcccttaagaatcatgctgtactgtctcctattttacagactgagaaacagagacaggaatggaaacaatttgaccagcattatattgtattgcagcagaatattttgagaatctaagggctcagattcctagcatatcatgtgacttcctttaaaacgggcctaaagaccccaccaaccccttccttacttgcctgaagcctgtgtattcttcaaatgctctcctattcttttttcactaaacatttaccagctcagggccaggcataccagtaagcaagcagacagacctctctgaacataaatcaatgggtccaaaacaccagccacagaaaaacagaaaggggagaattgcaaacaacagttcagaatttttgtgtgtgctaagttcaaaatgttcagtgacggtgtagacccaaagggccaattggagctgagctcccaatccaactaatttttatagaacagtcttaataggtcagctcagtcttatagactgtcatatttatcacccaaacctcaaaacaacccatgaggttaggtacttgtattctcctcattttgctaaaaaggaaactgagggttggtgaagctaagtgatgtgactgagccattcttctggatcttttcttttcttttttttttaattatactttaagttttagggtacatgtgcacaacgtgcaggttagttacatatgtatacatgtgccatgttggtgtgctgcacccattaactcgtcatttaaccttaggtatatctcctaatgctatccctccccctcccccaaccccacaacaggccccggtgggtgatgttccccttcctgtgtccatgtgttctcactgttcaattcccacctatgagtgagaacatgaggtgcttggttttttgtccttgcgatagtttgctgagaatgatggtttccagcttcatccatgtccatcttttctatacatagtctcattctcaaatccttttcaaaggaggtgagggagctatatctattcctgtccacctaaataatggtttcagagacggtattaactaccatatctcccagtgctcctctccacttcccatcctccctagagatcaggaccaggaccctgactcattctgagaaatggactatgagcaaaggggttgagatgtcacttctgggcaggtcagagctgatgtgcctcctccacattgctctgcttttctgccatgctgatcatggaggccatgcgctccagaggatgtggtggccagatgcaggaggactgcctgacccgtatcagatctcacattgtgacatcttcttgtggtaagccactgagattcccagggtttttctgttgtagcaactaattatcaattatcctggtagtaatacggtcatcataaccacagctaccaccacttgtttaacgttgaccccgtaccaagcactatgctaagcactccacatctgccaagtccttacattttagtcgcttacctgcacttatcagatgtgtggtttcaagagggctctgggtttgttaataacatatgagggaaagactctctctgggaggcaggattctcagccctaagcgactctactaccagagataacacctgcagaggcacaagcctgacaaatgcctgttcccatgagtgtgaacacgatgtcactaagtagaatgcagacttacttcatcaatgagcaagaaacacagcgttcaaagaggaaaaagaaattgacaggtgggatccttccctctccccactggcaaatgcaaagcgccaagatgaagctcctgctgcatgactctgaatttgaagaaagtgcttcctgatatctgatttcctgtaaaaatgaatcccttccagttattccctgttggcttcctgttgttcttaggaatgacatcctgggctcccacttgaagttcacaggcaggggtaggttttggtggaggggatgtgtgaaccaagtattaatgcatgagtaggaatttgccagccagagaagggaaaacagaacattccagaataaaagaacagcaggcaaagacatgggattatcagaagagaggagttagcattttaaaaaatgatcattaaaagctcagtgtagctgaaacacaaagtgtgtgacagagatcaggctggagacttaggtggtgagggaggccctcctggaccagcagagtctgggacctcccaggtgagtgggtctaatcctgcattcaggtaggagcccactcacctgcagatataagctgaatattccagcctaacttttcttatgtaataaaggtgatattttctttcccatctgctcattcttttttcttatttcttaattggtttgaaattttggcaggaaagaggggatgttacttattgtgtctgatatgggtttggctgtgtcccaatccaaatgtcatcttgaattatagatcccataattcccatgtgttgtggaagagacctggtgggagataattgaatcacagggggggggcggtttcccccatactgttctcgtgatagtaaataagtctcatgagatctgatgattttagaaggggtttcccctttcacttggctctcattctctctcttgtctgccaccatgtaagatgtgccttttgccttccgccatgattgtgaggcctccccagccacatggaactgtgagtccattaaacccccccttttttttttttttataaattacccagtctcgggtatgtctttatcagcagtgtgaaaatgaagtaatacagtgtcccttcaaagtccccagcagtggctactaccttcaactccatttcacagatgaggaaactgaggctcagagcactgaagttactttaatctggttgtatccattactgatatctacctggtccacacaggtgtggctgtaccagctgttaaaatgttcagatattgtgtgttggttgagaattagctgcttccctgatcccccacctccacctctaccccatgatccaaaaaccaaaaggataacatcaggcacagcaggggcttttttactgtgctccaaagctgtaattgactagttagttcctgaaccatgtcatttgttaaatattttgagtattacccctagttacatggctgatggatgccaacattagtttgagcccatgtgtagctggctctaatgccagtgctcttttcatgctatgagccacgtcaagcccagaacaagtgaagaatagtcctgctgcaccccctacacatgtcggaccactatgaagtctcgggttcaactttggaagacatacattgagaaagatgctaaatccctggaattgtccagaggagagtgacagaggtaaagaatgacttgaaaccacatcatataaggaaatgctggcagcattagggatgttaacctggtgaagagaagattcaggggacctgagaactgtcttctaatatttgaagggcaggtgtgtgaagagggttagactcaaaatggaacttgcaccaacaggtgtaattagcagccaatttggtgcttgttcattcactagataaatactttctggacaactgttctgtgcaggtgctaaactgggcccgagaggtgcaatgtggaacatgaataaggagctgccactcactggggagatgggcacatcaacagatgattacagcacaaaaatgagaggtgctggagaagcttggggaatggaaccctgaaaccctttgagggaactggtcacgctcttggagaataagagttttgatcagaatcttagagaatgtgtaggagattgccaatcagagaagggaagagagatggaacagcatatgcaaaatagcagagttgtaaaaggatgcacaacatttaaaaacaggtgagacgcagagtgtggctggaataccagacttgggggcagaaatgcagctggaaattgcagatgtcttaggagtttggacataaccctggggtcaatgaggaaagactgaaagttaactaacagggaaatgatctgattgggatgcttttgcaggctcagatttgagttcagttcaagaagaccttttcttgaattacagccattcagagatgaggtgggctgcccaggaggtggtgagctctctgccactggaggcattcgagaagagatgggagggctattttgaagggatgttagccaacagatcccagtatccaaagaaggatcaaatgaggtgatcttgatggtccattccaaccttgggcttctctgagaactgaaaatcgcagtcccgtgggggctgcaggcaatggggacaaaagaaggtttgaggcacagtagggtgggcactgtagataaatgttaccatttaggctttggcttaattttatttccagatggctgagaaaagggagacactggatcagggcatgaggaacaggttccaaatgtcttcccccaaaacactgggagatgcagagttgacaataataggctggtacttacagacatgagcactgttcttagcattttacattggtcaactcatttaatccacatgcagccacacacagtaatattattatctttattttacagacgagggaactgaggcacacagaggtaagcaacttgcctaaggtgccaaagctgggattcagacccaagcattctggctctagagcccaattttttttttttttttttttttttttgagacagagtcttgctctgccgcccagtctggagtgcagtggcgtgatctcagctcactgcaagctctgcctcctgggttcacaccattctcctgcctcagcctcctgagtagctgggactacaggcgcctgccaccacgtccggctaattttttgtatttttagtagagacggggtttcactgtgttagtcaggatggtctcgatctcctgacctcgtgatccgcctgcctcggcctcccaaagtgctgggattacatgcgtgagccatcgtgcttgccctctaaagcccaattcttaaacacgataccataccaatctgtgcctttcctcataggacaagctctaagaattagtagaaacctttgtcaatagcgaaattagtgggagacagtgttcactttatagatcagtttctcatagggtctctttaactagtatcttcccaaacatctattattaatcagattacagtcaaatgtcccaagccaaagggttccaaactcttcctcttaactaagataaggcaaagaggaaattagttatttgacccaagtatttacctttctagtttaacactttccatttttccagacaggaagttaaagcaccaagccctggccgggcgcggtggctcacacctgtaatcccagcactttgggagcccgaggcaggcggatcacgaggtcaggagatcgagaccatcctggctaacacggtaaaaccccacctctactaaaaaaatacaaaaaaattagccgggcatggtggcgggcgcctgtagtcccagctactcaggaggctgaggcaggagaatggcctgaacccgggaagcggagctggcagtgagccaagatcgcaccactgcactccagcctgagtgacagagtccatctcaaagtaaataaataaataaataaataagtaaataaatacaaaataaagcaccaagcccttagtcacacagcccagaatgactcctaggtctcagcttggattcttataggatctcatggaaatctctggaaaagaagagaacaggacagaagacctggctcaacacagagcttcaatactcgctggcttggcagtggaggcaaggaaaagaatggttgggagaggatgggaaatgaagggaggatcttacaccaaggacactgctgtttgaatacctagtctctgccaggcacagacatgttctttctcactctatagacaaggaaacagaggatcagagtagaaaagcaattcagccaaggtcacccagtgaggaagcacatgagctgggatgtgaatttagctctgcctgagtccaaagcccatattctttccattttatcctacagccttcccatttcacctccttggccttgttttctcctcagcaaccagaagtccacgttattaacaactttccccattgtgcatagtatgctttaaaatattccgtcttatcacgccattaatagcaacactagcaacaaaaacagctcacacgaatagctataaggtccctggaactgttctaagccttttataagtattagctcattaaatcctcactaagaccctatcacgtatgatgccctccgtttatagggaagaaatcagagaaagtaagtaacttacccaaagtaacatggtgaattgtccattcaataatagtgaataataacaaatcaatgaaaaccttgaagtaattgaagactgctccaattaccaatcaagtgatcaatatgagataatcagcatttttttaacactagctatttcagttaccccctgagtgagtataaatgtatgattcatatgtggctttgggaaatctaggaagttgccagtggatgcctaagccctggtggggaagggggcggccttgtgagatgtcacagtcatctgatgcctagtatcccagctccaattctgaacattcaatgtctcaccagcagaacggaaataaaggaacaacccttggctggcttctgcagacaattctgggccatcctggtgccccgagccagctagtggcctagaatcccttctaaccaggggcagtggacacagaggaaggaaagaaaggttggagacagaggagagggagggagcattagggagagagagaggtggaggagacgctgaaggctgagacaaccgtccatgctgcctgctgcccacctgcttgggaagaggtaagtcttgggaagaggtaagttctagcaatttcaccagccacttgcccacctgagctagatagggtgggtggtcagtatccttggggctcaggtgacagttgtctttagctgcctctccccttggactctaatttgcacagatgagcttgaaggcccgcctgggaggtcaacatctcctccctctcctgttccttccctcctggagactgggcggcctgaggcaactgcagaaggcaatgagttggtcttcctggggtccaagcctccttttgggggcctctttttcatcttggtggcaactgtttccctccagaggctacaggtgtcatggaaaacccagctctggactcaaacagacctaggtttgaatcctgactcatcactactacctgcgtgatcttgagcaaatgaattttcagagagaataagaggtaccacaccagccgggtggagggattattcatgagatgatgacccctttcgtgcccaggccaccccttgctctcactcccccttctcagtgcaaacctactgtagagagtggcttgtacatcagtgccctcaggagttaagagcagatgctaccttctctgcattttgatagagaacaaacaactctatgaacgtgtttaccagaagtttaagcaaatctctttccctcgttggggactcatttttcccttcaaaatgtggaaatggatggcagacctagatgattccagaaattattctgagtctgagagactgggcactcccaggagcccagtccaagctaaattgtaatagacaaatcaccaacgggaagcgatctatgagagccgttccctgttattccagctctactcattaatgcctgcttcttacctaacagtatgctgggtatcgagtgagctaacaggccgtgtaataatagctaaatgtcaccattcctgagggcctagtgtgctaagaaattcatctatttaatcttcagaacccaatcctctccttatcttcatttcacaggttaataagtaagagacggtcaaatgcaaatttgggtctagtggaccctcaagtccatgctttcacccaacatgctactgtgagtgtctctctcttaccgcaggactctgtcaacccggagaagcagctcactgtgtcggtaaggagacaggatgttgggcagaaaccccgctgagaactaacaccaccaccaccaccaccaagggcaagctcaggaacaatgatggtgtgggcgattgcccacgcagcagggtggtctgacaagagggcagacccaggcagaaaagacacacagagaccggcagggagcagagagaggagagtgggagagccggggagtcgggcttgtccaggaagactttctggaaggtgaaggaaggaaagcaatgtttacggggcacccagcactctgtgctaggcatttcagagaagtgatttcatttatcaaaatgttaggatggctctgtgagggaagaaacggcactcttctgacgggttaggaatgatgggctgggaaagggaatcagtggtgcagaagttcactgctaggaaccaggaggagccaggatttgaatccagccagcagggatgagggtctctctctctctaaactctgcgctcccagcacccagcttcccatccagagcagatggagagcctggacttttgctttcactgatattggctcctgttccccatgcacaccctcagctcccccagcttaagtgggttgtgaagtcaccgcctgtctttcctgccagctgcttcagcctcaggccgcacatctggagggtgggactccacccgtcttcaaaccagatgttcgggggtggagggggtggatggcggactgtcactgaccaatgcctcctgtttgtctcttctctggtaatcctctttcctttcttgtccagggaatgtgcagctttgggcaggggccttgtcagattccctcagtagcttccccctcccactgctccgggaactggtgactggaaactcggagaggtctgcaagacgcagccactgcacggccctgggttagtcacagcaaaggtatttggcacctccaagtacctgcagagccttcctgggaggggaaggggaagagaggagacagaggcagagagagaaacggacacgtacacccagatagagagcagagaaaaacacagaggtggggagagaataagaggcagaagggagaaaaaagcaatatggagaaagaaacgcagacaggaatagaggcagaaagccaggaagagagcgaggaggacagaggcaggatcaaaaggcaggaaagagaagacgctccagccagcgtggtgccgaccagtcattcctgctgcttagaaggcaattttataaaagaaaagaggagaggacaaggaaacagttactcctaagtaatgaaattgactttccagtttgaagttggatgttgactcagggctctttgacttttgaaatcaatttttcagtttcatagtcacctcttaagaattgttgtccaaactcagtttccttatctgtaaaacaagttaagtgacggtcagttcacagagttgctatgaggactgagcgggttgcaggagcccacatagactgtgagatgctgcacaaggatcaggtccacggttgcagcctaaggggcagaagaaaaggagctccaagaatccccctttgggttgacttttatgaccagctggtgccctttcccagacagttggtctgattggaaatggatccccaagaagaaaacattaatcttcacataaaagatgcccaatattttcagtagatccagctgggtaaccatgagaaagtcacttcagctctctgggtctctttgaaatgacagctggactaaataatattttaaagctacctttagcttaaagcgtggacaaacccatgaccacagggatgaggaggtgctagtgtggtgaaggcttcaccatgggatgaaggctttcatatttggatgtgactgggtgagggttgggctcttctcagatgtcccttcctccaggaagccttctctgattcttccagcacaggtacagtgtcttcctctgggcccccagtccagtgctaccctaacatgtgttatggttgtctgtgagatgactgtttcctaactggaccatgagctcctgagggcagagactaccttgttcagccccaggtgcccagggcccagggcctggcatttgcaggtggtcagtggatgcttgtggacttgaatgggactgaattgccagcccacattctttcccattaagccagacattttcaaggaggaagggctggggccaggcttagccgccggaggctttggaagcaacctttagacaatttgtgctgtgctccaaatgctttctgggagccaactgagattccagggcagctgagagccaaaaagggcgggaggtagactccctggctggagggagcctgggtggggtgggggacaagaaaggggaactacctcaacacaatggctagcatttctcctgcattttctactttacataatatttccacaacaccattttgtttgagcctcatgcgaatcccagggctaagtagagcagttcaatagcacgatttttctttttcagacaagtcggacaagactgagagaggcgaagtgacttgccagaagtcacacagccagatttgaagttgaatcttgaatcctcagatttcaggtccagtgttcttccaagaccaaaaacaaaacaaaacaaaacaaatcaaaacaaaaaaattgggaggtgatgtccatgggtctgtgttattttcccattcattggtagcttaatgaattgttctgtctttctcatcccatcaatatttaaaaattaccacaattggggctgctattgatgggacaccggtaaagtgctttgttgtaagtcctttatcaacattattatatttaatctgatcgatgaccctataagacaagttctattactaaccctattttacagatgaggaaagtgaggctcagaaggaataaggaaccaactaaaaatcataaagccaatgagtagcctagatttgaacccaagatgtgagactccagagtctgagctctgaaccacccaccatgctgctaagatttaattctttacaccaaagcaataaccacgcagtgagtgggttccagcgcccagcgatgagctcatgcaccagtgtcagtggagaggcatgttgttggccttgtgtctccagacttggagactgacctgtcctgggcctgccctgtccactcatgcctgattcttgcctgggcttggtcagtacaggtacactggccactatctgcaaagctggagcagcataaaactaatgatcccaagggtgaagcaaacagaagccttgctcttggcagcctgagctcatcaccaagagtccaccagcctggacatggcctcgtgtcctggcattgtggagcagtgaaaagagcttggtgttggggtcaaacaaagccaggttccaatccagctccgaaccttagacgctggatgaccttgggaaaggtagataatctcaccaaacctcagttttcccacttgtaacaagggcctaatatgagtctcataatataagaatgaactagaacaacctacctgaggtatcttaatgcagtggccaacagatagtagatacttataattcttcattcaagagagggtggcccaggagaaagagcatgggatttggggtcagacagatctggtttcaaatgctggttctgccagctgtaagttgtataactttgtacagacagcaacctctctgagcttcaggttcctcatcaataaaacaaggttgacaacaactgccttagagaaaatggcaaaaccaagaaagggtgtcgggggcaagggtgtgatcagagttcagtgaagagtatcttacatcaacagtaaaaagttgatcttcccctcttccttttcttggagtggagcatgggagaattcattcattatttcatgcatccagccaaaatttagaaacattatctgccatgtagataaataatgatgtaacttggaaggtggttagactgagctgtttgctaagtgcccttgccaatctggggacagcgcagttgtggggagatggactcaggtcttatcctcgaccagaacgaaggtagcccctagaaggtagaaggcatggggccaactacgatggaacattagaagcccctggtctctgccccaggtatccccagtaacacctgtggcctctgtctccctcggccttcctgagccaacccatggcacggttctggcttagctagtgactaaaactccattctggtgatacttttgggttctgtttcctgggtttccctctggggcttattgaaactctgggacattttgcccccgctcccaattccctctctgttaatagctgaccctgcttggctgtgttaatccacttgggtagctgtaacacattaccaaagactgaggcactcataaacacagtttctcacacttttacaggctaggaagtccaatattaaggtgttggcaaatttggtgtccagggagggtccacttttcggttcatagacgactgtctgctcactgtgtcctcgaatgccaaaagcatcaggggatctttctggggtcttttttacaaaggcattaatcccattcatgagggctctgccttcatgacctaatcacctcccaaagccccccccccaccccaaaatacacacacaaatccattacctcaaaggttaagtttcaacatatagccgtgctcagtggctcacacctgtaatcccagcactttgggaggccaaggcgggtgaatcgtgaggtcaggagttcaagaccagcctggccaagatggtgaaaccccgtctctactaaaaactacaaaaattagccgggcacgatgatgggtgcctgtaatacaaactactcgggaggctgaggcaggagaattgcttgaacctgggtggcaggggttgcagtgagccaagatcgcaccactgcactccagcctgggtgacagaatgagacttcatctcaacaacaacaacaacaacaaaaattcaacatatacattttgtaggggggacacaaacattcagtctacggcattagtcttctctgaagatccctgctttgcagtgctgttggtctaaactctaacccagccctctctggcaatgataaatattcatttggtagagactgaactgtggttggaaggaagagtgaggagaatagttccaggtcaaacttagcatgccaagctcctctggatggtaatgagtcagggctagataggggtctgtttgaatgagagtctgatgccttccctaagtgcagtaggagtcagtgcctactagtagagttcaaggccatgagccaggattgaaggagggtagacgtagggtcaatatcaagagtggtatcttttacaaattcattctgtaagcacctactaagtgccaggtcctgttctaggtgctagagacacggtggtgaataagatcgatgtggttggagacaggcaacagacacataaatacatcactatattgtatgttagctgggagatgagctacagagaaaaataaatcaagagaaggggacagagaacgccatgggttagaatgggttcaagtttcaacagtgcagccagggaagccctctatgagaaagcagtatctgagtagaaatctgaactaggtgtgggacggaatcatatgaacatctgggagaagattgtttcagggcaagggcaagggcaatggcctcgaacttggagcacacctgttgtgttcagacgacagccagggcttcatatctattagagctcttattgcctaaaccccttctgcatcatggggatgaggtctgagaaataacggtggtgtacaggtggcagcgggtgtagatcatgtagcaccttgtcagacatggcaatgacttagactctttgtgggatggggccactggatggggtggagtgctagaagggtgacctacactttgcagtgtcatcctgctctgctgagaatatactgaaacagggcaagggcagaaaccagaaagccagctagaaggtggctgcatcgaagggtgagagatggttggattctggagggatctggaccttgggattacagggtttgttaacggatttgattgggtgtgagggtgggtggtgagagaaggggcaagcaaggaagactccaaggtttggggtctaaggcacagttgcctaaggtaacttggatgggaaaggctgaggaaggcacaggttttggggtggggagaagatcaggagttcagttctggaactgtgagggtgaaggcccatcagacatccaggggagacacctcatagcagtctctgatatgtgaatctggagctgcgggttttcaaaccatgacaccaggttagagcaacaaaggaatgaaggtgtgtgtgcaggcagggagaaaaagaggaccaggagccctgagcccagcccccagcccccagcccccagccggtgttgaagctgaagggtaacccagtgacgccaggagggacgctggtgagtgtgtcatcctggagccaaagtggagggggtgtttcaaggaggagcaatggaccagctgtaggtcaaattaggtaagatggagcagtgacctttagaggtcactgaccttagcaggcgcaattgcagtgcagtggtaaatggcagcagggccactcagaagtggcctctgctctggccctgagaagttaactcagaattccaggggaaaggcgaaagtgctttttaaagaagaggggtggggtagggaaacaaggcatgcccctccaatgttcccctgggatctggggagtccaggtgcgggtggtcatgggagagatcgggggacagctctcttgggcaaggtgtgtctctgactcagccattgtcagtcgcgtacaggcctctgtgggtgcccggcagaactggcctataggcagtttctggtggtgaccttggcagagggtgttgacagcagtgggatatcaccaccttcagtcagagttgcagaatcagaacaggaggaataatgccacttgtttgccaagaggacaaattctgggagaccttgtgacaggccctctcagagccgttgaggaaaggcttgcaggggctaaaatgcttaaacagtggaagcagagccaaagaaatcttgttttatgatggccatagtgatggtttacactcagactggtgaggccagagctaaaataataggaagcatttagtgagcacttactatgtgtcagctgggcactctctaagtgctttatgcatgttctgatgttttaaagcataaatgatccttctctgaggaaaaacactgcatactacatattctctaggttgttcgtttattatctgccacttcctcattagatgataacctcttgagggcaagatttgttgattggtgcatccccaactcctagaacagtgcctgaaatatagtagatgcttaataaatacttgctgagtgagtacatgactacgagtcccctaggcattgaacttgatgagccctcactgtgaatccttactgagggtaaagctgggaacagcagccatcctttattaagcaccaactgtgtgcaaagtgctaagcctgtgccctctaaatataggtcgatatcctgcaaccactgagagctgtgtttctggtcactgactcagtttagaacattcgtctccatccttctcaccaaacatttgctctcctcactaccaaaatcttgctcatttatgagctgtcctcctccacggagccacctctgatagagctggcctgcctctggccccagcctcccttcagccccctcagcacaaggttgtgggtctgagctgcgattaaattaaaatgactcattaaatcacaaaaactataatacaatgactgcttctgctactccttctacgactcaccgcatttgttctgagcacttgccgcgtgccggggctctgctgtccctgtccaggcctcatcttgtttcaccctcccaccaccccagaagggcatcctatttcttttattttgcagacaagcaagcagcccctgctctcggccagtcacctaacctccttctgggggtcctggctccttgtcgatctctgatcgacaggagatcagagagttcctgaagcagagatggtggggcaaggctgaagtgcagagtggtgaatgccatgttttaccatggggagcatgcatggggggccggcttctctggcggaagtgtgtgggaagcagagaaatggagcgggggtgagtggaagccccagaatgcagcaaagggaaaaccgagcactctggggaacagctccagcctcccccagaaccactgaaaccaccagaagggtcaggggttggtcccaaacaacatggacttcctcctggcagtgagccagctggagaacctcagcagaggccaagaagagcccctcggggcccctgaggaagatgtatatatgggggttccatcagcagcactgcccctctccatctctgcctgagctctcctttccccccagaaaaccaaacagtagagcctgctggggtcaaagggtcaggttgtatgaaaggtcaaaggtcacgggtcctgtgggcctgcagatacagatcccatgactccaagtcaggccggtgggagctccttcctagtcccagggaacaaccccaggggcccacacttggccacctccagaaattcccaactcctgactcaggctgtctctagaggggctgcagctgcctccagaagaccctgactgccccatgacgatgacgcatagggagcttcctggggaacggctggctccacctcaggaagggcccaggcccaacagactccccagcaggggcctacacccagccaccgctgggcttcttagcccaccagagaccttcactggctccccacgtttcacaggaaaagtccctatttctggcttccgaggtttccaccaccctttcattctcgtctatggaatctttaagaagccccacactccaaaggaatctttattcttgggtgttgatttatcccatacacttaacgcccattgtgcctttcatcaatccctcctttggccaacacagaccaaggggtcaccccaggccaggccctccaggccttgtcctaacagaagccaatgagagagccaggggggtcaccccaggccaggccctccaggccttgtcctaacagaagccaatgagagagccaggggcctgctctcacggagctcacgtgcttgtgtggaattctcatccccattttccatatgagaaattgaggctctgagaatacgtaggcagcacagcagtggtctgcacacaggcttgtctgactccagaactcttcttttaatccccatcctttctcataaccactcgaagtccccggaccatggtggtggtccacacctctgggcctttggacgactactccattgacttggaatgtgctcctcatctcttctccagctgattccctttcctccctccctcccttcctttttttctttttgacacagagtctcactctgtcgcccaggccagagtgcagtggcgcgatcttggttcactgcaacctctgcctcccgggttcaagcgattctcctgtctcagcctctcaagtagctgggattacaggcacctgcaaccacgcctggctactttttgtatttttagtagagacggggtttcaccatgtttgccaggctggtctcaaactcctgacctcaggtgatctgcccgccttggcctcccaaagtgctcacattacagacatgagccactgcacctggcctctttcttttaaaaaaaaggactttgcactttggtcatcctcccagtactggactactgaacactgcccaagcaaccagaccatcctctcctgctgccgcagacctgatatgtgaagagttggtcctgagcaaggcaaacaaagttctgcagaatctcgccttgtcttagctcctccacccggctcccccttcccctcactctgatctgcactgtaaattccagcaagtcctcagacgttccctgagcataccatacagtcctacaccttgatgcctttgctccttcggcacttgctgaaagggaaggtgagcgtctccatgtaacattggccaaacccttgtccaaagtctccagattgagaaatcactttcctgtgcttttcctggtgggtggagccttgttcagggccagagaggcctccagaaattctccctatcttagtcactcttctctccatgggccccacagctggcccagagaaggaggtggaaactccctggataggaagggacttctaacctctgctccccctgcaaggacaatgtgagactcagcacaactccaagtccttccctcccaagtctggcactgggactgagggactagagagcagagcagaggcgcagaggctgggaactggtctggggaaggttggaggaaggaaactaacatcgaacatttactgagaactatggagttccagcactttttgcaaaggtcatcttgttaaatcccatcaccccaatgaggtaggactatgataattcccattttatctgggctaaaacgaaggctcagagaaatgaaattactggttcaagatggcatctccaggttcaaaacagtgaatgctcttgtcactttcacccgctgccttcagacccaccacactgactgttccagaggggaaagcaatcttgagagcccttgaaagctaatccttgaagcattcaaacgttacatggcaagatcacctaattctggtccaaggggctcccatgatgatggagaaacaaagaccagagaagttttgcctggttccaacatctggaggtggcagaaccatgattccaactcagatcttttgactccgagctcagcgttctttccattagtttatctactctaaagacaaagagctttcttgcccaggaaatcatgccccaagcctactgcaaatcccataagcagagcttccactcttctgtcctccaaggatggaggaggaagaacactttgtcattctgttgtgggcaaccttcatctaccatggtggccccagccccaacttctcacacaccaatgcccttctatgacaaataccacttaatgccccttgtactatgttgaaacaaaattcatagtgaacctacgtacacaattttttttaaaaaagttaaaacgtggcccatatgcaccatggaatactatacagccataaaaaagaatgagtccacgtcctttacagggacatggatgaagctggaaaccatcattctcagcaaactaacacaggaacagaaaaacaaacgccgcatgtttttactcgtaagtgggagttgaacaatgagaatgcatggacacagggagaggaacatcacacaccggggcctgtgggggttggggggcttggggagggatagcattaggagaaatacctaatgtagatgacaggttgatgggtgcagcaaaccaccatggcacgtgtatacctgtgtaacaaacctgcacattctgcacatgtatcccagaacttaaagttcaattaaaaaaaaaaagttaactggagtcccctaactgtaacataaagcaaaaatcaaacagaaataatttatagaggcatagcattaggagatatacctaatgttaaatgacgagttaatgggtgcagcacaccaacatggcacatgtatacacatgtaacaaacctgcacgttgtgcacatgtactctaaaacttaaagtataataaaaaataataatttataatgaaaatggacagtctgatgcttgcacctatgcatagaattgccatgcattttacaactatacatgccgactgatatagtttggatgtcccctccaaatctcacgttgagatgtaatcccagtgttagaggtgaggcctggttgaaggggtttgggtcatgggagtggatccctcatggtttggtgctgtcctcagtatagtaagtgaattctctctcgtgagatctggttgttcaaaagtgtgtggcacctcccctgactcctagccacctctctcaccatgtgactttgccttccaccatgagtagaagctccctgaagccctcaccagaaactgagcaggtgtcggggccagtcctgtacaacctgcagaaccatgagccagtcaatctcttttcttggtaaattatccagttttgggtatttctttatagcaatgaaagaaaagcctaacacaccaactgaaatgtttcattaacaactcaaatgccagaagtaggattgccattgtcatcagtgacttgattttttgaaatgattaacaactgtcggaaatgtttcaaataaagcaaagtataattgtcccttaattgacacagtggttgcacttttttttgagggggggtggtttggaggaaaagcaaatattgaaagtgcttcctgccactcatcatcacccctagtgatccactagcatgatttttgcttttgcttcctgttctcacaccattacattctgctggcatataggtcttagttccagagggaggaacactgccaccaggagacacaacaatgattctattaaactggagttaagattgccatctggacactttgggctcctcctaccttttttttttttttttttttgaggtggagttttgctcttcttgcccaggctggagtgcaatggcgcaatctcggctcaccacaatttccgcctcctgggttcaagcgattctcctgcctcagcatcctgagtggctgggattacagcggtgcgccaccacgcccagctaattttgtatttttagcagagacggggtttttccatgttggtcaggctggtctctaactcctgacctcaggtgatccgccagccttggcctcccaaagtgctgggattacaggcgtgaaccaccgtgcccggcctgggctcctcctacctttaagtccacaagctaagaagggagttacagtggtggctgggttgatcgaccccgactatcaagatgaaatcagtctactactccataaaggaggcaaggaagagtatgtgtggaatacaggagatccattaggacatctcttagtattaccatgccctgtgattaaggtcaatgggaaactacaacagcccaatccaggcaggactacaagtgacccagaccccctcaggaatgaaggtttgggtcactccaccaggaaaaaaaccacgacctgctgagatgcttgctgaaggcaaagggaatacaaaatgcgtagtaaaagaaggcaatatcaataccagctatgaccatgtgaccagctgcagaaacgaggactgtaactgtcatgagtatttcctccttctttggttaaaaaacatgtttgtgcatttatacacttgtactaagaaaatattttcattttatttccttttcctttatcatgccacataagatttattgacttcatatcagcatttaaatattgttaactttatgtaatagtatttaggttggggattggtttgtttccggttgtaccaaggatagttgtattatgttaggcataattatgaccttattattgtctttatttgaagattatgtatgatctgaggagatgtgtatgggttcaagttaacaaggggtggacttgtgatggttaatactaagtgtcaacttgattgaaggatgcaaaatattgatcctgcgtgtgtctgtgagggtgttgccaaaggagattaacatttgagtcactgggctggggaagacagacccacccttaatctggtgggcacaatctaatcatctgccagtgaatataaagcaggcagaaaaatgtgaaaagacaagactggcctagcctcccagcctacatctttctcccgtgctggatgcttcctgccctcaaacgtcggactctaagttcttcagttttgagcctcagactggctctccttgctcctcaagcttgcagacagcccctattgtgggaccttgtgattgtgtaagttaatacttactaaactcatatatatatatatatatatgtcttattagttctgtccctcttgggaaccctgactaacacactgcctaaatactttgtgtttgaatttaatatggaattaggttctaggctcagataattataaatgacttttcacctatatggtgtctggtaggaccaaatccaacagtcctgtgggtagcaggacagctgttggctgtgcagagtatcctgtatgcattcccagtccccctgactatctgcccatagtgcccattgcttgtgatgataaccaaaagtcttcccacaagtttccaaactgcatttcaagggagggtcctgtccccatggaggaccattaaccacatcattaagatttactcataagattatatcccaacctctcaatatctctctaagttctttaagccctgtattcagttgtggtcgccagatggaagagacagaagcaagaggaggtggaaggagccccagaattagacagggaatccagcttgcctttccactgctgcattcccaggcctagccagcacacatgaggtgttcaacaaatattcatgacatgaaattattagccgtgtaggcttggggaaattatttaatcttccggaactgtcaattccctcttggtaaatggatggtcacaccatggggctcttgaaaggaccaaatatgagaaagcccaggatatgtacaaggggctcaacgactattagttgaccatgaaaatcgtggtcctgctaccatcaggctgggatgaaattctcaatcatggcacagctaacagaagagtgttttcaaatcagcctgtgactagactacttgacattttggaatgtaatttcttccaaccttgagatctggcagttctgagacccttgtcttgacagagctggtggtgaggagaaatgtccccatccaccctcgacctgcctgattcctacattcctaccacccccagcactcacccacccccagccagcacccacggcacccccagccagcacccacgcaccaccagccagcacccacccaccatcagccagcacccacccacccccagccagcacccacccagccccagtcagcacccacggcacccccagccagcacccacgcaccaccagccagcacccacccaccatcagccagcacccacccaccaccagccagtacccacccacccccagccagcacccaccaaccagcagccagtacccacccaccagcagccagtacccacgcacccgcagccagcacccacccaccagcagccagcacccacccacccccagccagtacccacccacccccagccagcacccacccaccagcagccagtacccacccacccccagccagcacccacccaccagcagccagtacccacccaccaccagccagcacccacgtgcccccagccagcgcccacccaccagcagccagcacccatgcatccgcagccagcacccactcaccccccagccagcacccacgtaccccccagccagcacccacccgcccccagccaacagccacgcaccaacagccagcacccatgcaggcctgcggcccttccttgattgagtctaaaggaaggtctccctccattctgctcctgccctgcccttcggttgaaggagaggagaagcaaacaattactgagcacctcctgcatgcttggagctttattcttccccaagttatgctgctaaatctcgttctcgaagtgggatgaaggggagtgacatcccacacatgaggaaacggggctcagagatggtaagtaatgtcatgtgcccagggtctcagagtgggcatgaggtggacattccttttggagtggtcttcccttccaccacagtcaggggaggttgacagaaggcacatgcagggccccccgtgggcagagctcacatcacaccagcctcccaccgtctaccctagcccacacccacagtgcccaggcttctgaaattcaccaggctctgagggtggggctcctctgtccttccccactggttcagaggggcggtgtaaagacagacagggagagaagatgaggaaaatgtcagcaggcctcaaatgccaggggtactgggagtgagttggaaccagagcaatggatagatttttagcaggaccaaagagaaactttgagtatatttgagagtgagatgctttagaagactatgatgggccaggacacttcacactgcccaggcagctggtccagggtcaaggaaacactggcgtcatagatattgtaaggggttcctgtcttacaatgttcctctcaacctcccatttccagtctgttccctctagcagggggagctcccggggtacacggtgtcccagccagctcttcaatctagaggacagcagctgctgccagcctctgagggctgggaggtggagagttgaagcccactgggtcatctgctggtcaaatgctgcagggggcaatgcatcttcagttctagtgttaaccttgctgcaaaggtgctgtgtgacccagtgccggttactgttgctttcctggcctcagtttccatattgccaagttgaggggattggactagttgattaccaaaagctctctttcctttggtttttatgaggagcaggagcccagggaagaaatgggacatgagagagaggcaaggggtggccgatagaagccatgcgcgtgagtcacgagaaggggtgtgagatcccaaaaggaagctgagcaaatttgcagaatgtcaacaccccagggcaggtcactcctagcccttcactgaccctggaagggagtggggggacaacagcaaggtcaggcttcccagaggccatgggatttagccagcttgctcctgagggctggcagcccagttttgagcacctcttgaaggcagtggggcaggtgcttctggtgggggtgcctctgaaaccccagaatgcagtatagtcccagagaggtcaggtcctgcagatttctttggtgataacagctgctttgttttgcggggaggccacaaaattccttttaaagcaagatttccttcctccatttatttatttacttttcacccagtgattcagcgaaacaacctcaaaaccagtctccaatgggaggcaggaagaaccaaaccctcaaacattagtgtctctgtgaggttttgcctggtggaattttccttaaaataactgcacccggagattgtcggatacgggatggggaaggggaagacctgaaaacggggtcctgcggggcttgtgaatgactcagatgctggagtgaggagtctcaggagtctgccctgagtgccacctgtccttagcgagggcttgggtgggtgatggcatcggttttctcatttcacagactccagagggtgccatcttcctgaagacagaacgagccagtagtttgaaccctaagtgcaagagaagggactcaaggcagcacgtttatagcagtggggtaggattttagcgccatcttgctccctgtccatacatccttcctcagggttaaagcagtgggctgggactggcatcctcttgctcctgtccatgcgtccttccccagggttatagcagtgggctgggactggcaccctcttctccccgtccatacatccttcctcagggttatagcggtgggctgggactggcaccctcttgctccctgtccatacgtctttcccctaattcctaatgcaatggctttagtttctttaactcagtgggaacaacaaacaaacagaaaatgtctttctctttgttataacacatctgaattggaaaaggaccaacaagataaaaggttgtggtggaaatggtgccagattagaaattaattcaggatacctgggatctatttcagctttggtgtattaagccatgagaccttggggaggtcacttcctaaagggcataaagatggccagggtcgcgaaacccagtgtctgcaaccaggaagtcaggtgatatagaagaacaggtctgctgatggacagagcgaggtggggcgggcgcccttgcatgaaagtcacatggacttgggggcacgccctggttcccacttattgataggatgatctggggcaagtcaactccttctttctgagcctcagcttccccatttgtaaggtaaggaaaatagtaatcatctcaaagggctgttgagagaatgcacagggaagagcttggtaagccagaaagcatgagtcaaataggagatactttcattactctagacacttaggagcaaggaatattaatcacatagtcctcaaggggaccaaggctaaataacaatagctacaataacaacaattagtatcttattgagtgcttactatgtgccagacactgttttgaatgctttgaatgtatgaactcatttcatcttttttttaaagtgtaacataacatatacacagtaaattagtaaagtgatctattttttgttgttgttgttttttttttgagatggagtctcactctgtcgcccaggctggagtgcagtggcactatctcagctcactgcaagctccgcctcccgggttcacgccattctcctgcctcagcttctcgagtagctgggattacaagcgcctgccaccacgcctggctaattttttttttgcattatttagtagagatggggttttaccatgttagccaggatggtcttgatctcctgacctcatgatccgcctgccttggcctcccaaagtgctgggattacaggcgtgagccaccacgcctggccaagtgctctaatcttaagagtacttcttgatgaagttttacattggtacatatcatatgagctcatttagtcttcaaggcaaccctacactgtttatttccattttacagatgtgaaaaccgaggcagagccaggactcaaatccagacagtctgcatgctggtagccatgcagtactgcccgggcaatccagtatatcgagatggagagtgtctggagtgactgggagtctgacaggtgaagccaatggaggattctgccttagtaggaaactttttttctgtttgtttttgttttgttttttcacttccccaggtgaggaaaggccaggatcccaagctcagggaagaaagtagatgaagctgaaaggaaaggggaaggagatcagggtatggaaaagcaggctgagatagtagggggaggatttgagggaagcggacaattgctgctgatgactgatgcctccaaaatttggtgtagaagccccccccccctttttttttttgagactgagtctcactctgtcgctcaggctggagtgcaatggcgcaatctcggctcactgcaacctctgcctcccggattcaagtgattctcctgcctcagcctcccgactagctgggattacaggcatccaccaccacacccagctaatttttgtatatactttttagtagagacggggtttctccaggttggccaggctggtctcgaactccagacctcaggtgatccacccgcctcggcctcccaaagtgctgagattacaggtgtgagccactgtgcctggcgaagaccccatttttaatcagctttcttaaggaactggcagacagaggatcaagcacagaaacaaaatgtccccgttttctgtaactgctcaccactcccaggctggggcccactcatttccccatggatgtcacccccaacccccaacttcaccctttgtagagaagccggcaaagactgcgttgagaaagcaagtttggaagagaatgacccaacagcctcactgctgcgggtgctggaggaaccagtgggctgctttcggatcacgagaaatggatcagaaacgcagcagaaggcagcctcgtggcctggaagaacactgggctggaaggcaggttctggtcttggctggggttccagtgttggctctggctgtggatttacataatctcccgctaatatcccaaactgggggaagtcacgtgatgtctctgactcttggtgcctccccactatggaattaggggcatttaaaacttactgcaaattctatctcctgactggagaccccaaggcgtgaatctgaactcagccccttcagcaggttgaagttcacatgtgtgaacattgcagtggtggggagcaatggcaagcctctgccatctgtcctcattctgattcatggacattcttcctccctcatagtctctctcctcaaagctcttaagtaggttgtgaaatcatgactgagccgattgacatcatctccttatttgggaggcaggaagttgttccccacccccaccctcttgtccttccagggccccatcctgcgcccccaccccaccccactgtccagtttccggcttcctgagggtctttgagacctcgccgtttgctggcctggatgacaactatttttccctggtttgagagcgagagagtgtgtgagtgtggactgtgtgcaccagagggccagagaggcagtggtgagggtcactcagaacaagccagtcccaagaagttaaaattagctctgggaactggaatgtcggggtcttcaaggagcagcagctgtgaaaagaaagtacaaggcgaggaaagaaaatacaccccatcccacacccgccacaaacctcgctcgcccacttcatctgccctggggtctctgcagcttctcactcctcccgggatatctctggccaagtccttgaggccgatcagtgggaatttccccctgtatgctgtcattttcctctctggtaaccacagaacaaggtggctgaggattcctgataggacaaggtttaattgaaaaacaggaaagtggaggacaactttggggctggggtggtgacgataatgagaaaatgacaggcgagagggtgacagtggaggagggtcgcatagcaaggagggttcgccacaaacggaaactactcctgggagagctggacacgtgagcgttaagagtttgggcatggctggcaggagcgggaggcctgggaaaggctagagatagagaaggggaggaggaaggctgggggactgtgcacccctttgcacagagacaaagattgggtgttcaaaaaaagatcacacaccactgaatgcaggatcttgtgtttttgaatggttggagcttatgtgtcaaactcaggctgtgtggaagaaccttagagaagggccaggagccaatctgagatggagaacttatagagagtaatcccttataagctgggtctgagattccagtcctgtaaacccaggggccctccaagcactaggcttcctcttccagctctttgtccagatgagagaggctggttttcaaggtttttgttgttgttgttcatttgtttggtttttgtttctgctgaaaaaccaggtagcttgcacctctgtggtttggagaactggaggaggtatttggagccatacaattctgcccgacatggggagaaagactggggcgtgggtgagatatagagcctttggaaaaggcacttagggaagggatcaggtggaagtgggtatgtgctgagcaccttttgtgctttccatgaccccagctgtgtatctgcaggctttcttcttctacttctcatgatcacctagaatagaagctccaggaggaagaaacatgtacaattttctttaccaagaaattcccagcactggaaacaatgcctggcacatagtaggccctccacaacaacctgttcaatcagcgtgatacagcagttctgcaaggtcactgctgttgccatcttttatagatgagggacctgatgctcagagaagtggaatcattttctcaatgacccacagtgaatgaaagccaagatttgaatctccgcacccagaaggccatacctattgcatcgcacagccaatcctattcttatgcactgctgtttcacatcatcacctgattttgtcctaggctcctgtccccacctccgtgagcccttctactttcatcatgtcactgagaaccaaatatcttgatgttttcccccaggtacccagtctaggattcccagatatgctccaattcatccttcctctaaataaataaagtatcagtcccttgtacccttcagaataaacctttccagaggtttactttggttgagtgggaatgggtatagacagattccagctgaatgctgcactgactgggcaacactccagattatagaattaaatacgctgatactaaaatacaggacttacgtgtgcaattctgatagacagttgggtatccacagtagaccatttgcgaccccatggtctcaacttccttctttcccctgacagttcttacatctctccctcccttccaaatccaaatcagttataggcctgtgccttccgggatagaatgaatcctattctccaatcatcggaattgactcaatccctactgcgcatcagggatgctacacatgttatttgtgtactttgcacacctgcctactcacaactccttttcctctgcccacaagcacacttggggttttgctttcgtaaataaagtcaagtgttcttctgaccctcaagtagccttctcttcttatttttgtctccacgtttcttaaaggaatattatctggttactgctttcatgtcccctgcaatccagtttctgctcccactactttcctaggattgctccttcaaatgattgctggtgacttcacacacacacatacatgcacacacacactcttatttgcatgatttatcttccctcattttgagatccatgttttgactgaattttcatttgattggaatacatccttaagtaatttcctcagaaagggcctatggatggtatcctagggtgttagagcccctctaatatgaatggcgtcatgactaggtaagggaattctagttcatattcatgtctttcattagtgtaagaacattattccactgtctttgaacttacattgttgcagatgagtaatccggtatcagctttcttttcttttattttctttgtaagtagactgtaatctttctttctctgagaacatttaggattttctctttagagctcagaattgtcaccagattttgtctttgtattgattttatcattcatctttctaggacttggggactcttctctaccaacacttccttctcttgttgatctcactcagcctcatgactttaaatataatctatgtgttaactactcccaaatttacctagactcaattgcttcttcaacatcttcccctggatgtctaacacgcatttctagtttaacatgtcacccctttgatcagacaaattaggtatttctttagttcagagacattttcttctattatatctttaaaagtatcatttctcttccagttactcctctctctccttccaaagttccaattatttgcacatagctctgttgggtctgttccttcatgccccctatctttttgctcatgatttccttttctttgcatttctgctaagtgccctgagataacccagctctggcttccttctgggaaaattcagtggtctttctccttctccttggtctccctgaataactttatactccttttctttcaactgtctcatttctaggctgctggaaagacatgcttcatctacatattcgcccctttctctgccttctttgatggatggctttcctctttttacccctaaaattaggatgtttcccaagtttatgcccaactctcttctctttatatttctttcctgggagacctcacctacattctcaggttcaatcgccacctctttgctgatgattctacctttatcccagacctccttctgagctccaagccatatatgtataatcaactgcttcctggatatctaatgtgtgtatcccatgggcatttcaaatatatgttcaaaacaaatcttgcctttctatgtactataaacactctgttttatcttattttttctcttggttgcaaaaatataccacatctgaacatggctggagaaaactgtgaccatgaactgcaggactcatcccatagtacttcctgagcccattcattctcctactcttccaggcaactatttaacattgcttcctttcatctcacacttctcatatgtccttctcctctagattctcagtgacgatgattttgtttcaaatttcattgaaaacattagaagcaataagaagagaactgccaaagctctcagcaccacatctacccaccttccagtacctattccatataccctgctttccctcttgctcctttgcatgaaccctgtgctcctactccatggaaacccttcacttgtgctctaggtatcacccctttcgccgattctaggacaatgctccacccacatctcctctttctccggcatccacttttctttttctaatggatcatttccattcatttcaacacgccattgtaatatcttccttaaaaataaaaaccctttcttgaccctatattcaccatcaattaccacccatttcccccctgttctactttacagcaaaaagtctatacctctggattctgctctctctttcattctctctcgacctcactcccatccctccacctgctatggtcatcaatgacctccatgttgccaaatataatggcagaatttcagctcttgttttacttcgctatgaagctgcacttgacatagttgatcattccacctctttgaaacactttcctcacttggcttctgggacaccactctctcactcttgattctcatcagctgagttgaactcagtcaactttgccggtggctccttatctccctgacttctgtgtttgttttttttttttttggagactgagttttgctcttgttgcccaggctggagtacagtggcgcgatctcggctcaacgcaacctccgcctcccgggttcaagttattctcctgcctcagccttcctgagtagctgggattacaggcatgcgccaccatgtccagataaatttgtatttttagtagagatggggtttctccatgttggtcaggctggtctcgaactcccgacctcagatgatccgcctgtctcggcctcccaaagtgctgggattacaggcatgagcaactgcgcctggcctctccctgacttctaaacactgtagcactcctggctctgctcttctctctccacactccctcccctattgatctcattcagtctcatgactaaatatcatccatgtgttgacaactcccaaatttacatagattcaactgcttctttaacatgtcccattggaggcctaataggcatttctagtctaatatgtcagcaggcaaaccctgacttctagcccccctgactgttcaatctgcagctttccccatctcagttgatggcagctcctttcatttgctcagccccgaaaccttggagtcacccttaactttttctcttgcactccacatccaatccatcagcaaattctccttcaaaataaaatcagaattgacctcgttttaccacatctatcactaactcctgatccaaggcaaattcacctccatatgctctctctatttctgttcttgccccacaaccaatctcttctcatagcagagtggtgatgccttcagatgtaagtcaaatgccactcttctgctcaatgctctgcaatgacttcccatctcccactgaataaaataaactccttaccatgagccacagggcctgtgtgatctgctcttccctatccccataacatctctaccctcatcttctgcctctcctcgtcactctctctgctcctcgtgctgctcctagaacaccccgagtttgctaccacctcggggcctttgcacttgatgttcccttgttctaaaacctcttctcccagaaacccacatggctctctctgtctctgtccttgttcatgtctctgcttcgttggagagaccctccttacccatcatataatacagcaactacatggttcctgacattccatattccccaattaataggtgtaaggccctgagtcaaggctcttaacagttctgtgtctctgttttctcctctgtaaggtaactatagcaagagcacccattctataaggatgctgggaggattaaatggattactcgatatgtagcacacggaagagtgcctggcacatatgtgttcaattaacacatatgtgttcagttattattattatttatttattttactttaagttctgggatacctgtgcagaacgtgcaggttcgttacagaggtatacatgtgccatggtggtttgctgcacccatcaacccatcatctaggttttaagccccacatgcattaggtgtttttcctaatgctctccctccccttgcccctcaccccccaacaggccctggtgtgtgatgttcccctccctgtgtccatgtgttctcattgttcaactcccacttgtgggtgacaacatgtagtgtttggttttctgttcctgtgttagtttgctgagaaggatggtttccagcttcatccatgtccctgcaaaggacatgaactcattcttttttatggctgcatagtattccatggtatataaccagccttgccctctgaagttgtccaccatggagatgttaaaattctgaaagttgagtaccggaggaaaaaggttcaaccacagagttggtgaccagaagccacccctaacctccctgccaggctctttgggcccctgtgcactgcatctgtaacacagcacagtggcccctgcccaggctggtggaaacaacacttggtgaagaatgggcaccaggaccaggtctgcatctactagctgtctgacattaggccagttacttgatctttctgagcctcaattttccttctttaaaatggagataatatctgcctgcctccctcacaggggagggtcacaggacacactgatgcccaaatacatctacatcatattcggtgtacatgactggccatttcaaataccctacaaaagatgaacaatgcccattattcattttcaagcttggggactatattaaacaatgcacactgcacatggagattacccgtgagtctctgtggtattcattcattcccaaagcaaatggtcattcatgacatttgtgctacagttttactggccaaggaagacactcagaaacgaatctagatctctcttccaacggtcaaaattagaaaggggagagggagtacatttcttaggcagctgctgcttggaagcaggtttgtttgagggttggggagcacagccgtttaatgtgggaagggtggttgtgtgcatgaggctgcactaggctgtctggagagcagttttagcccagagaggatggggcaaaaccctcctaggacatctgaaaaagccattaagcctggaagaaaggatcctacattggaaaatagaccttttctgctagaaacttccctcattctttctgtccctgaggatagtgctgggccacagggggggagaaaagcaggaccagaaggtcaagaaatgctgcagatgttggtgttgttttgttcttcttctttctttttcttttcttttttttttttttcaagaggagggaggcaggtatgagggagatcaaggcagccctagggagtatctaacaaaatggagaaccctggtgtgaccccagatacagatgtggagtgagcctggggcttccagaagggcagaatcagaggtaggagctgtcccatctcgggcaagcttccttgtccttccagaacaagggtcagcaaagcttttttgtatagggacatgagataggctgaaaaatgatccgcctccctccaccaatgatatcctcacccctaaagcccataaatgttaacttatttggaaaaagagcctttacagatgtgattatgttaagaattttgagatgaggagattatccagaatcatctgggtgagccccaaatgctcacatttgggcagaagaggcagagggagacttaagacaaaaaatgattagtgtaggagaccatgaggccagaggttggaatgatgtggctgcaagtccgggaatacttgcagccaggagaaactggaagaggcaagagagggactctctcctcaggccactgaagggaggatgccctgccaacatcttgatgtcagcccagtagaactgacttcggacatctggcctccataactgcgagacaaaaaatctagctggtttggggtttccaattctgtagtagtttgttacagcagccacaagaaactagtgcaagctagatagtaaatatctggggctgtatgatctccctcgcaactactcaactctgatgttgccatgtagaagcagccatagacaaggaacaaatgaataggcatggttgtgtcccaatacaactggggagcaaaggccctgtccaaagaatggaacagtgtcgggcgtggtggctcatgggtaatcctagcactttgggaggctgaggtgggcagattgcctgagcttaggagttcaagaccagcctgggcaacacagtgaaaaccctgtctctactaaaatacaacaattagccggccatggtggcatgagcctgtagtcccaactacttgggaggctgaggcaggagaattgcttgaaccctggaggcggaggttgcagtgagccgagattgtgccactgcactccagtctgggcaacggagccagactctgtctcaaaaaaaaaaaaaaaaaaaaaaaaaaaagaacgcaacagtgacagtagtgattcagcttcagtaggttcttgctggctggggacaaagatctgagacggccagatcctcctctttctcaaaagaggtgggaattacagatttttatgagaaattttctggatgtaattgttggtagctatcttcaattctggttgatgtcatgcagactgaagaaaaacacatctgttcagccatatctagcccttgagcctccaatttgcacccactggtctattgtatgctgggctctgggctgggccttgaggacagtgtctgttcataagaggatcatggtcaagtgagggagacagacacactgatgcagtgaagtattacagggcctgcaactgaattaggtagagggtactatgggggaggaaaggttgcttctatctgaagaggaaggagggagagtgaggaagggctgcagggagaactgatatccaaagtgagtcttgcaagatgagctggagtcagaagtggacaaggtttggaacggaactgccagtaggagggctggtagaagcaaaggaagggagatccggggaagcagaatgtgtctgaggagcaagaagttccagtgtgtgctggtcccaaggacaggaaagaaaagagtgagatgggcttggagggagaggaagggagggtcttgatgggatagccatgaacggatcttggattgatcctggggacaagaaaaaccatgagggtttgttatgaattgaaaaatgtaacctccaaaaagatatgctcaatccctcacccttggtccctgtaaatgtgaccttatttggaaatagggtctttgcaaatgtaatcaagttagaatgaagtcagtggattagggcgggctttaatccaatgactggtgtcctcataagaagaggaaatttggacacagacacacagagaatgccgtgtgatgatggaggtagaggttaaaactgggaatgcccaggattgctagcaaccaccagaaactggaagagataaggaaggaccctcctcccctcgagtcttcacagagatgaagccctgtccacactctggaggcaagaagactgggtagggtgctgttggaacaccacaggcaagagttttcaggagcctcaaataaggctcaccctctcctctgttttaagcattgcactttttttttttcttttcccgatatggagttttcttgcccaggctggagtgcaatggcgcacgatctcagctcaccgcaagctccgcctccggggttcaagtgattctcccgcctcagcctcccgagtagctgggattacaggcatgtgccaccacacctggctaattttgtacttttagtagagatggggtttctccatgttggtcaggctggtcttctcctgacctcaggtgatccacccgcctcggcctcccagctttgcacttttaaatgagcagagtgtttagaaactgaacaggggtcttgtctggttacccattccactcattcaacaaatgctgagggcctccgtggagctgaggcagataagacaaatgccaatcctgaagaaggcccccagcttcctcctctgacctatctgtctcagcctgcttggacagccataaacttagcagcagattttattttctcatagttctggaggctggatgtccaagatcaaggctctggctggtgagggctctcttgctggcttgtagacagccaccttctcactgtgtcctcatgtagcctttccttggtgtgcatgcaggagtgtggagaggtggactagggagcaagttctctagagtttcttcttataaggacactaatcctatgagatcagggtcccacccttctgaccttgtctaatctaactacctccttacaggccctatcactaaatacagctgcactggaggttgaggcttcaacatgaattttggggggacataattcagtccttagcagcatctgagccacaaacacctgtggaatgccaagagagtggtgacctggtcctccctgttcccacttcccatagcagataactgtcgacgaggagggtgactgaggcaaaagtaccccttctcctttgcattgcagtagaggacacatgtatccttagcctaatgcatcctccagtctgcacaacccagaagggtggccccagtcatacaaacttggcaacactcaaacaacccaccaacctcaaggtatcatggtagtatagccataagtccttgagatcaggagttctgctgccaaggctacattctgccacttcctggccctttgagataatccctctccacctctcagagcctcagtttccctttatgtaaaacaggatgattaacaatcatagctactgtttctaagtacctactaagggcttagtatctgttgtcagctgaaaaatggccttccaaaagatattcatgcctaattcctgaaacctgtgaatgttacctcctgtggccaagaaaaaggaagtggcagggggctgtagggggtagaggtttgcttatgtgattaaatgaaggacctagagatcaggagattatcctagatcacccaggtgggccctaaatacgatcacgtgtatccttatacgaggcaggcagagagagatctggtgcccgcagagagagagatctggtgccctcacagaggacgaggccaggcagatggcagcagaggtcagagctttgtgtccacaagccaaggaacttggacagtcatcagaaacaggaaaggatctcccctagagcctctagagggagcacaaccctggcgacaccctttttttttcagcccattgagaccagtttgggacttctggcctccagaaatgtgagggaataaatttctgtcattttaagtcacttggtgaatggtactttgttatggcagcccaaggaaagaaacacacacccattatctcgataaatcctcagagtcacccatgaggcaataagatagtcatgccttaccaggtgccaggtagtgttcattcaatattcacaacagcactaggaggcagatactgtcaacatcccattttacagattaagaattgccacccagagaagtgatgtagcttgcctaaggtcacacagcgggcacctgtgccaggctttgaatgaagggtctggctccaagttgctgccttaggccaccttgaggcgagctctttgcaccagaatggatgctctgtttcctgagccagtcacgcagccttgagcaatggcttaccatgctccctctgcactaccctaagtggcttattctgggatcctatgaggatcagatgggacagagggcatgaaaagcattttgtaaactgtaaagtgcagtgcacggagaaggcataagaattcaaagtggaagcaaacctgcttacctagctggccatggcaaggctaccctggtcatcactgagataggtggggacaccagcagcaggagccgccccctatcccttgagcacacacaggaaagtttctaagcctcgaagtgcccgtgggtgaactcacagatgttaccacccagaaccacaatgctgacctcacagcatgatcactagatgtcacgtgagttcttcaagcctgaatccagccttgtaccagctcatcagcacctcctcccgacctgcccttctccgtggctttcaaattcagaaccagttcctcccagaatcacataatttctttagctgtaatgactccttcattccacagagaaggagacaggcaggaacatttagtgacccatcgaagaccacacagctagtatattctatcgaaagcatccttcgtgtcccagctgtgggtctcggtattcccagctccccattcatctcaggcagctagaaattctttctggttgggagaatcctaaaaaggggaaactggcatatgggcacattagatttcatttcatggcctggagccagcctgctccttctttttttttaatccaattattatcacacagaaacctgtttaggaagaaaagtcctgactcggtgcaatattgtccccagtatgttggtagggactttacttcagtggatctgtcagagccccagatgccaagtctatctaaacattctatcatcagttcatcatttttgcatccatccatccctcattcactgagcttcctgagctcctgtgtgtcgggtaccgtgctagacactgggatataaagaatatccccaaagaaccctcagatttacagggagagaggcaagaaaataaataatagcagcatttctgaaactcacatattagcttttcttgcttatgatttttgtcattttcttgttatagtttactcttcatatttacttagtattttctttgaattaactcttttttttgtcttacttaaatgctagctttgggttcaccctaagcaataatatccatgaattcatggatttaattggctagttttttctgactacatgttgtactaaaaagtttaactattaaagaaagaattcctgggatgccacctaaaaccatcctgcgtctcagaggtatgtgaggcttccagtgagaaacactacattattgctaaggaggcccctacgtgttagaatagagtctgccagctgccactccaagaggacaatgcttttatcctatcaagtgctggctggtgaagacacattaggattaatggtttgataaacaacatctcaaggcaggacattctatggcaggaagcagataagtctgtgcctttcactcaaggatctcagaaacattaacttctcagttttcatgccctctaagtgggagacaaggctattctcatgcctcatttcctagctacaggaaaaggtgttctgtgatgtaagactgcatttttttttttgagacagaatctcaccctgtcaccaggctggagtgcagaggcacgatcttggctcaccacaacctccgacttccgagttcaagcaattctcctgcctaagcctcccaagtagctgggatcacaggcacacgccaccatgtccagctaatttttgtattttttttttagtagagatggagtttcaccatgttagccaggctggtctcgaactcctgaccttgtgatccacacaccttggcctcccaaagtgctgggattacagatgtgagccaccgcacccggccaagactgcatttttttaatctcctgtttccatcacaacacaatgacggatgatattcccatgggagccagtatcagggtttacgctgagtgaagcggaatccctaggacttgcatttaactgcagcgtcaccgaagaaagtgcgtcaaaatgcaagcaaaagaggatgacattattttgaagacaaccttcaacataccttaatttgtttcttaataagaaagcaacacacaaactccaggacttttactatcaataataaaaactgatttgtaacactttgctccaaataaatgaatataccattgtattgggtacttctcatttcctttattaatttattccataaatatttattgagcacctcttacgtgcccagcttgccttaggcactggggttagaacgatggctcaagacagacatagtccctaccttcatactactagtgaggaaggctgacattaatcaaataatcatccaaatgaatgtaaaatgtaatgtaaatccaaatgaatgtaaaatgtgatgtgtggccacagaggattgataggaatggtgaatgatggatttaaaatatgaagcaaccagccgggcatggtggctcacgcctgtaatctcagcactttgggaggccgaggtgggtggatcacttgaggtcaggagtttgagaccagcctggacaacatggcaaaaacccatctctactaaaaatacacaaattagccgggcatgatggtacacgcctgcagtcccagctactcaggaggctgaggcaggacaatcacttgaacctgggaggcggaggttgcagtgagccgagatggcgccactgcactccagcctgggcaacagcgtgagattctgtctcgaaaaacaaaaacaaacaaacaaatctatgaagcaaccatacaagagacatcactagtcacccctcattaagtttcttccacaaaccagattgtctcatttaatcttcgctgcaactctccgaagcgggcattattattcccactttacaagagaggaaaccttggctctgagcagtgtaatgacttacccaggggcactcagctggctagttgcagagctgggaatcaaacccaagctgtgcttttctcccaaatgcccagtctccccaggggatgcatgaataggaaaaacaggaccttacgtactttgcaggttactaccgtgatgtccttgctagcgactcctccacgctttagtaccatcaagggtccaggttgggcaagtactcgaacctccattctgccctgggataacctgggcagaaaagccaaacacagcaggggagcaggaacaaagcgctcccttttatggtgaggcggtgcaaacctctgcatctgcctccaggccttgccaaggcccacagagaaatggcctgccctaaagattgcagtgagctgagattgcgccactgcactccagcctgggtgacagagtgagattctgtctcaaaaaaaaaaagagagagaaaaaaagagaaaaaaaacagaaatggcctgccctgactgagcccgaagccttctgccctgatctctgcttttctttgtgtacctgtctggttacaaaggaagcagctgccagctcactggtgtgggacgccatgtctggtctgtgctttgctgaactgtgctggaatttcacgggctgaagctggccctggggggtgccgggaggtgaatgagagaagtgtctcaggagtgttgttctgggggctaaaattacaggtgatcggacaactgctgtaggagatggagacagagcagcacctgagttgactctaaaaccagagggcctctgtgcagtgcgctgttggccgctctggtttccttttcgcatctctgcagcccttggtattttctacctgtgttatcagagaatctctggctgaggaccctggaaatttctgcccccatctccacccttggaagcctttccacaaagagctttgtaattcaccaggtgccttgcatatgggagggattacaccttgacctcaaatatttgctgttttcgtcactggctcagagcctgggcactgaaataacactgcatggttggaatcctggctccctgacttaccagctgcatgaccttggacaatctactgaacttcctgtgccttagtttctttatccttaaaatggaggtaataataatattaaccacaatgtaggcttgttattataaggattaaatgatttcatgtaggtaaggcacttagcagtacccagcgtaataagcacttaatgagagcaacttggtattattgcctgcctgcctgcctgccttccttgcttccttccttccttccttcctttccttccttccttccttccttccttccttccttccttccttccctccttccttcctctctctcacccccttctttctttctttctctctctcttttttctttctttcccctccctccctccctcccttcctccctccctcccttccatcctcccttcctcccttcttccttctctgcatccctcctttcaataaacaaatccttttaaattgtataaagccctggaactaccaagacctgcaaggctcaatagctcgtagtcttgtccaaggttccacagacagaaaatggactcactgggaagtgccatcttttaggaattcactcttatctgactcctccatcatcctccctctcaccctcatggtgcctagcatagtaccttatagaacaagtacatcctcaataaatccctgagagcctgaatagatgatggtggttaaggacacaaagcttagggagcaaggctatgtgggtttaaatcctgactctatcaccaataggctacatggccttggacgagttacctaacctctctgggtttcagttttccccacctataaattggcattacgataatgcacttaccccacagggctgggctcaggcttaaaggaattaataataaaatgtttatatcagtgcttggcacatagtaggtgttacttaggtgtttgctattattattatattagcaaacacctaaggaggtgttacttaggtgtttgctaatattattattattattaatattattattattattgttgttgttgttgattggctgagctagggctgagacacaattgctatttgagagtctcccagttcattttctgatacttttctcctccaggactgccttaggattcttgggcacagagaattggattactgagtagatttacagcagactatgcttctcctcctcctttttcattctcttacaaaacagttttcttttttaaacagaacagacaagcaatgtcaaagatttcttatttcgcaatgaagttttccttccatgtgttctcctctttctatcttctcagaaggttgttttttccccttcagaactttttttctgaaggaaaattccatagtaagaaggaaacaaaataagtttcaggctctgtaatttttttttttttttgacaaagtttcaccttgtcgcccaggctggagtgcaatggcatgatctcggctcactgcaaactctgcctcctggtttcaagcgattctcttgcctcagcctcccaagtagctgggattacaggcgggtgccaccacgctcggctaattttgtatttttaatagagacggggttttaccatgttggtcaggctggtctcaaactcatgacctcaggtgatccacccaccttggcctcccaaagtcctgggattacaggcgtgtgccaccacgcccagctaattttgtatttttagtagacatggggcttcaccatgatgaccaggctggtctcaaactcctgatctcaggtaatccacccaccttggcctcccaaggtgttgggattacaggtaagatctaccacgcctggccaggccttgtaattcttttttttttttttttttttgagacagagtctcgtactgtctcctgggctggagtgcaatggcatgatctcagctcactgcaacctccacctcctaggttcaagtgattcttccacctcagtttcccgagtagctgggaccacaggcgcacaccaccacagccggctaattttttgtatttttagtagagatggggttgcaccatgttagccaggatggcctccatctcctgacctcatgatccgcccgcgtcagcctcctaaagtgctgggattacaggcgtgagccaccgtgcccagcccaggccttgtaattgtagcagaggatttggcttccctcagcctatggatctgcgccctgaaggatgaacaggaattagtgaagcaattctctattgagaaggagcaattctctattgagaagcaactctctattgagaggagttagttaagcacttctcattgaagcttcccagagagtagtgagaccagaacctgttattcccattaaacggtatgggaattgaagatctggggaagccaggtacttaatcttagtccacagcagagaactaagctcaatgacccccttcttatctttacttagcttctcggacagtcactaagaccgggtttctcctgtgcttcctctcttgatgcaggtttatattgcctggatgcctgacttggaagttcatggtacagttcagggccttgaaacaggtgagtatgacaaataacagacctgtggcctcagttggagagacaatacagaaggctgtccactgggacgggttggagtacacttgcttcatctaacctggacagcatcttctaagcccctgctaagtaattccttgcaatgtgggcccggagcttctggtttttcaggagaagctggaaactggaattactgaaaatctgaatttttctgaaagtttgtgaattacattttaaaatgcggcatgaaccaaacacaaggcatctgtgggccaaatccagccttgagattgctagtttttacatggtttttaatcttcggatttaagggggcttagaggatgtcttgtccactgttctttaccatgctggaatcccctgtgcgccgtctctgaaatacagttgttcagcctccaactgaaatacccctgctctctcctgctaggagtttgaaattcaccagaactcacagttttacttgctctttatcattataaacccctaatctaccacctggcagcttttaccctttggtcctagtgtcttttgggggaaactaaacaaaccaatctcatctttggcacaaaccaatctcatctttggcatgaattctgcagccaaactgcctggattcgactcccagcaatactataactgtgtcgtggtaggcatgtgacttgaactatctgtgcctcagtttccttacctgtaaaaaggggatgataatggtatttaccttacaaagttggatgaggtttaagtgagctaatatattcaaaagtccttggaaaggcaatataagtgtttgttattttttcctctttctcaggttaaactttgcaagtgcttccaactatctccagaccctgtgttttctggggcttttgtcattctctctactctgtttggagggtgagccaacgtggctcccttgatccctgactcttggtattcacagccttgcctaattcctccaccttgagtgatggtggggcttgtgatatgcctttaaccaatagaacatggcgcaggtgacagggcatatgcgattatatgaatatgaacaatcatgttacatgaggctggaatgcccatcttgggaggaggcactttttcctgctggctttgaagaagcaggttgccgcatggtgagctgcctgtggagataatcacatggcaagaaaatgagggtgaattccagctcacagccaggtagaaactgaggaaccaaatgttgccatcaatcaagtgagtgaggaagtaggtgcttcctcagtcaagttccagatgaaactgcagccctggctgacatcttagtttcagccttgcagaggagccagctaagccatgtccagactcttgtctcacagaaatcatgagataataaatatgtgttatggtaagctgcagagtgtatggcaacattgtcatgcagcaatacataggtaactaacaacaatggtaactctccctcacctaccttactttggaagttctctacttatgtcagtgtcctatttaaaacagaagttctggaagagaacagcatatcgcagcaggcattatttgcacactgcatgagctgtggccataaaataatgttgctgattttctaatgggcacgagagaacaaatgcatgcaaatgctcctgtttataccagggcagggcttgagccccaactgtgcacaaagcactgggctggatcttctgagacagaggagccttctctccccttcctgcctccaggtatgatcacttggtacaagtgatggtggcagctgatctgttttccttcctaattctcttccctcttttgttacttttctttattgaagaggaggcagaggaagaaaaaaaaaaaggacaaaaaaaaaccaggtgaatgcatatagtctgttacagctggaggggatgagaggggtcagtcggtgcagctctggggtcagtcggtgcagctcttgttgtggagggttatacagagactccatggctcctaagtgatagagccagagttagaacgtctttgacacttggcccagggctctttccttcaattacaacttgccatttttttccttgtgagtactaggaagttgacaccatgcttccgggtagagtcttgggtgttacatgttgtcagagggtccctcgtactttctttttgttcttggccaaagggatccccttctctgaacctcagtctccttctctgtaagatggagtcctggggggctgatggaataacacatgctggctcccagcaagtgggagagaagcacttggcttgctcccattagtgtgttcttctgcaaggatttcaaatgctcgtgcatcccactgtgcattcaagtgttgggaaaacatttattgtgcctgacattttcccagagagtgttttctcagattaaaagaaagtagtcaaactttccccttctctgattaccttaactgaaggagaccctatatgctccacatcccacaagttactctgtcttatcatcttcattgcactcatggcccgctgagatggtttatccatctgtttctgtgtccaccaggccaacgcaagctctctcagctctcagaacaggactgtgtctgtcttgcttcctgctctgtctctgtacccagaacagggtcaggcctggtgtaggggctcagtaaataaagcctgaatgaatgacagaacctgtcttgcttttgcctatgagacttggcctgagaagaaggagaaatccaaggaattcaaaccacttcaaagaagaagaagaagaagaagaagaaaaaaaaaatacagcattctagcaagatacaatcccatttacttactgcacactttccacatcccaagcagtgcttggcccttagggctcccatttaattgggatatctcatttaattttcatatttgccgtatgaggtgggtgctgttagtgcccttgtttgtagccgaggaagctgagttccagagaagcaaaatcttttgcataagagcacacagtgaggtacagttagggtttggaatgcaggcctgtgtgcctccagggctgaactgctccacactacaaaagttgatggtgtctttatttctaggaagtacatattgaaatattcaggggaccaggagcatcatgtctgcaacttattctttttttttttttgagacagagtctcactctgtcacccaggctggagtgctcactgcaagctccacctcccgggttcacaccattctcctgccccagcctcccaagtagctgggactacaggtgcccgccaccacgcccggcaaattttttgtatttttcatagagatggggtttcaccatgttagccaggatggtctcgatctcctgaccttgtgatccacccacctcagcctcccaaagtgctgggattacaggcgtgagccaccacgcccggccctgcaacttattcttaaacaacctaaaggaggggggatttaataatatgttaacatttggggaatctgggtaaaaggtatctggtaattctctgaactattcctgcagcttttctgttaagtgaattatgtcaaaataaaacattttcaaaagctcatggtgggaagaagatgagactcatgtcatgggatgaagggcacaggtcctgcttggctacaataaagagggggaatgggaggctggggcagactctgggggctggaaggaccaggtttcatcagggaggcagtgttcaacacggataggaccagtgatgatactctgtctttaaccaagtctacccatacttcagcatcccgaatgtgccaacttcttttttttcctttcttttcttttcttttttttttttttttcctcactctgttacccaggctagagtgcagtgatgcaatctcggctcactgcagcctccatctcctgggctcaagtgattgtcctgtatcagcctcccaagtagctgagattacaggtgcgtgccaccacacccggctaatttttgtatttttagtagagataggatttcaccatgttggccaggctggtctcaaattcctgacctcaagtgatcctcttgcttcaacctcccaaagtgctgggattacaggcgtgagccaccgcacccaaccctttctactgttttctagagtagctgtctgtgggggaaggttatatatatccatcctaaaatatatgctttcagatcagacagacctcagtgacatcgcttcctattggtgcccttgagcaagtgatttaacctccctgagcttaagtcttctcatctggaaaatgaggatgatgatgtctacctcactgggttgttgtgaagattcactatttcaaaaaaatatttactgagccttgatctgggataccggggacagagcagtgaataagacaggcatcttgcactgttttctttgtgcagctagaaacactaattgtttagaattaaaggacaattaataaacattttaataagtttttttcagatactgataagcccagaaaagaaaaatccatgtgaaaaatgagaccctgggaggctccagtgactggggatggctgtgctcctccgctgcggcacacctccccgagaaggtaatatctgagctggaagctgcagaattagaaggatctgactggccatggcaagacctgggagaggcagagggagggtcagggcagtcctggagctgggactgagtttggcttggttaaaggaggaaaaggaggtcagtgtagtgtaaacacaagtgagagtgggagagacatggacagccacagcaggggcaatgccacgctgggtctagaaggccaaggcatttagacttcaagtgcattagggatccaccatagagttttgagcagaagagtaatatgatctcgttttttttctcttgaaatcggataatccagtcagccctctgtatctgtggattccacatcgggattcaaccaaccgtggatggaaaacatttggaaaaaacaaacaataaaaaataacaatacgactatattaaaaaaaacatgaatttggctgggcgtggtggttcacgcctataatcccagcacttttagaggccaagatggacgaatcacgaggtcaggagttcgagaccagactggccaacatgatgaaaccccatctctactaaaaatacaaaaaattagctgggcatggtggtgtacccctgtaatcctagctactcaggaggctgaggcaggagaatcgcttgaactcagaaggcggaggttgcagtgagcagagatcgtgccactgcactccagcccaggtaacagcgcaagactccatctcaaaaaaaaaaataataataatatggatttaaaaatacagtataacaactacttagtatttacattgtattagatattataagtaatctagagatgatttaaagtatgtgggaggatatgtttagattatgtgcaaatactataccattttatatcaaggatttgagcacctgtgaaagtcctggaatcaatgttattaatacaggacctgaaacatgatagatatttaataaagaacagctttattattgtttatcatgacttggcattgccactagtcattacggacttctagaaggtgggcggcctgtgcctaccttcattctagaggcatgcatcttggtgcacccacctgcctggggaaaggggagaggagtgggaacaactcgggacacctctgacttccttcctcctccttgccacatgctgcccccccacccccaacaagccagatgccagtcacctctgccaggccaaggggcggccagggtaggattgctgggcccccctccagctggctccggctccaggcctctgagccgccttcactttgccttaaaaatgcaaagcattccagccattttaattactgggcattgcataagccagcaaccagttcatacaaaggagcaatagacaaaaaaatgatttttcaacatgccttcagcctctccccttctttcctcctgaaatcagcccccaatcactgcctcccaggcctagaaaaagcactccaggtatgcacaatctctttttgagtttgttgatgtgacatcaaggtcttttttctctaaatacttgaggcaaaaagcagttccagccaccttcaagtgttttggaaagttaccgatcatattcctacttgacatgctaagacaatcagaggactccatattatatacactgagaactctgatataaaacagagttcattgtgcagtgggtctgtccaggcaccaattcagggcgctttcagttctggaatgactttactatggggtactcctaagaaatgaacctcaaacacaatgttccagcaatgcttttgtgtggagaattattagtacttaaatatttatgtgattggggaagcttccatgtttcctaattctgatttttcagtagcctctaaactgttttaactaaatttaatccaaaaatttgttgaggacctactgggtatcagtattggttacgttcttggaagaggaaattcaattagccctgtcaattagctcactttctaaagagggaaagttacacagaaactgacaatcccagtacagggtgatgaacttcaagttaggtcatctctgatgggtgctcccagcttgggtgggaggaaaggctacttgtagattgtcttaataatattgacagtgactattcactgattggctggctctgtgccaggaattctgctaaacgctttccacatatatcatcttatttattccttgtaactctgtgaggtaggcgctattgttgtccctgtatcacagacgagaatacggaggcacaagaatgttaagttacttgtcgaaggtcacacagttaagaaaaggcagtagtaagctggtaaatatttaacaagtagctctacagtacaaagagccctcatttgcagtgtttgccaatttctgtggtgtaaatacttccatcatagccaattttaagttaccaaggtaatgttcctaaatgcagtagcacatcattatataatatttccaccatacagaaacaacagatgaaagttaccctgaaagcataaataagagtatactgtaataaacaattaaggagtgaggagtttcaagtgttcattaatataatttattagttataacattatataattaaattaaactttatttatttatttatttatttatttatttattattgagacggagtctcgctttgttgcccaggatggagtgcagtggcatgatcttggctcactgcaacctccacctcctgggttcaagcaattcttatgcctcagcctcccaagtagctgggactacaggcacgtgctaccaagcttggctaattttttgtatttttagtagagacggggtttcgccatgttggccaggctggtctcaaactcctggcatcaagtgattcgcctgcctcggcctctcaaagtgatgggattacaggtgtgagctactgtgcccagccaaaattttaaataacgcctatgtttaatgaccgacctgcaaattcccgaatgtataacaataggctctgacaagccagggtgagccagctccagtgcagcactggggtctctagaaccttgctcttcaccatcgcagacaagtaatagtagctacgagaaaaggtcaagggaacggaatgaacaaagacctaagatgtgactaccggagaaaagaaacacaatcacatttagtgttcacaaaatctttttaactgatcactagagtattcagagatagtgaggagtgcaggatgggacgctgaacttggaaatctccaccacagattaactgtgtaaccttggctacattactaaacgtctctgtgccccagtgttcttttccataaaatgggcatgatcataacagcccctacatcatagagttgtgtgaattacatacctttacacttgtatattacatagaataggacctggcacatagcagcgctcagtaaatgttagttacttattgtttgatctttgcagctgcctctgtgaattagatgtttgccttcgctttatagggattcaatttacgcttagagagcaatgcaggaggctggaggagataggactcaaatgttctgattctaacttcggtgcttacctcaagggctggaaggcatattgacctggctgagtactgttctccaagaggggctgccgacaaactcaatgccctactaagtgtcacttctgataggggccatatctaattaatggctcctcacccttgattggcgggtacaggcattctgggaagaaagacccatctggtttcaggaactgggcatctgacctttgcatcccttcttattttccaaacgctcgccttctgcttgaagaggcagagtggtggggtagttaagaggatgggctctggcttccaattccagcacggcagcatactggcgatgtaatcttgagtaagtgacataatctctgtgtaccttagttttcactgcggatgtgaaaagggatggcaacgatgatctcatctacctcatggcttttgctataagaactggtacaaattaatatatgcaaactgcctagaagaatacctggtacccagtaggcactctataggaattagttatgactatcaaatttttttattctcttttgcctcctttcttccatcccttctttgagtattaattacaaggtcaaaggggatataagcacatgctctttctttataaacacaggtcactagactataggctacttgagggcaggggctgttctcattcacctttatacccctggggccacaccctggtatacacagtcctcagtgagaatttactatgtgccaggcactgtgccatgcatcttattcagcttacagtgtttgatcttcatgaaaatcctacgaggtatgcatctctcctcccttttagcacgagacagctgaggctcagagagaggttaaggaacttgttcaaggtcacagtgaaaaagcaaagaaggataaaactcagacttatgacatcacaggccttcgttggttcctaacctccctgttgggctgccttctagaatattccatgggaaattttgagagatcgttaaatccaacccacttggttttacatttaaagaaaggagtcactgatttactcaaggtcacacagctattttatgtggtaggactaggataataacctggtatattgcctcaatctcatgtttgaaatttcaggaggaaatgaagccaggttcattagctgttaaaatatactgatgagtatgccaccagcttgcctctggttctgggccctatctacgtaatacgaatgtaaatttcctatggcatctatcaaaattttgagtaaggaagggcacacccgcacccctagaaattgcctgccaagtcacttctcctgccttctctccattgcaaaccaaatgaaacagagatgcatctcacttgcctgcagataaagctctctccctggtcgtcagaggtaggtactatgcttttctctgcttggctgcatcaagagctctgagcactcaacgagaacccaagagacaaagagaaaatcaccagtgctgcaaatgccccaatgaacgtgtgggcacattgactttgaagtcttcaggaagagtgctggtttggaaagagacccctgcatctgaatcacagctctgccacttccttgagtgtaagaaattgaacatgcaatttaacttctttgagcctccgtttccttgaccataaaatgggcataataccatagtacctagtacctattattaagggttgtgaggattagtgggactactgcattgaaagtgccttgtacatagtaggtattcaactaatgccaagttcccttctcttttactcatcttagaaacatttttcagcttatcattccaaggttgacgagttgcagagcagggagatgattatttattgattatctctcatgggcccagcctgaattagagcagcctggagtgacgggaagatgatgaggtactaaggagtctgattctttgtttgcttctgccaataatctggtgtctacctctctaggcctgtttctgtatctgtaaaatgagggagttcaacttggtaacccacagctctctcctacttctgaccttgtgtcttaccataatctgagttcctaaacaactccctgctgcctggttggataggtagctctatgatctcatggcacacttgactatcccactgtagttctttccaccaactattattttcttgtgtttttctcccagaagactgggagctccttgggaacagttctatgccttgttcactgttgtatcttcagggcctagcatggagtaacagacattctgccaatgtttggtgaatatttgaaggaaggagggaaggaaggagaggaccctgcccctatcctccaaacacttgatcatcacactatgacacataagatgtgaggcaaatggagaatgtcagtggagaattcatgattaagcacacacccagaacttggaaacaaggtcatctgtcttactgaagccatacattcatgcaccatgcttgtgcttagccatctgtggtaataaatcaagacacagcaagggcagagttgaaaatctgggaataccagagcccaaactagttgacctgggggtaatctttgaatggtgacttgtatactaaaatgtagaagccaaatgaattccaatattccaagtgcaaagaaagtgttggggaagagaaggatggagtggccagcctggtgctgagaaccaagaagatccaagagcctgcagttggcatttgtgtgtccagcattgtccctgttcaggaagagaggctttggccagtggttgtgagcactggaatttcctcagcaaagcttttgcttccatgaaaaggagaattccagggtatctcagctgaaagacccttcctatgatgccctcaatccctgtattctgaatctacacacaccacagcaaccttctgaggagaaactagcttcatattgaagctctctgtgactatcaggaggaaaatatgggggtggtgttgacatgagtcctctagcctatgtgacaatgaaatacctcacgggaaacaagcccagtgggattttggttggtttgctgagctcttaggatcagtccgtgagaatgatcaactgagggagcctcatctagttgagtttctggacccaaggagctggattccagaacctctgttggggtgaatgtgtgacggtgatactctgactcctccttttctccactccattcattggttagtttattcctttaatatttgttcaatgtctactatgtgcatatgatgtgttaggcagtcacagaagcacctggatttgctcgatatctagaagagaaccagggatatcaaccactaggggcaacagagtgtgcgaggtgccaagctggaagcccggaggacccagtgtgggtgggaggtgagtgagagaagaggagaggcctgagagggggtggtccattctgctggggcagagagaggaccggaaaatattcactaagtggtgactctagctgaatcctgaaagatgaatacgtgattcctggcagatgaggtggaggagggtgggggaatatattggtggcggctagattccaggccaagagtgcattgtgaacaaggctcagagaaaccgatagctggaatataaagggttggaagagggcagcatgggtttagagagataagcaagaacagagcctgctgttgtataactgcaggggcagccatctcattgtattctatgtgaagagggcctcctccagctgtggaccgtggggccctggggatgagccagatcacagagggccttgtttgtctttggagcttaagactttgttcagaaagccacggagcacaagtgaatcatttcaagcaaagaatagcatgttttcagatttatattttaaaaaatgtacagaagcagcaatgcaaagttgaagttgatagagaaagactctggggagtgtaaccaattatgtcactattgaaattgtcaggaaagaatccacaggggcctgatccaaggtagaaatggtaagaatgagaggaagggatggttagaagagatgtggatcatgagactctataggacctggtgagtgatgatgtcatccttcggaatgggtaaccccggaggggactgaggggaaaagacaatgagttttggacacctggagtccgaggaggccataggatctctaggtgaaattgggcaggaggaagttggagatagaagacaggcaatcagagggacactgttgcttgcagtgtgcactccggtgcacatagcatggtagcgaccatgggggtgcgtggggtaggcctgggagagtgtggaggctaaaagggaaggggagagagccaaggacagaaaattgggaaacagctacattttaatttcaggaagaacctgaggagtctgccaagaagactgagaaggtatagatggagaggtagaaagcagaatcccagagagagtagggtctcagcagccaagtttaaagaaggatgcgatcaatggtgttaactgctctttggactgtccccacagcacaggacaagaccatatcagttccagcaggttccactgaagaaagctcatgtgccttgcagaaacaagacctccagcccagtctaacaggagaccaaccacatgtccatcccattccctcccaaggcatgacagcacctggctgagatgcttgtgtgtattctctgtgtgaagctgagcatgcaaccttcaaagaaaccacaaaggagctactcgtttttaaaggaaaaacacatgaactccacgggcataaggaagacattaaaacagggttggggagaagttcttctccttccatttcatagtacccttcacagaaataattgactgcttgaatatatggtcattgaaacatacatacacacacatacatgcacatgaaaacaagagctggaatatttgactctgctttccatttcccaccaccctagataacacaggatacaacatggctttactgcacacatgtgttttctggcttaaaaacactgagagtagatccctgtggaaagaaatatgaaaacctgaggattcatgcgaatgtagccagaggcgaatgtagccagaggggtcttcaatttgctggcagagctgggggagagctggggcaattttactgccatgaaattggctccagatggaggcaaggaaaggtgtttaccccctgctggtgccagacacagagagatcctgcagtacctcgcatcttaggctcagaattgcccagtgctgggcagcagccccactgagggtctggccagagctcatggggatgggtggaccaggctgtctgttgcttggaaaaggccattttgaatataatgactttcacatggacggtggggcttgggggaaggcatcgtggctagggtctggaggggaagagggaggaaagcaaagaggagcttccctatgaggcaacagaaatgacagtaccttctccaggttgaatttccaaaacccagctctgccctggaagactgggactgtggcatcctctgcagtgttcccagaccgccctaaggcccccaaaccaatgattcacaactatgttgcttccccagagagcatctccccctttggttgacatgtggccagctcaggggtggaggagctccggcagccacgaacccagacgggatgttgactgagagctttgtggccatggcagatgggaggggtgagcttcacccactcaaaggcacccgcaccccaccgatgagtgtggaattgtgctctcccgccctcgcagtgagacgaccgaccaggactgcaggctgagcaaatgggtgttctctggcttatagcgccccctagcaccagccagcgggatagagctccgtgaactctccaaggagccaccacctgcctgtctgaatgctggaaaggggtcggtggtgctgatcattggacccattcaaccaatacttattaaactcgttgttaccaacacttaatccctgtgttctaggggcttagactccagcaagggaaacagatgggtaaataatcacattagagtcagctaagtattgtcaaagaagttgatacagggtgttgtggggatacatgggaggggaatcagaggaggtttcccggaggaggtgacatctaagctgaggtctgaaggatgtggaagagttcagtaactcctgaagaccaaaaaaatggtgataaaaaagacaccttcctaactttttagtgctacgatccaagagacaaacaagcaggtgaacgcataactacactgggctccaccataagccagagcctgtctctcctaggactttggcatcacaatcttctctgaaattctgttttcggcattgattcttgggggaggtagcaatataggaactcagtgttcgttgcgaaactgatggatggtcttcagtcttgggtacgttcccatgtgtcaaacctgtttaaatggcaggacccatctccccttcagaagcattcacttgtcctacaggattccccatggaatcttggagtttttgaggcgagagggatcctggataccactgagttctatctttcatccaataaacacagaagtggacgcctggacaggcaaagtgacttgaccaaggcaggtgcacagctattctgcaacattgggaacaaatctcaggtcttttgattttttgtttccactttactctcttttcatttcccagaaacaaagttttcatgtgcttttttttatagtgatatgtttggaatgcattagctagtaatttaggaagggaaaaaaataaacacacaagagataaacctgtcaggaggacaaacctgtattgcttctgattggctcagagggtgattattatcatggtagagaattatttaatcagtgtaagtaaaatttctctgtgggctgggcactgtacaaagactcaaacgaatctgtctacagatctgaaaagcagatacgagatctgtgaatggctggggtttccaagcccacagtacaagcatgggccacaccttacagcttggaggactgagccctgaaaatgggcaagttccttcacttctctgaaccttatttttcccacatttaaaacaaggatgagtagtttctgaggtcctttttacgacttctcttcctacagactctagcatcctataacttgatacaaagagggtggatatgaactcacctttcctagaaaagttccaggaaagagaataccaggtcatcctagtaggtgtgtagacaggccagatagatcttgaaacttactcagttcttcccagatgtataactctatcattgttcttagctgtcaagagaaagcaggagagcctgcatcttcattctttttttttttttttttttttttggagacggagtctcactccatcacctaggctagagtgcagtggcatgatctcagctcactgcaagctccgcctcccaggttcacgccattctcctgcctcagcctcccaagtaactgggactacaggcgcccaccaccacacctggctaattttttgtgttgttagtacagacggggtttcaccatgttagccaggatggtctcgatctcctgacctcgtgatccgcccaccttggcctctcaaagtgctgggattacaggcgtgagccaccgcacccagcctgcatcttcattcttactgttagcctcaggttcaccccacctagcttattaagtgatgttgaataaccaattcttacatattattaggctcatggacaccatgacatccagactgatgggtgcctgctgaagggggtgaccctagcaggaggactcccctacgcaaggattcatggagtttgctgtttcttttccttagggtgagaaccaaactgccttcacacggtgggcagaggggaactgactcaggtttggaataagagagaacatcccaactgaaaagctcttggaattcgctgaacttcaagacactgtgtggaccagcttaggatagggagtgagaagaaattaaccaaaaggtaatttcgttacttttcagctggaaaaaagatcagattatacttgtgctttcataattaagtagctgctggaaaaaaacgcttcagatgctttctatgagaaaactgctgcttgaagttcagcagaagttatctacttgatacttatattccaggcaaggccttccgttggagaaaatatcggcactttggacaaaactgaaatgtgaaaagaaagggaagagagggcctctatcatgtaagatgcttatccaaagtggatttggtctggaaagtcttctaaaaccttccacatgactgtggaataagtcatgtggggcgcggggataagcgaatctctcaaattccaccacgtatgccctcattcaacctggatccttagagtggcctccagggcactctgctcaggactcagtcagctgttggccacacccatgctctccagtctcctgagaccctatttggttctgagagggctaaaaagcagtgtggctaaatatcccaggcctcaaagtattcctactgtggttggggaagcaatagaatcataccccataaaacaatgaaaacagtgctagaaaaacatcgagagacagaaacatctctacgagttaggccacagttagagtgaaggcagggaaggtttttaaagctgggtggaggggacaagtcaaaaagatgtggaaactggtttccctttcctatggctaaagtgctcaaaggggaaaaaggagtttcaaaaatgttcttggaaataccatctctcacgaattcttcggcctctgctgtcccaatgtcacttgtctgagatgtaaacagaggagttctgagaaagaagctgaacttgcatttctccctgtttctatttgttccaaacttgtggcatttctaacaggatgaagcggaagagaaagggaaagagacaaaagtgtagaaagatggaagatcccagctgcaaatggccatttgcagttagatggaacagctgctgacgttcagggaaatgcatgtctctcttcagatgggaaggagcagtggaaaggggtgacgagttcctggctggccaccaatcatcccatctttctgtgccggttcctcatctggaaagtgggagtgatacttgtgcttgcttttcctacccacaaagattattgtgagagctataatacggtgagatacagaatcctgcttttaaaaatacaaagcagaatcaagatgtcaataataaggatagtaattgtgttagttatctgcaatcatctattatagctagtcgtctaggatcctggatcgttctcctggttttactacagttttggatcagctcacccccaaatcccttgctgaagggtggagctctgtcagccatgggcagggaaccacttcctcttgcctttctactttctgtctttcaaacatgcccagggtctttgcacttgctgttccccctgcctggtacctctctcctgtggcttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctgcaaacagcagatggcttcccatatcccagagagtaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgcgccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcggtaagcgctcctggtgccccgcccgagccccacgctgcagccaggactgcagcgctgcttagggaggcagggcgagccccactcctttcctctgccccaggagaggggcagacggggttggggcggagtggagaaactcgatgtccttgggcgggggcgctggcatagctgagaggggaagatgccctgcagaggaaactcacagtggctgagggagcccctggccgcctttgctttcctaacttaggtcgtgaggttcctaccggtccttttgacatctggaaaatgtccccattcactactaacggaggaagggctagaagagaagggtggggaaagggttcccaaaacttggaatgctaactaaagtgctgggaaattgaatagttaaaaaaaaaaaaaaaagttgcccgccatgtgcacggaaagttgcaggagaaacttggagtactccgagtctgcatcatctcctgcgcctatgaaattcattcttttcactgagacccaacccagctgcaggcttcccaggcaagcgctaaccgagcttctgggactgccaagtttgggtggatttaagggggaaaatgaggagaaagctgtggcattgacccacgccctggaggcactgtgtttgagagtgttgatagccagcagaaggtgcgaggggtcactcaccacatagctgtgaaaattcacaggaaggctatttttttcccccttgaatgtgtgtggggagggggagaatgggtagtggaaaacagatttgtcaccaaaagaacaaacctgccaagggtcacatcacggtgacagttccagactggacttagtgtcttgagtagagagaccctgtaaagagacctcctactccttagtgtgtatggagggccccgagagcatcctgggaggcttgtctgggagtgtttgggacacttgtgtttggatggctaaaggtggagtggcatctgggaaacatctctctcctcctttccagcccataaagcgtgcaagtccagtggctctgctgggagagtgtgtgtgtgtgcactgggctgggctgggcggtggggtgggacagccttgccgccctctgcctgtgtcgattcagaggtgaagaatggagcgtgtgtgttttaagtacagtcataaaggagaaggaaattttccactgagtcttgggtgagggactctaccagcgtgttgtggtgaggagggggaggaggtaggagcttggcaggggaggcagtgagggccgggaggggcactgctggtgggctgggctgagcctagaggtcagagtgggggtgtggtgaccagaatgtcagtgcagttggcagctgagggtgtttgtgtgacctgaggtcacccttgtaagaggctccctggggcctgcatggtacatcctcccctctcctgggggaacccagctggcccaggatttgtggattgcttagaaagatccttttgggcagcctgaagactggggagggttttcctccctcctccacctccacccacattccacttaccctttccctcctcatcccagttggtaacattcccacctgattagtgtggggagttgctgctgcagctgagttctggttttgcccagcaggatcacacacgtgcggccaggaggctggcaggtggaatcagggtgtgcaggggtgcagcccaagtccttttctgctggaaaatgggctgggtgacttcacttgcgtttttttggtatgtagtgggagtaggtccccattcttcccccttgccctttgctttggggtttctaccctaaaaattgaccacggaaaagtgaaaacaagcatgagtagatcctgcttccaatgggggccttcccgtctgcttactgcttaggtttcctgcggtgggtctgagcaatgcagaaagtttcttacaatttctctggattgaaacaagaaatagctccctcgctcctcttcataaatttctcagagaaaatctaagttaccaggaagtagccaaagaccaggagattgtggaatcaaaaagaaaaaaagaaacaaaaaatcttcgatgctctggcacggatcccaaattgttctgcctgggtttggtgagctgcactagtggcagggatgagctaatgcttttaaaatgggaggtgtgggtgtgagctgcttgcctgccgacctccctcgccttgcacagcaccctgctggcgtccagtacttggctcccaagtttcattgctcagagcctttctggtttccagtctgggttgaaactgtctattctcgccctcaaacaaatatgaaggagctccccattccttgggacccacacaaccccaccagtcaactttgtagccccctaaaggtgttcacatcagcccatcaacttcctgttttaaaaccatcatggtggttttctcttcatggcttggtgccatgttggcctagcaaaaggcacaggaggcctggcctggtcctctccggggggctgcccgatggcctttcctcctgtctctgctcatccacaggtgtctctttttgtcttttttccccaaagtcctagggcctggcatggcattctgggggaggaggagttaaaaggtgtttctatggcaactccaggccctgcaccctatggaagtgtttaggagaagaataaactacatgccggcttataagacacactgtgggggaaagaaagggacttggcagcaggcaggatgtctgtggtccccctccctggccagtcattgcccctgaaactcctgacaaaaccttgactctagaagaggaatgggagggggctggagatgaagaaggcggcctcggcccgggcaaatctgccctggcagctctgtccagctcaggaaggggtgggctgtgccaagggctttctgaaaatgtgcgtgtgtgcgtgtgtgtgtgtgtgcgcgtgtgtggcttctgcaaaggtggctggcagggctgaggggggttgcagcagagaaagagaattttgcttcagaatgccaagcccttctctccttctctcttgccgcctttgcatgggaggaatggggctgtaggatgaagtgtgttcggggcctgcctctgagcctgttgggaatttgagcatgaggctcagctggggggccggctgccagccccagaggatggcccctggatagctccaaattgttctgacaggggccagtgccagcagattctttcagtatcagatctgaggttgtcgttttagcaaagaagccattttcaaagaaaccagatccatcccctctccctcttacacacaattacacctcaacactgggctttgcaacttaaggaaaatagaaagaatcagactttggagaggcgccagcacttggtagggcaagtctgggggacccaggctgtggatgtcttggaaccatggaaggaggagagctgctatccagctggaggagggaagagacatgtcttaggcccctcctggttgcacgcacttcccaaatgccatctctttcaccccctcccccgaccccccacagcaaccttaagagtaggtattgcacccatttttcagatggaaaacactgaggctgaagagactgtgcttgtccaaggccacccagttgctaaatgataaagctaaaacgtattatcagttataccatgcttcaaaaacctttcaactttcattgacacatgacattctaaggtgaccaggagatggaatggatggttaacatttgaagaatgcttttcttctacatctgggttttctttaaaaatatgaagatagccaaaatggccagaggttttaattaaacatcatctttagggagggagagcttattattattctagtgtatcatagaggaaaattctaatgttctttggctattagatctggaaaagacccttgaaaccatcaagccacagtaataaaaggacttggtttgtctcactgtggcccaaggagaagtaaggttaatagagacaagacatttcagggcttcaagactcttcccttaaaggtgggatcagttagggctccccagtgggaggtacccggtctgccagtgtggtaggaggaaagccagggggagtcaggagactgggtcccagctggagaaggtgcccctctgacagttctgtgtccctttcacagtccctggatagataaggctagaaaagtggccacagaagtagcttgggtggagggatttttgtttgttttgcatgaacagcaggaaccattcagctccactgctgaatggcacattccaacaggttcattaattaaaaacaaaaacaacaacacgattctccatcgcacttggcttttaccattccagccagtatggacaaggaggccccttcttctaccttttgtcatagtctactcctgggtggccttgagaggcagggtggagtggtggaaaggcaatggggagggcagatctgagctccactccttcctctggggcttgttggctgtgtgtgcctaggcacatatgggctacctttgagctttagttttcttatttatacaaggggaataacaatttgtaccatcttggcctgttttatctatattttaaaagctacaagtatatgaatacattctatgtccatgtatgtatctctctgtatatctatgatatatccatttctatttatcatttatcatctatctatctatctctctatctaaaatcggagaagagtaaaatcctttctgattactttttctaactctagtcccttctccaaatccttttcttcctatacatttacatacataggtatccatagcaaatttatagtagtttttcccttagaaacatgaatagtagaacattaaacatcatggaataccacataataccacatatagtattctgcttgtttcccattcaacaatgcgtactagagatctttctacttaatatatatataaaactgtcagaggagcaccttctccagctgggacccagtctcctgactgcccccctggctttcctcccaccacattggcagactgggtagctccccctggggacccctaactcatccccacctttaagggaagagtcttggaaccttgaaatgtcttgtctctattaactttacttctccctggccacagtgagacaaaccaagtccttttattactgtggattgatggtttggaggatatatatatataaatatataatatataaatatataatttatatataatatataaatatataatatataatatatattatatataatatatattatatataatatatatatattatatttacatatatattatatatataatatatatatttcttttatgtatttcatgaggttataattttaaacagctaataagtatagagtgattactatgtgccaggcattattctaagtcattaacttacattaactcatttaattctctcagttttatgagggaggtgtgctattgtcatctccattttacagctgaggaaactgaggcttagaaaaatgaggtaactcgtttaaggttatactgctagcaaggaatacagcctgtatttaagccccttcaccctggctctaaaatatatttaacaactatactataggtcacattataccatatcatattatatatactactacatactcttatattattataattatataatatgcattttcaattttaatagttcctgccaatttggcctccacagtggctgtgttaacacagttcttttcatatatgcaacatgaggggatggaggaatgttagagccctgtgcttaagagactcccatgcttctctcaaatagaaaaacaatttataatttttattgacttactgagtgttttttttccttctttttgtctctttgaaagggagcaaaattagggccacgaagatcaagttaatgggagtattttcatagggagaggaaggctgcaatgccaggaaagctgtgacccttgacttgttgcatgctggagtaattcggttgaagatagctttatgtatttattttgctttcagaataagcagtggaccatttattacaccaagttgtttgactttgaggacttacatggactcaggttcaaaggtatatgtggctgtgttttgaacacacatacacagggttttgctttctgactcaaagctgtccgctggccaggctcatggtggcagcaagggcactcactcatctgtctcccttcttgttgcctatggatggcacttgggtgagagcagtgggatggtcacaaggaggaggatggactgccgagagggaggctgggtggaccccagccaagaaggacgctggggtctcattattatgggagctagaaggcctggtttaggaaagaattcctgttctgatgaaagctcttcagtggactcttaggataaagtatcatcaaatggcttttacaagggccagtgtggaccctgcctacctcatcctcatagtctcatcactggtctgtcctgctccagctgttcatactctgtctctctggctcttggcccatgacaccccctcggttttgaacagtcctcattaacttctcattctctaggtctcctttggttcctttccctgatcactccttggcattggtacagacgaacagtcataaaccttgcccatattttaagcatgctgaaaaacaccatctctagtaaaacccaaattctccaaagctgcatgggaaactcccagaggggatcattcctgcgctgggagaaagaacttagggctgcgtgccacccagagggataaacctaacccactttagagggtaagcacccactatgctctctgcattacttgataagtctagtcctgtcttctggtggacatgataccctagcaccctcccagagaagaaagtggagatttctaaatgccaaccctgcaggagatcacaaacataatactgtaattttcatagtaagtttggtgcccttactatgtgccaggcactgtaccaagctccttacttgcctatcagtcatcccagctgcctgatgagctgtctcaggctagggaagccaaatggcttgcccaagctcacaccacttgcaacctatacttgcttagcctatctccaaaacctgtgtttccaatcagtctctcatatagaccaagggctacaactttttagacttgggaagattctacccattttgcgacctctccacatgagtctttggctccccactgttggggtccccgtcagtctgcttatctttggttttcttcctctccagacatgccttccctgctgcccccaaattttattactgtatagtcagttctgggatcctaacataaccaagccttacctcctaacccagtgccctttcaactctctcagtggttcccagacttttcaacactatggaattttttaaaattaatttttccctccaataagttctgtgtttggaacagttatccgacacaatttcatgtgttgagtgttgattaactttccattaaaaaacaaattaaaatataactagaactgctgatactagccagtcattattctgacacaatcagctaatatactaattaattatagccgaaagcaaggacggttggtgttttcataagcctgggaagttttctcatgggttcctgggtgattgcattgtcggatttgggttggcttactgatatgcctaaaatagctcctggcttctttggtatatcgctgtcctttgcccctcctgagaatctttagtttcatgccagcttagcatctcttctccctgtgggcaggtcccatgcatttactgccattgtcacttctccctgttacccacagtgctgccaccatgcctgggatagacagcaggtaactgatgtgtcctagttgaggtccctatcctttcagaggaggtgacatgggttcagatattttcctatgttcatgtctggcatccaggggtacacaaagtattgattctagctaaagggacttactaaatactgtttgacaggaggcccacaggtgtctatgtgggctgcagtggaactaagaggtctttttgttcagctgttaaaaaattagtgtttgtagcttcagaggggccccagagaacctttcctgacccatttagaggccatctgtgtggctaggatggctttgctgtcacagaagggacagtccacactacccaacactcaagtctgatttatgttcatgtaaatccgatcacctaatggtggcattcacggcttggagacaagaaactataagtgtttccaagcctgcagccacctggctttttgtgggggtggggaagggaaggaaagctgtacgatctggcctcagagagcccaaggtaaagttcagttagtggaaaaacagagccctagatgattgggcggggggtgggtactggggagtggagaggggaagtcctgagctgaccaagcctccaagagccattccggaactagagatcttaaatactacatggtaattatcccctctgcctctgcccatgagggtgtcaggcacagggccgcctggctgcctgcagagaagagctgtttcattcagaaacttcagagctcctgcaatgcctggattaggatgtggggatggtgagtttcgcaaccagggtcagatttcatgaagacttggtttcgtgacttgaggtgtttgactaaggtgtttgcatctcatgtatttaggaagggctcccttttgacttagactttatcatcatgaataagctccctgccttttcgatttggaaacatgatagctctagtgagctctgctactcccaagcttgggcaggttctttgcctcagtttcctcatctctaaaatggggggaaatatattatgtaccacgtggtaacttcattggcaattaagtgaaatacttcatggaatgtttagcactaaatattccttagtgttgaaaaggctgggaaccactgagacagttgaaagggcactgggttaggaggtaaggcttggttatgttaggatcccagaactgactatacggtaataaaatttgggggcagcagggaaggcatgtctggagaggaagaaaatcaaagataagcagactgaggggggccccaaaagtggggagccaaagactcaggtggagaggtcgcaaaatgggtagaatcttcccaagtctaaaaagttgtagcccttagtctatacaagagactgattcttggcacagaatagctcaataagaataagcatgagcttttagtagtagtgttgttatagagcagagctgatattctcacttcactttcggtgaggaaaatggcgctctgtggtgtgatgtgatgttttccagggtcatatagagagagctgagtttcaattcaaaatcgtggtttgatccccccgcctccaaatctaatgtgttccattttgtcacagtgcttcccacagggcagagaaagaaacaacaaagttcctactctattttcacaactcttcacattttagagtcttaagtccatttgatctcatttgatgacaacttcgcaacgaggaaagcaggatggtgattggggggtcggtcatagttcctagttagtggatgtcagtattgagaatggcggggttctgtggcttagccatatagccaatacatggaatgggattggaacccatgtcttctgagggcaagcccaacacttgtcaaggatctggtgctgcccttccctctttagacagctcccattgataagcagaggtagaagtcactagggtagccaaagagagggccctagaaatggaatggtgacaatgaacttggctgaagagtcagcaaccgctcccctatccactgccagggctaggaggtgcagtgtggcatggaggaggagcactggctggagttaggaggcctaaggtctagtcctagttcatcatctgactctggagtccccttggtgatactgacctccctgggtttggtctcttatctgtaaaacagcaggatattggctctatgtggtgtgtatttcactgaatgcctactatggtcaagtttttctggctctaagttcccttggaaagggctctctactttagctgaataactcagcacctaaatctgtcaaccacacccttcagtaggtaactttgttagaaatatggtctattaaggtaagagccaggatttctgtggttgcaaaagtggatgcgggctctgaacaaaacctctagtgagctgagatactttatcagatgacatatttgaccaccaaacttctgttggagcagggctgatttgccaaacagacagcaaccttgcagacttagtcgatggctagaattaagactcaaggtcacttcagggcctgtcactgattgtgggagggcttggtaaaaattgaacctcattaacaccactgaagaagctgatagacaagaaatgggattaagactcaatactcatcaaaataaggctttccttatccacagcctacctgagcagtgcctcactctggaaaatgtggttcatggctcggctcaaacattttctgttgctgagaggacttctctcatggaagtctggctcagatgaacacatgtgtgatctgatggaacctttgtttaagtgaatgaggagggtatttggaagacttagatcaaacgtgtgccccattgggcagtcactatctgctcccctgacagggagaaaccccagtgacaggatagaaagctccaaagatcctgaggaagtttggaaggtcaaacttcaccactgcaaggactgagagatccaagaatctcagaatccaggttggtctccagggtgcagttctgaacaaatgagtgcagtggataaaaagcttatacttaaggtgggaaggtgggtgtgggttccagttccttctttggctgattctcttttggcctggatttcctcacttgtcatccatgccatgtcacaaacccagtgcctacagggaccaggcacagaagctggatatttgagtatcagacatattggaatattactcactcctaccaaatatgtttatggttccccattctcttggtttccattttggagagctaaacaggtactaaaaatgatttctttattataagacaagcaataaaacagtgggcaagtgtgatgataaacagcatctgagctttggctttggagttggggagacaatagagagtggcagtaactgtggtgaaccgtacagtccaggtcccttctggaggggacagctgctgtccagctccagcctatcaggatgtgagtctagtgatgccagatttccagtctcttaggacaagcaagaaatccaaatttttaatgtaacatcttctgaaaagatacacacacacacacacacacacacacacacacacacacacacacacacacgtggaccaaacaaaacatgtccatgggccagattcagccttgtgggtcaccagttttgtgatctggaatccattttatttctagaatctcctttcaattctcggatctctgagtgagtaacacccaatttttttttttttggcaaaatgtgtcctgcatttcccacactttctgagctggagcacaggttctggagttagaccacttggctcaaaccttggcctcgttcatggctagttgcctgtccctggacaagttaattccctggtctcatttttcctatctgtaaaatggagtatgcaataatagtactcttaacctcataggttgtggaagaattcacagacacaatggaaataaaaggcctggctcattgcctggcatgtagtaaggacctgataaatgtcagccatcatattattactacatggtattactgcctccccttagatgggagccaagtcttgctcaccagctcattgcctgatgttagtaggcattcaataaaagtatcatgaatgaataagaacatttgagaaagacagcattccagcctttccaggcaatactcgtgtgtgtgtgtgtgtgtgtgtgtgtgtgtgtgtgagagagagagagagagagagagagaaagagaaagaaagaaaagaaagaaagaaagaaagaaagaaaacaaagaaaggaaagaaagaaaaaaaaagaaagaaagaaggaaagaaagaaagagggagggagggagagagggagagagggaaggaaggaaggagagagagagagagacagaaagaaagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctcctttaagccagaggagattcctggaggctgctaaaatagaatgctccacctggatagttaacatctggattttattttgtttcaaaaagttaattacaaatagttcgaattccttctggtatccctctgagaagagtttcttactgggtggctcacaagcggggagacagaaagggaaaaaaactagattgatattgctcaggagaaacaggattgtggctacacgtgagccatgtatgcaattttgaattttcccatagtcatgtttaaaaaaacgaggaaaaagtgaaattaattttaatactaaacccaatatgtataaaatatgaccatttcaatatgtaatcaattttacacttattaataagatcttaatatttttaaaattaagtttttgacatccattatgtattttacactcatagcatatctcagtttggactagttgcgtttcagctacctgtggttagtggccgccatgttaatactacagcacaggtcaagataacatttgcaaaggcaaggcatcttcccctccccatttctagtttcatgaactgtgcacagggatatggggctgttcgaggtacttttgggctgaccaaggctcagaggctactgacagctttgctgcaagtaacttctaggccttgtgggtcccagtgcagggaacccatgtgcggtgacactggagaagccatctgatccaggtctctcacttgacagatggggaaactgaggtccaaagaggtacagcagcttggtttaagagatagagatggaactggaacaaaaataataaccatttgataatattttaacatttattgatttgtttttatatgccaagaccttttaaagcattatctcctttaaactctcataaccactcattgaggtaggcactcctatttctactttgcagatgaaaaaaattgggacttaagaggaattaaatatgaaagcagctactatttgttgacagctattttaagatctttatatacatatatacatgtaataaattctattctttactataaacatacatgtcagaaattattagtgttatcatccttgtcctcctcattccactttgcagatgaaaatactgaagctgagagagactaggtaacttacctagtatgtacctacatagtgaagccagatttgagccggacctcctgactccagagtccgagcaatctcaccaattctgcccacggtcaccccactgcatgatggcagagctagtatttgagcaggtgtgtctgttctgtggtctgtggtcttcaccgccccactagacagcctggatttttctgctcttgagtctcaacactttctgccttactgtgccactagtaaggaacagaacagggaggtttttgaccccagcactgattgaagggcccaggcaaagcaggctcgtctcctctggcttggctggttcccaggctgccctaacccatgaagccagattcttggccaagttaagcagggtgggaagaacacttgtccattccgccttcccagttgggcgaggtcagtgtaccaggttggaaagtggtatgtgtctaattgcaggggcgggggtaggggggaggccagaggattaacactctttaaatagacatcagaaaactaagaatagccttgctgcctggtaattgatgggcattcctgactacgggccacacactcagtaggtgctcgataaacatgggtgaaatacaggaataaacaaatactgaaaatgggtcattgggtgagcacttagccagtaaaaatctgtgctttgtataaaaagaactttggactgaggttatatgagtcttcctgcaggctggagacctctgttacctttacttctctacttttgttgtcttgagaccagcttttttatttttggtgaggagaacagcaggcagttcaaatgtcagggaaagacaagttcagcttgctttttccttatttctgtcttgttacctgctatcctgccaggttagaaagatggaatcactcccttttgccctatcatcaagacttcagtgttccctggagcactctaaatttgccatcagacttggatcatcctctaataccaagctcctgggtccttcctgaaggctgcctccttgtcttgctgagaagaattaaggtcgcttccctgggaggaattcagcagcacctcttgtaagtcatcaggtgtgctgtaaggatggggcaggcaacatttctttgtactgtgggaaggcctaaatcagtgtttctcaaggtgtgatccttgcaccaccaatcttaagaaatgttctttggagccgggcacagcggctcacgcatataaccccaccttgggaggctgaggcgagaggatcgcttgagcccaggaattgaagaccagtctgggtcacatagtaagattccctgtctctactaatttaaaaaaaaaaaaaagaaaaggtggttgggcctgtagtcccagttactcttgaggcttaggtgggagaatcgcttgagtccacgaggttgaggctgcagtgagccatgattgtaccactgcactccagccagggtgacagagcaagactctatctcaaaaaaaaaaaaatgttatttgggagagctgtttattgtattcccctcttggagagacatgtggctattagcatagtaaaagctctgagaagtcctgctgcatggtgacctgtttagctctgtttaatccagtgttctctgaacatatctagccaaggaactaattttcccaagaagcacctacaaatgcagttggtgagacactgcccagatgaggattctgaaaaccccttttgcccacttgcctgccattgtgattgctgagtagggaagaagaaattaggaagtatcatctgcattacacagggaagctgctctcctagggttgccaaacagaaatggctgtagtggtgccagtgggtgctttgtagggaccagaagaaaaaggaggaagggaaggctgaccttcaaggtcacacatttgccagatttaaagttccttcctgtggtcatgacttgttttataatcttgcttggctcagttctgggcacacatcagatttttaaatcctaggatcttgtttataccgttaaggacatgattgaaggacattgtggtgagtgtgaaggtgagatgtttctgattgaaggtccatggggcaggcaccctgcgagcaggtaatgaacagtaggggacataccggtgcaaccccaccctggtcccctggtcgtctgggccagatctctcccctctctgttctatacttctcttacatcaccgtcctacctaatcattttaccgataggagcacctttgggattctgattaaagctatgcatacaaatttcaagagcttcagaaattctcctaaaagctatcttggatcattagaacacttgccctagagtatcactgagtcaataatggtgttgaaactaaacagcaacaaaatccccccaaaaaggtaacctaacttagtctgaaattgtctgaaaattaatggcactgccagttcagtggctgctcagagcgttttggtgaagaaattggctgatggatattttgcagtagtctacaggatttgacgtgggatgccatctttatggacatggctctgctgggcaaagcaaggacgggcacatccagcctatgcggtccatcaggggcactcacatttagaatgggggagtcttagttagcccaggggctgggggcagcatggtagtgtagaaaaaggggccagtgcctccagaaaatgggaccccaggcctggctctgctccttctgctgtgtgattctggttgagtggccttccctttgagtcctctggatgaagttaaggagaagtcttgggttctcaagtagtcactattcagactctcgctttcagagtatttaaaggaggaaaggaaacagaaggatagggctggtggacttaaaaggccgtgtgtttgccgccaccccatttgctcccagggctgggtgtttgtctcccctccggcgctgggcctcctgcttggcctccagctcttgcaccattaactgcagtcagaaaagctgatgtcactgtggccggcctagggggaaagtctcaggataaaactgcttccacctggatctggagaaggggaagtgactggcaagagattcgcaggtagggctcagagaccaggaggaatccagtctgggtaagaattccctgtcatggggctctgaagccacgggccaggcaggtagtggatttcaagccagccagcggggtcacttggcccctgcagctactcctcgccccctcctgcataatttcctatttcctgcctcctcctcctctgacacagttataaataacctcgaggctggcctctgcgcttaagtataggtgagccagaggaaagtggaggggatcaaggtggagctggatctgccacttggccagggggtcacagggtttcagattgctcaggggaattttgttttcttgttttttccactagggagtgaggtagtgaaagaggaaataagctgtgttggcatggggaggcttggccttgcaggccggtgctgggtttcacccgcaaggagctgcctctctgctcactgcagatccccaggaccaaaggtctggaaagaggcttagtgagaaggcatctcaggacacaaagaggacacgatgccttgctggtgaggtcctgcggtctccttctcgaggcccagcccggccccatattggaggccaaacatgtagaagggtgtatctcattttttacctttttttctcaaccaccagccaacgatgggtatgtgatttctaaggatgtccattgactataaaggtcccattaatacatatgctatggacagattctctccttgaacacaggtttatggagcacctactatattccaggtgctgggcagagtgctaaggtcacaaaaatgaatcagctgtggcctctacagcctgttcccctcttggcatagatctgcccttccccctccacagtctggacaatcaaggacctggagtaagcacactctaggggccgcgtctcccagcatatcttttgttttcgaaagttcaaaaaacagaagaggaggattctgaaacagcaaacttgctgggtcatccatagagtatattaactggctatcttgctatctgtccataacttgctacctgtccatagtgtatattaacttcctgggagcccactcactgcctgacttcctgttctgcgcatgggcccaagggaagttctcgcaaccatagttttctgtgatatccatcctaccacatggcttcctgggaaacccattagcttttttgtttgttttagagcccaagggaatcagggccttgaggggattttttggtgtggggggtggtgcaagcttctaacactgagagtgggtgcttttctgattcctatgaaggtggagtgtaggtgtcgttcctggctcagcagagtcagccctctcatcctattcaggccgtctctgaggctggctcctgtgcccaagcccttcctcactccctcagggcatgatcacagggcatttccttagcattcctcctttctcccctgtgtgtgtgtgtgtgtgtgcgtgcgcgtgtgtgtgtgtgtgtgtggtgtgtgtggtgtgtgttctactccgtgtgtgtgtcatcctctgctcatccacccattccactgcgtgtgtgtgtgtgtgtgtgtgtgtggtgtgttctactccgtgtgtgtgtcatcctcctctgctcatccacccattccactgcagcacctagcatcacctaggggcctggaaaacctgcacctgaaagccgtaactccccggcacctggctggttgacttcttcccccttaaccccatttactttgaggatggaggtagtctttagggtcaggctgagatttgtcctgacccatgcttagttggcacatcttgcttctgcaacatgcttgcttagggttgggcaggggcccggagaaaacaagtcgtggcatcaccaggacctgattacccccaggcaccaaggagcacctgggaccaaggggaggtttggggcttgggatatgttttagggtgaaggatcacagaagcttactcatacctatttgaaagccaagtcaacagatgtgggttcttggaaggagaaaaggaggttaactgcttacttattagattagaagtgatgtatgaatgataaagagcagagtttgccagatattgctaattaattctctcactgcttattttatggatgataaagggtagggagagacatgttaattggcttcaaggtctctgagccaagcatgaccaatccgagaaacccaggtggcttcatgctctttcaatatgatctcatccctgcactagagaatttatatttttgagcataaagaatacccaccggtgcaatctcccaggctcttctgaagggtttggagagacagtggaggatgtcaaaagagatgaacttagagtcaaaaaaagcagagatggaatcccgtctctgccttttaccactggagttagttgactaaaatgtaaactctgagccttggttttcccaattgcaaaatgggaaagaccccatttataatgcaggtgggtgagagatgccagcagtgacagggactttcagtaaaggctgagctgaagctgaatttgaaaagcacattctttacgttccattgaagatctgcacttgctcttctgctaaccgctaaggtgtcatcagtgctgtgctattaaaatcagaagtcaaagaaggtgggtgtggccctcatagccagagttgatagaaatggatttattaatataatggatggtccatagaaaggtgaatgacctggttaacagacagggatggagtggagacctgtctgccctggtcttcaggctggttctgaaatcacagaattaagatgatctcagctgaggggcaaggcaaatcggatggaagagcggaggcccagagaagcgaagccctttcccaatatctcacagcaggtggggagtgggggaaagcagcttccagggggtggattcctgaaccaggtatttgtcactgtcccacgtagctcctcttgtcaccatatgtcccactcagtggagggatacttcctgcaagacaaagagggcctcatggttcccccgtcactcactgccttccactccctgcttctgattattctgtaagaagttgaggccgagcgcagtggctcacgcctgtaatctcagcactttgggaggccgaggcaggcggatcacctgaggtcgggagttcgagaccagcctgaccaacatggagaaaccccatctctactaaaaatacaaaattagccgggcgtggtggcgcatgcctgtaatcccagctactcgggaggctgaggcaggagaattgcttgaacctgggaggcagaggttgcaatgagccgagatcgcaccattgcactccagcctgggcaacaagagcaaaactccatctcaaaaaaaaaaaaaaaaaaagaagttggagctctgtctgtctgtcctttccccaactccccatctccgaggctggctcctgtgcccaaagtcttcctcgctgtctctgggtatgttcacagggtatgatcacatttcccctgcatgccctgcgtgggatgtgctccatgtgctgatgcctctggggatttccagatgatgtccctggacttggcagagcagtgtggggaatctgggacttgcacttcctatcctcatggagtctggtctctcaccttcacaggccactaagaggaaaggcaactggtgtgacgtctggggagggaagtatgttcctgtgcatcgaaagcctcaaacatgtgcatacactttaactagcaatcttacttctagaaatttagtcctaagaaataactaggcaatggagtccattgctacattgtttatccccaaattaatctaaatgtctattgcaaatagactgcttagattatggtgcgttcatacagtgaagatctgcacttcctcttctgctaaccgctaaggtgtcatcagtgctgtgctattaaaatcagaagtcaaaggaggtgggtgtggccctcatagccagagttgatagaaatggatttattaatataatggatggtccaaagaaaggtgaatgaaagagtcataaaagatgttgaggtagttctctattgatgccagaatagccctatggtgcacttttgagtaacagaagccaatttgttaaaaacaacaacaacaacaacaacaaaaaaaaaacagagagagagagatgaatgtgcatccagatgcttagagaagagtctgaatgtctgtatactaaatatcaacactagttactctgcgctgtgggattttggatgattttaatttgatccagtgttttctggaaaataaaatttcactacattgacacatcatttgataatcagataaaagaacaatggtgggaaagcaaggactcaagtgacccttgcttttgggtctagagcatcatgtaggaagccagcacagcccatccctttcctaggcgccaccttctggctcctggtgggacttgtaagtcccgtggtcagttacctgattgctcttacggacctgacgctggaaatcctctctctccaaggtccctgcaggagatgggacctgccacagagaatgccgcaagggatgtttctgttgggagctgtgagtggggtggatgtcctctgcctctcttaaatagatgagctagatttgaacctggggctggccaaagggagtctcctctcagaaaccaggatgcagtgggccgtctgtgtcccagccccaaagcagccagggtccagtggattagcacagagccgaccaggcctggagggtggtggtctgggattgggtgagcagccaccagcaggaatagcaattggagggaaggagaagcattgccaagagcaacttagggggccgtgagtgcaggtctctggacagacagcatggtaactggctgaggcaggaagaagcttggtgggctcccatggtgctaataataggccgtgtaggagcaggggaggcagctccagacttggagtgaaaagacgtggggtgcagtcagaatgaactccccagccatccatgtggtctcaggcaagtcactctgcctccagagccccatgtccactcctataagatggtacatccccacagtgccctgccacaggtgattataggtgaaggtcttttgacacctatatgtctaagggtcatggagtgacatcttatgaagtcagcacatagaaagtcaaaaaacccttacattcctgtaaaatacagtgcaggccaggcgcggtgactcacgcctgtaatcccagcattttgggaggccaagggtggcggatcatgaggtcaggagatcgagaccatcctggctaacacggtgaaaccccatctctactaaaaatacaaaaaattaaccaggtgtggtggcgcacatctgaagtcccagctacttgggaggctgaggcaggataatcacttaaacttgggaggtggaggttgcagtgagacgacacctcgccactgcactccagcctgggcgacagagcaagactccatctcaaaaaaaaaaaaaaatacagtgccatctctccataactccacctgagccagcagttccatcagtgttgtgacagattactattttttttttgttgtcaagtaccctcaggttgagcagctgagatgcttttagggagtgagacaatctcaggatctgtctttaaaccccgtagtcatatagggactggcaccaccagagacaacagcagatccctgtctggagctcactgaagaatcaggggtgggaggaattgcccttttaaaatggagtgtatatatgtatatattttttgcataattaaataatatatatatgtcattgaactcaggctggttagaggcatgcatgtatgatataaattctctgtatacaaataaaaggaagttacttgtattcgttgaatgggttgttatgatgactcccttcataggaaacatttggatccatttcctctgctttcgatgttgttctttcgcttctgaaccagtgtttgaggcagatgtctttgatactgagtaaagacatggcagtttgcattcactctctgaccaaaagagatgctccctactcttgcagaatactgattgcccatgacaaccagagtacttttataagaaaaggagcacacagaaggcagaaagggaccttgtttggggaggcggctttgagcagtgactttatgacataaacgattaggctcttcctggccccgcctgtcttgggatatctactcagaccctggaactttgaaatcgcaggctgggtccaatgagcgcagaaaagggacaggactcaggcagataggatttctttcgggtttggtaaacagctggcctctaggggtagggacaggggcagtgggtgggaggacttgggggagggatgggtgagctcgtgggaactgagaaactgtgtctagggcttccttagttatactgaatgctgcatgtagaggtctgcagggtggccagctgatggctggcggaagatctgctgacttggattcagttactactaaaatggcaggtttagaaagaggagagaacttctagatccagaggaaataatcaggtaagtatgctaagatgtgtgtatgtgttagccaggcacggtggctcacgcctgtaatcccagcactttgtgaggctgaggcaggtggatcaccaggtcaggagctcaagaccagtctggccaacatggtgaaaccccgtctttactaaaaatacaaaaattagctgggtgtggtggcgggcgcctgtaatcccagctactcgggaagctgaggcagagaatcacttgaacccgcaaggcagaggttgcagtgagccgagatcatgccactgcactccagcctgggcgacagagcgagtttccatctcaaaaaaaaaaaaaaaaaaaaaaaaaaaaaaaaaaaaaaaagatgtgtgtatgtgtgtatgcttatatatataatacatatttatttgtacatatgtgcatgtacagatataaacacacaaggatgtttatcatagagttgtttataaaagcatccaactaacatttctgtatctatgcaattgaaaacaacatagccattcaaagggatgaggcagagctatatgaactgatatattgggattgaaataaaccagatcaccaagcacattttggatgattctattagcaggggacgtatccacaagtttatagtagcatagggaaaagtcttgaaggtaatataaatataaagcatagttataactggacagtgggagtttaggtcatttacacaattattttataggtttttgtttgtttgttgacttctttttttcccaacctttctttagtgaagttgtattacttaagttaaaaaggaaataatgagcctggtgtggtggctcacgcctgtaattccagcactttgggaagccgaggcaggagcatcacttgaggtcaggagtttgagaccaggctggtcaacatggtgaaactccatctctactaaaaatacaaaaaattagctgggtgtggtggtgacacctataatcccagccattcaggaggctgaggcaggagaatcgcttgaacccgggaggcggaggttgcagtgagctgagattgtgtcactgcactatagcttgggagacagagcaaactccgtctcaaaaataaataaataaataaataaacaaaatttaaaaaggtaataatgtaagaaaataaagagcatggagaaagtagaaaaccagataacctcggtcctattttgttaaattttgggaaatttcagtatctgcattgtacagatgacaggcagaatcttgagaagttaacactttaaaagaaagaaagaaaaaaactagatattcactatgtgtcatcttgttgactattctcttctctgaacttcctggcatcttagttagcctatttgagctggaataaaatgtactacgtgtcttcagattctgcaaacatttaccaggcaccagggcgtccactatccagtcccaagcctgccactcaggagttcatgggggagtgagtgcatgtggcaggcattaggcagggtttttgcattctgctctcccacttgatccctgtgacaaccctaggagcctgctgccactgatcttcttattccacttgagggaacctagaggcagagacaggatttgaatccaagcctccagctccaaaccccagctgaaggaagcaagctggaacccaagatgctttcaatccctgctgctctgagcactgagatttgttcactggaatgctggagttttgctgatcattgacctcgcaggggcccactctgaagttaaaaatccccgagtgaataaatctccagcctctcctgctgtttccttcccagttctgaaagtgagggcaggagagatgagctttggccaggaattcagcgagtgactttgcgtggagtgtcagcttctccacattgctgggtgttagcttacccctgtctggcaccagcagcaaaaacagagccaggcgtggcctatagcaaagctcccagtttaaatatgtgaattcatttgggcctggacagctgcatagctcaggctgggcagaatctgccaccctaccccgtttccttgaaatctatacaggaacacagttccaaataccctggtgccagtccctgcaagctcctacttgtacaaatggattttaaaacatgtgatgatatctacctcctcccgtacctctgggcttttctaggtgtcagcatgaatctcatgtgagctttacaatgaccccagagtgggtgggcaagggagaggtggttatgactatcatgaactcccttgcttttacaagccactcccctacaatcctttctccaacaagtagacagtgaactttaaaaaatgtcagtcacatctctgccaatgccctgctcaaagccctccagtggcttcttaattcctcaagaagctctagaagtttctacgggatctggcctctgtctcccttggccttgctgttgccacatacttctagctattcctcaaatgctccaggctccaagtttgtcactgtctcttttgaacttgctgtcctctcttccaggaacacctcatcccccagatactcactggctggccccttctcatcatggaggtctcaactcaaatgtcaccttcgtagagaggccttccttgcctcccttcccctcctaccagcctccttgtctattcccctttgcctcctagcacctgccatcatattgggtatttgtcttattgtttggcctgattcctcctccgttacttaggcaccaggagagtagagaccttgttggtcttgttcaccatctagaagatacttgaaactctaacatttgttaaatgcaggaaagaatgcccttttgacagctaggaaattgaggctgagacaagtgaagtgtcttgccctggtttcccagctagtgagtgtctgtgctggattcaaacttagctcttatgctccagccttcaagtgggggaaactcaagagggcaagttcttacggggccacttaggagcagacagcttcttaggacaacattcttttatgttgatgtgaagtagcaaatctttcagagatacaggcctctaaaaaattctgccatctgccggctgctgtgttagagccagcctcagaaaaaggtcagagatccaatccctggctgggtgctgtgcacccaggaaagaaggagcagaattgaaataagtcttttccactcttctagatgagccttctaggccacaggcagggcatacccatgcatagactttaagggcctttatttggtctgtttgcttcccagttggggaaacaggcccagggacaggaagtgacctgcctgatgctacctcatgagttagtggtccaggcagttagaaccaaggtttcccaatccagcgggagttcttacctacccactatagacttcttggccggttctgggagactgagctctttccttccctgtgtttgcctcatcagcacgctggactgagcgttcccagattcagtgctggagccagcggtggggaggggagtaggggctgaagagtatatcagccaagcttgggggagacagtcacataaggaaattcacactcttcctctctcattagggggccccacaatgaggaggggaaagacaaaaaacaaggatcttgggtacattggtccttacctccccactgccccaggagcggtcttgagggttggaggagactaccagcctcctccctatagcggacttgaacttggcacatggaaccagctgaaactggcaccatttctaccctcagagggtaccgctgaagaagacgggcagagatgaaagaggaactgcttaattcagctcggcacttcttagcagctcccccatcccattgccggctttagtcccaggccagagacccatgaggtgcgttgaacattactgataccctctttgatctaaaccctcctttcgtgatcacgcctggtggctcaaagaattgctcccccagcttactgttcctgttggtgctgaaagaatgctcgtaattgttaccaaacagtggacggagcaaggcaacatgtcccctttgcccagctggctcccagttggcacttcattatggcaaagacagagggggtggggtccccgggccttcggcatttcatttgcacccacatgtaggctcacttcttggcctgggaattgatcggtgccagatgctccatctagccagcatccccaccgcagcagggctgcccgcctcctgtttcgtgaaaaacggcccggattttcatcagaccttaattggcctgggtctggccttcattctaccccagcctcttcacagactgctggccactggctgttccctcctccagccaggacaatgccggtccccgggcactgaccctggcccaggcaggcctgccaactccatagctctcatttctcactctgcacatcagtgctggcttcccacacccacagctcctccagaaggaaggtttgtcagcgggcttcaccatgcactctgacgtaccacttttggcccaaccaaactacaccccacccttgggtagaatgggaccaagatgcgaccctgacagacttaaatgagaaatgagcattttccagtgacgcctcctcttcctgcctcttgctgggcctctctctgcattgctctggggtgttcactgcacttggactgataccagtcaatgtccctcgcttcaacctgacctgaaactgaaatgctccaaacaagagtaagtggggcagccgacatttcaggaggaggaaggttggcagccaggctgctgtgagcttgcacggcccatatgggtcccagctagtactttgcattttcttttctctcttcttggaaccccttcgtcctttttcccgctgccctctagcctcttcactgtcttgggaaagggggcctctcacaaaacagtagtcaccgctgctgttcactgagtggttactttgcaccaggcactgtgctaagtacctcaaggggagtatctcccttaatgcctgcaacatcctatgagccttgtatgattgcatctcccttttcaagctgaaaagaagttacatgctttgcccgacagtctatagctaggaggagctggagctgagattcaaccccaggttctctggtgcccaagtgctcatgtctttgccctgtgtgcccctctttcacagaaacagagcttcagccaaatcctggaacggaagctcttgggaagctgcctgtgacctttcttattgtgtcccctcagcacaggtcatgcacaggcagctgggaatagatatgcgagttaaaggaattctcgttggaaaacaccagagggatccacagggccacccccccgcccccgcaataccactgtgtgtctgtccctgcagggccctggaatcccacagttgtttcctgtacccaggcctggggagccagccagtcacatggaccgtgagtgtatccgcctcacgcttctctgtggcccctggcttctcccagtggattccgcaaggtgtttcctgcaaatcctgctgatggtcttcgctggcacgtagcaaaatccacccagaacaccgcgatctgctggcctcagcctggatggggttttgtttttgtttagcttttaaaaaaatgtgtgtttttttttccccaaccaggggcacaggggtgggggaagaggagaaacatgaaggtaaaaatattgacagagtgaaaagtattgaatattccttctatttcaaaaatagcagcttccatggctgggatgcaggctggctaagttcaggttgggctgaggttgaagttgagatcaaggtggcagcgtgacccttatgcctcaagcatgtccttcaggagggtgtgggagcctgaggcagaagagagctccttcctgttttaaaaacacctttttctgagactctcaaagaatgtttgaaatcagccatccaaggtgctctgccatttttaagagggaggacggggctggatggtgtccctgggaattgaagggacccagagaagaggtgaattgtttaaagttaactcagagcattagagtgggctgatatcctctgaagagtctacttgtctgtgagagctgtttcagctacttcaaagccagatgatcagggcagcggggctggattttcatcttcatggctgtgcacatctccacttgatatgtgggggtcggagttggggggcagtaaagcctggtccccatggagatgctatcctggaagcatttttattaccaaggactagcatataattggaagattgaaggcagaagcccttatcttctcggcattctttagaattcttctgtatgtagatttcagaacacacagagccagagcaaaagaccttacttggcattaacaccaggatccacctgcccctcccttcctggcattaatgtccagtgctcccctaatgcactttaagctgtgaagttatcccaggtttatttacactgtaactaatttactcttggctggactgtcagcctggaaaataggatgtcactgcaccccccccaacctccaccaaaaaaagacagtggctaatgaagaaaacagattgttgaagggcactaaaattgaggcaaggagctgaataatgtgccctcctcaggggcaggcagggcaggcgtggcaggctgtcggcattgttacagatcagcaatgtcccactagttagcaaatgggcccctctcagtttgaatgtgcagctgatggaccaggtggggtgattaggggccaactccgtacttgtttctgtccccagttttgttaagtgcagatcacccagacagatcccaggctgagaaagagactgaagacaaagctagaagaggcagctgaagcatcctaatgtcttaactcaagtttgacttttcagaaatgtgattttagaacatagcaaacaggaagcacgtgacaacttggaccactacaacgaagagaaagtggaacccaggggaaatgcatgagttagaaatataaagtgatgggactcttagattctagggttaattgggacactagaatatgtccagtccaacgtgttcattttgtacaataaaaaacaagggctccaggaggaaatgatttgtcaaactcacatagaaaatgaatggaaaaaaacagaaagagtatctagcttccaattcctggcccagggctcttcttgctattcaatactttctacgtaataagcctgggttttttttttttttcaaaaaaattattatacttggccacccagatgagtacagttatttagtagagtacgtagagttattcactaaatcacatcaaagttgggagacagagtctggtttgaaaaccctcgagtattttattttattttattttattttattgtgataatacttaacatgagatatactcgcccctctctttttctgagacagagtctcactctgtcgttcagctggagtgcagtggcatgatactggcttcctgcagcctcaacttcctaggctcaagtgatccgtttccctcagcctcccaagtagctgggactacaggtacgtactaccattcccagctaatttttttttcgtggttttcgtagagacagggttttaccttgttgcccaggctggtctcgcactcctgagctcaaggaattcacctgcctcgacctcccgaagtcctgggattacaggcgtgagccaccgcgcccagcaagatctaccttcttaacacattttttaacactagaagtacttaaatagatgatggtgaagtctcaagctgtcctaccagcagtaaaaagattccaagtggggaaggtgaactctcaaccttgtatactgatcggtggctcctgggaaatttgcatttatcccctaacaaagccattaagagagtcattggcccccagcaagactgagatggtcgaaggacatgggaccatgtcataagcagggagagaccatcctaatctatgaaaatatttatcctggagatgatttgggaaacatgacccttcttttcaaatatcttgtttttttgtaagcccaagatgtcacctaggtgggagaaagccacagggaagcagtccaaaggagaatttttttatagtcaaaaaaaatggcttgacatggaacaggctgacctaggtcagagatggttgcacactgggcagtttaaccttgggatgggactgtagaagaaattcaaaggagcttacactgagtgaccctgaaggtcccacccaacctaaagtctgtggcctgtgaaatgtgcccatgccactgtgccgtagtttaacatgtccttctggaaggcaggtaggacccagagatgagaagtaggggctcccaattcaggctgcctggactggcatgctatgtccaccacttccgcattagatgatctggggagagtcacttcttctttacaggcctcgatttctaaaagatgggctaatgacaacacttactttatagggccctagtgaggctcaaatgggaaaatccacggaaagcatttagcactgatcatgcatggaaagtgcctgatagctgatggcacctattgtaactaataatagtattagaattagtattgtaatcattgacaataggatttttataattagggaaagtggggaactacccacatgaccatcctcctgctttctgtgtcagtgtttgaccaaatgtgttcatccctggtactctcattgcttatcctccgagagcactggcatataatggaaaatgtattccaatttgttctgttattccagccaggaacatctaggaacaggggttggaggtgtgcttcagggactacctgagcccagcttttttttttttgagatggagtctcattcttcttgcccaggctggagtgcagtggcacgatctcggctcactgcagcctccgcctccaaggttcaagccattctcctgcctcagcctcccaagtagttgggattacaggtgccctccaccacatctggctaatttatttttttttttgtatttttagtagaaacggggttccaccgtgttggccaggctggtctcaaactcctgacctcaggtgatcagcctgccttggcctcccaaagtgctgggattacaggcatgagccactgcacccggccaagcccaccttttgataggagcctcccatgggcaggcagagtaagaagtgtcacatgcagccactggtcacttaggcaaaaccctgccagctttcagatgtgcagtggaggtggcagggggaggtggctggtgctgtgtatgttttgcagatactctgtggtgtggcaattgctctagaggactctagtgtccagaagcaggcatgtgcagtttatcattacagccctccttcaaagaggacagctggccctgtgctttgcagggagaggtgcactccgggtggcccataaacccagaaaatatgattcctatctggtacagggtaccatcctggcacctggagaggggtctgcatgagacccagaaatgactggatccacaacagacctagtttgtggaacagtcctaaagaatcctccattcaagcttatatctgtcacccagggaactggacattcccttcagtcagaatgaactagtggcctccccttctcttcagccagggtctttgcagtcctcagccatgtgacctccgacctgtcagtcttggtctgattgctgtacccttgtttgtgctgtttccattgcctggaccatccttcttttctttccatgatcaaaaccctatacattcttctgagtcagttcatgcagcggaattggcattggaatgttgcagctaattgcacatactgggtgacagagtgcacagtagagaaaggtagggtgatacactcttcttaggaagcaatcaataagggccaagatggaaaagatgtcttatttcacccactgagcacctactatgttccagacactgtgagatgttgcggttagatacaattgtgagcaaagcaagatgtaattccggcagaatttagtgagtgtatgggggcagggaagaaagaggatgagacatgattcaaatgaatctacgaacatatagttacatacacactagggcccctgagaatacaaaacaggggttctgttctagtcttatgcttgcaggaggtggttggggatggctttatgtgaggaagtgttttttgattttaaatgtgaagtatgagtggcagttgatgggtaatggggagcagaagagggtctcatgcagatagaatggtatgtgcaaaggccccaaggctttgcaactgagagatttagaccagggctgccgatcagatgtctaaaaaagtatacttgttcgccccttgccatactctttggtccaaagggctgagctccctgtcttcaaaccagggggcttcaggtcagttactggacttctctcttcctgccctttgtctgcaagccaaggtaccctcaatctggcattgagagccctggggcccacccagcttgtaagtggagatttgaatccagacttcaccattggatgagattcttagacattacaagagttatggagagttaactccacctcaaagttctcaccatctgtaacttatacaagcccttctctcataattcagtcttgggaattttccctatctccgcatttccaatgcatttgacttggtggggtgtttcagatttgttaaatatttagtagtagaaagaagatgagctttgctgctgggcatatttggattcctagctgtgtgacttctgacaagtttcttaactatcctgagacttgttttcttcctatactcagtggaaataaagctacacattttggggaatggttttaagagtaagatgtactgtttgtaaagtgtgtctgtcttgttcacttttctgtttctgccacctgacacaatgcctggcacatagtaagtgctcagtgaatatttactgaatgaataagaggtttaggcaccatgattgcacagacacgatgttcatagagtagttggtcttctccttctttatcaatgactccatctccctgtcacacttcaaggccagggcaggtggttcagaaataccagaggttggctttatagttctgccattacccactttgaccaaagagggcagcagttagcattctttacttatttattttatttaaaatgaaggtttccttaaaaggatttggatcttctctttaatcattcctccgcaccttcagtgctattgattcctgataatggtcttagggcttgaagacctatgtatgggctcgtttttctcgtacctgttcctacctgagtgcccactatgtgagtgatgtggttgtgagctggaagggaggtgctgagtgagtaggggaacacccgctgcagcaggtgggccttccaaactatggccctgggtgtccacaaccttacagaatgaagcttgtggaacttaaaggtgaggaaagcctacactattttaaaagccacatgaagggtaagttatagatgtaccagggtctccttggcatctgtgctgtataaaatccatagacagagcagccattggctcttgttcaaaccacaagaaagtctcctgcccactcctggtgcattctgggaacagatttgctgtctgcaaaggctgcatctgcgggtctggcgtgcaaaggagggtggttctttggctaatggtggacttgctcctaggcctatcccagagtccctcagctctcctagcaaacaaaatcccaattaggagaaaaataaaatgctatagatggctcctgagatgttgccagctgtttgggcttcaaaaatgccccgacctgaaagctggaagttctgagaaccgtttgagggcatggtatttttctgggcactgcttcaaaggggctgtggttgaagaccatgctgctattctggtggccacttgtgtgggataaagtttcccatgggcccccgtggagaggctggagcactctcaggggatagggggtggtctcagcccccctcaccgagtgcacttgcatggcagtaagcaagtcggcgcctctgacccctgagtgggcttgagcttttgagaggtcagcatgcccccttaaacttgatgtctcctcagagcacagcacagatgcccagccaaaacacccagggcgaaaccactccaagaggtgaaagggcttgaggggagacagggtacggcgggagacagagatgcatgaaatactaacgttgaagattagaaatgggatgtgcactggaatgagatcatttgtggttctgatgcaaagacccaggcttgtttctaggggtttcttggggcttcgggggcctcctgtcaatggactgtttggacacccatttggatacatgcaatcctaaagtctatgggcagtgacagagtgataagtctttatcactagcctcagggagtagaagcccacctaagaaatggcactgtcccatgttggagcaagacccaacctaccaagctgggagttaccgcccactgcaaggcacccctgtactttgttggactctctgttttctgtctctccaatgggctggactctccagcctccgggcctctgcccaaccatgaccagaaggtcctctcctttctctttctcttaactgtctctagtgattctctgatcccagctcaggcaggatgtctccctccggcgcctccaggctggctgggtgtgtctgctgcatgctcctgtggctccctggactataactccctgtcttcttgtctcacaagagtaaaataagcttcttaaaggtaggaaccttgtctgcctgcttattactgaatccccaagacatggcacaggatctgagatgcatagttcctcaaatacttctgaataaatatcagatgagtgaatcaatgaatttcaagtggacttgaggagaaggagggggggtggcaaaataaaacaaacaataaacactatggcagagagggacacaggacctggagatggggcctggataaacagcctgccatgctcttcatatttcctgagtgctaccacaaggaagaggggcagctggaggccagagggcctgcagaggagtcagcaggtctagcaaggagtgccttgggtggagactccctggggctaattttggtgtcaccactgacttccttgagggtgctgagccttgggatcttcatgtgttggtagcttttgggtgctgtccttccacagacacatcaacaagttcatgggggtctcctgtaatagggtcctgtgacttgcctctttttggaggtcagtcttcaatattttggaacaatgtcggtattcggcctctccagatcacatttttacttgtcccttccttttctgagtaactctatggaacaaggactcctgacccagcactccaggaagccaaacacaaaaccatccccgtcttcgttattgtattacctttggttccctcccacagcctcattcattcattcattcaacatttttgggaaccctggccacaatctaggctctatgccatgtgctggagtcccagatgcagtccctgccatccggtaattagcgatgctagtgagtgtccaaggaaccaatcattaaagaacacgtgctggaagaaagagaggaaagccaagcagaagagaggtggactagcttggcctggggtggacagaaggcttcctggaggaggtagcatttcagctgggtgggtcttgcaggaagccaaaggtgcaggcagatgcacagggaggaagtgattctcacctaggcaaggggcatcataggacaggttcatatagtgatgggggctggaagcttcagagtgatagggtttgaggtatggtcccagctctgaagagccatatatatgccaccgagctatgcagaataatcctgtagatactgcaaacccaagggaggtgtaggtgaggatgtaaatgagggttgtggatcccatttgttcctgggagaatgtgggggacttaggggagaaggactgtgtttcccactgtctatcctttggggctttgacatttcccacctgacagccatttgcagagtaaaagcctcagggattctaatcatgcttggtgaacactttgaggtagtcgcctcattggacccttagaaacccaggtcacagaaacaccatcacccttctgagattcacagtcctccctccccaggtaagtcggccctgaatccaggaatcagccagccctaggacttttgccctgtcccaggccaaggtatctgtacctttcttccaaattgctggtggccccaggaagaaatcaagagtggctgactttaagcagttagattaaacatcaaatgcattcatcccaagtccaggcatatacctagaaggagcgactcttaaattttgtcatttcattgtgtaaaactgaggttgccccttaacacatgaaggccagcatgggatgctaattttgtgttgtgttcttttgggtaatctcaaagttccaggaagcctgaccttcctaagcctgtgtttccttgcctccccttcccggccccttcatttcatctacaacagacgtcagcaggggccctgagtttttcccagaccgctcaagcagaaacccatcctgctcacaaggtgaggagagccaggagctcacaaaggcccctcctccccttccccgggaggtccaggacagggcatccccaggacagacctgccctggggaccccggaacacaaggcaggtactgagaaacaggaatctctgggcagggaggttttcatatcctccaggtttaatagctttccctgagatggaaacttgggttgaaatgatttgcagctttccagattttctgagtgtgtgtctttgggtttatttttagccacaggcattcatttcttgccaaaaaaacctgcttaaataaaaccaagattaatatttttacttaacggaaagagttagtcaggacaggctttgaactgggactccttatcttgatggggagtgcatgttaacggtctggccttggcgttgacatcaacgaaaagggcctttgaaacggacaagagagaagggccctgggggaccagggtaggatgcaggaaaagcctatttgtgggacttctctgaagagagagagttcctcttcactcaggctgctcgccgctccccacccccagcccccagcccccatgctcttgcagtgggaggggggtcatcatcttcctggaaaggcgggagatcggctctggctttgctcagagcccggctgtgattctgcctcacttccagctgctctccttaccgccgccccctccgccccccacccagatcagatccagacttcttcctcctctggattcagacgcagcaaactgagtctcttctgcaggatgggctgaggctcagatctgatgccatctccagggcgattccctgacacccctcccctgagatggacttcatctcttcttggctctgtcctggctttccgtccttgcttatattgctgagcctgccttacttgagtgtcattgctggtctctctcacctctggcccttgagttcctaggagccttatgtatctctctatccctgtatacgtcttcacaatactgaaacaccttcctggttgctgaagagttgtgtatctgaccctgtgaaccgagaattgctgttacccccttttgattgaataagacttagaaagactggtcatttgacagagcttgcacaggaattatttatctgtttttaaatcactctgtgtgtggcactttatacaagaaatcacacgtagcttcccatattcagcaaatacatatgaggtgcctgttatgtgccaggcactcttcgggcagctttggctacagcaataggtaaagcaaagaacctgctgcccggggaggcttacattttaatggggagagatgatcagtaaagaagcaagttaatgtataatgtcagatggtggccagtgtctgatagagcacagtgtcaggggccaagggattgcgaggagggggaggaatgtgcatggatcaggatcagggaaggtcccccgcccaagtgaagaaagagtgttccagcagagggaactgcaaggtcagagaccctgagagcatgcttgggtgctagggtgtgcagtagagtgagctacaatttcctgagattaagaaggccatgagagccccgggtgcagggaaggcctgttatctggagctcagtgttggatgggtcgaatttgagatgttttattaggcttgcaggtataaatgtagactaaatgtagactctgggatatataagtaaaaagatcatcagggaggggaacaacatacactggggcctgttggtgggtggggtaggggagggagagcattaggaaaaatagctaatgcacactcggcttaatacctcagtgatgggttgataggtgcagcaaatcactatggtacatgtttacctttgtaacaagcctgcacatcctgcacatgtaccccagaacttaaaataaaaatacaatttgtttaaaaaaaaagttcatgagagttctaggttggcggtggcaaaagcgtgggagctgtcagttgtgcagatggtgctgagacccacaagctggaagaacatagcaggaccacgagcctgcacctcgatgaccggactgagcaccaagaaggtcatgggtgacttcgacaagcactgctttggagaggttaggggggaggctgcctaggttattgcaggcacctttggaggctggtaattatcacccacaatttatctgctgggatgggaagtgacttgcccaaggtcacagagaaacagggcagcgacttcacccagaccccacgtgctccatgcctgtttttcattccagtacgccgtgatcacttctccagttttcttgatctgtcctttcagcttctgagtctttcaggagggtttttttgggagttgggattgtggtgatcaataggctgggaatcagagggacccagtccaggcaggcccctcaggcctctgcttttcacccttagttccgaaggccctttcctctcacctagacatcatcaaagcatccccagagaggcagcagatatctgagaaggaccttgggaagggtcactgaggaaggttctcaagatcctggggggatgaggaaatgctgaatcacaagaatctttcgggttcctcttgctgttttcctctgattagtaaatttaagaatctacaagtcatcaccatcagcaatataacagtgtatcatttgtctagcttcagggttacaaagtacctttgtacatatacattgtctcatttaattaatcaatctaattaacttcaaacttcctgtgttgggagaacccttagggagcctgtggttttgtggtttctaagttatttgtttttattccatgaaagccttgccggggagcacaaaggtctaaacagatgatacgatatactgttatactgctgatggcgatgacttctagatttttattactaatcagaggacatgtgtttgtgtgtctgtgtaagtgattgggaagggtggtgggtgggtgatcaaagggatgtggggctcactgggagcttatcaagggtccttccttttaggtatcaatcttcttctctgatcctctgcagtgaaagtggggaatgcagtaaaattatgaactattttgcaaccagtgtgaaatcccatgtaaaggtttttaggtggtctgctgtcctgggggacctcccatttttttttttcccccactaggatgcaaaactgcttacaggctacctgatcctcattgtccacagttggaaagtagggacattaacagccacaacagtagccaccttaccagcttgccatgaggacagagttaaagaacatgcacacgttgcttggcacctaagaggcattcgataaatggtagtggttgttatcagtatgttctagttcccttccttctcctctagattcactaatgtgatgctaagaaaagcaagcagtttgtaattcttgaatgggtgagcagctggaagagtgagagagcctggctctgccctccttgggcaggctacattgtagagtgtccaaggtgggcaggaaaaaggcttgcttggcgggctccaggccgacctccctgtgggtccctgacctattgcctttgccatgagcactccggcctcagcaaggccgctccctttgtcatcctgtgggagatgataaaatacacacgaaggggccgtgagacaagctgggtgacagggatccctctttcctcctttttggtgtgttttcatgggtagggcatcattccaacacttccagatccctcttttcctccaagtctaggccgaagatgcgagcccatggtccaggcttttcttcctacctagagcctgcctgctggggtcccatcagaagagcagccccttccctgggactgacactaacagtgacttctgcatttgaagaaatgcagtctacccactaaccagacgtcccttacttatccttgctgtccttttaaaaaccatgccttaaagcagcaaaatcattctatggggtctttggagagacaggaatgggggtgttgtgtgtgtgtgtggggtggcggtggtatctcacctgctagatagcatgaatcaactcctaagtcatggagaggatttgtactgctcttccgttgatgctaccatgggtggaacctggactcctaagttagtatacattaattagttaaggagtccttgatccccagaccagccaaatgggtagcattgttgctcggccttctagtctgccagtaggaaagtccaaccattaggtcggggaagaagggtctggatttggttgacaatggttggatgggggatagaagcagagagagagagggagggcagctcaagggtatcttgccccactctgtttatgctgatgaacagcacatgtgcaatttctggagacacaccagtaagcttttctggaaactcaatcccaattgccattggaaaattgttctttgttcaaaacttgtgccactgtggtccatactgctagagctggaggtggggagaggcagcatgaaggtatatttatggaagaggtgtgccttgtttgccttgcttttgtaagctcttactagcactcttgcccaaacaaatattcaaaggaagcaaagacagttcaatagagatatatgcctctatgcctggcttctcaggcgcatgatatattcaagagggccccatatatatttatagatcaatgtgcccattatataagttcacacatcctagttagtttcttcttagatacttttacattgaaatactgcttattccttaatcaatctcttccttgtttcttcttcttccttttttttttttgctgagacagagtcttgctctgtcacccaggctggagtgtaatggcatgagatatagctcactgtagcctcgaactcctgggctcaagcaatcctcccacctcagcctcctgagtagctgagactacagatacacggcaccatgcctggctaattgttttaaatttttataattttttattttttatagagacaaggtctcactgtgttgcccaggctggtctggaactcctgagctcaagtgatcctcctgccttggcctcccaaagtgatgagattataggcatgtgccaccacacccagcctcttccttgcttcttttgaccaccagatccctagaagcccagattctcttcctaagagcaaaagaaattctagagagacaagagaggctcagaggctgagattcacactgagcctcacctctcccttctctgattggtgcttctgtaccttggagactagtcctctagccataaactttttttttttgagatggaatctcgctctgtttccaggctggagtacggtgatgcaatctcggctcactgcaacctccacctcctgggttcaagtgattctcctgcctcagcctcccaagtagctgggactacaggcggccccatgcccagctaatttttgtattttagtagagatggggtttcaccatgctggccaggatggtctcaatctcttgacctcgtgatctgcccacctcagcctcccaaagtgctgggattacagtggtgagcctccacacccggccagccataaacttttaaaccttatctccccactagactagccatcagtggaagcgggaaataggacttctatttcttgttgtcaccctcaccagcacccaacccaatgttccagacaccaacctagttcatgcctatgttggtttgattgttgggggcactgggtagacagtgtaggggccatactccagcatgaatgggaataaagacaacctgtgtccagcctggcccatctgtaaagctggcttctagccaccacaacaaggtggaaggaatggctagacatgctgccagttaccagtttgaaaagtgtcttctgttgttggaaaagcacaacctcctcccaccccacttcccttgttccctgtggcccctgggccagcgaatgcctcgggagaaccctgattgccaaacaggagagtacaaaatagcacacatttgaattacagaggagaaactggagcaaatacggacagattaatgcacaaaccaaataggtggatctggggttggccagcaattctactttggaaggactttgagaatctatttggagggcagaatgtaacttaattttagttcagtttagtgaagttttgtttttgtaaggaaaacactgatgtggcctcttcactgggccatctctgcctcagacttttggaaccatgactgtgatcttgtttggctggtcttagtaggcaattcttgggttacacatgggtgataaggtgggatgggtacatgtgatagagtaggcactcctgatcccaaaatacctcctatacttgttctgactacttcatctgtgcttctccacctctccctgaagttctgtaaggctagaatatttttatgaggttgcctttcttctcatcctagggagaactcccaggccttagcttacagtgcatgttagaagtctgaagatggtatgccctaagatggaataaaaatagacatcaccatagtggtgataatgctaataacagtggtagcaaacacatgaggtttgggatggactacatactgttctcagcgcttatattaatacgaccctcacagcaactttatgaggcattgtttcatcattcccatcttacagattgggaaaccaaggcatagagaggtttagcaacttcctgaaggtcacccagcaccagggctgggatttgaaccctggctctcaggctccagagaccaggctctttaatgcaatgctatgttgctgctccaatagtaataagcaaatcacttgttagccacatgagaggcactgggctaagaaagccagagagattcaggaggaaagagccccagagagatcatacagtaatggtggaacccaaacttcaatgcagcttcctgactacaaaaacgtattcttttcactgaactatcctcagatgaaaaggttccaagctcaggctatttggggtaaggaaggagttggctggttgtatgtgcagaagcttccagcagtactcagctttatggggcaggtctgcttgtgacatcttctgtctaaatcaagtcaagccatttttgaaccaggatgttgctatttaaaggaatcccttttgccttgcccctcccacaccccccggccaagactcgctcccttgtttaccttctgtgttaatgaggcagagaagatgggtccaaatcatttcaggaagaatcagtggtaaaggctggcagacatgcctctgcacggaggtgaagctgttataacctgcctgtgagagttaatatggaggaaacagtccccggggcctccgggaggctggcttgtcgccgagaatactaccgcaatgttagaaacagaggtggatgcaggatcttgacagacattggcctgggatcttgccaacctctcgtttttacagcagacttggaaacaaccactcgcctcctcctaatttgagctgcctccgctaaattgctcactttgccaatgactgtgtgttttgccatcgccggcagggaaggtctgaaggggccattgattcatctgaaccctgacttcatgtctgactgcaagggtaggatccaagctcatttggaaagaaacaagacagaatccagtatggatgaggaatcagttcttagtaaagattttttaaaaacagagattagagtcaaataactgggatacatagtggagcatccacaatgaggaaggataatggagctaccaaaatgtgtgtgtgtgtgtttgtgtttgtgtgtgtgaagggtattttacttaacaagcatttattgagtatctactcctttttgggctaagtgcaacttgagataagaaagattgataggatctcagggctgaaggagttcaatttgtaattcaaagtatgactgcataagcaagccccattccaattcctgttgaggtcttagcatggaagtatccagcaccctcatcacaccccctgatagaggcactctctgccctaatggcagcccccctgccttttgttgctggttcttattattagacgatttttttctttggttgagccaatgaatgttactctctgcaatttccagttttggtattcaagacctgtccatttgctcctccatgtgccaattttacaaatacctgaagacagctcttgggtgcttctttttcacacaacgtagaaagagaagcacaaccttgtagaatctaaaagtcaagtcctctcctctttctgttcccagtgcatgtggtaaatgcctctctttcagccctcaacccactgggtgtaattacttttgtattcatagttaactagtatctactgggtaaatcctttctgccagacattgtagtgggaaatttcataagatctttcgttcaatcctgattccaattccctgatgtaaagagagttataccctctttatagatgagaaaattgaggctcagaaagaggaagtggtttcacttcttggtctgttaccttatctagatcatgtggatgctaatactgcccttgtaagacagttaagagcagtaaataagtgaaatgtacatggcacatagtaggtgtgcaataaatgggagctgttttcattggaacagcccttccatggttagcccatttcatttttggtgatgataatgatgatgatattaataatatttgtctagtgcaaactatgtccaagacagtatcaagagtttcacatttgtcatcttgactaatcccttcagttcaagagattagtatcattatgattcctgttttatagaagaggaggccagaaacaaagttacttacttgcatacagtcgcaatagccataaacagcagagctgagattggaacagttctgtctggctcctgagccccgactcccaattgctccttcttctaaccacatccccatagagctcagactctattgcatcccttgctatctaagcactggataccaagggctcaatcagaatgctaactgggggcactgtgggaagctagggtgcaccacaaccctgtagacatgtcaagatgtggtgaattaatgcatgcaaaggaagagccccaaatgaggtggttagaaaggggtcctagtggaaagagaacagatctgggagaccatggcattgtcagatggacaagggaggggggacaatggctctaacaggagaagtaggttttggattatggtaaagtcacaaagtcaagaaaatcctcagggtcggcgggggttgactatagccttggaagttctggagctggcaattgtgaatatttggggtaattaacttgaatggtggctgtttctttttcctccaacctccctctcaccccagggaattcccactcttgtaaacacaatcatctattccagttggctccaaggtaagagtgcaattccaggctccacagaggctagcgtgcccgccctgagatgctgttcctgatgtggttcaggccttcctaacctcttattgtctccttctgtctctgcagtgatccgggccaaggtggtggggaagaagctggtaaaggaggggcccttcggcacgctggtctacaccatcaagcagatgaaggtaggtaatgtcatcaccctggctccgggaaggtttttgggtttttgccagaagagtcctggctaagggaggcaaagtgggttggaactggggtgtgtgtctaagcaccagccagacccagcccttctgcctgctggagagggagctgctaaggctgcataaagggatgggtagggagggggcatggggctgccttgtccaagagcccatgcaggtggagtcactccaaggcacttgttaggaagctgagctctggagccagatggcagatagccttgttagctcgtaaccatgagaccttggtcaagtcactgcccctctctgggctttaatcttcccaattgtgaaatgagggggttggactagatcatctctatgaactcttctgagctctgactatctgggactcaacagtgcttacaggtttcatgcagccactgaggttacagcttaggtttacagccctcaaatctttacatggaaactgtgctgatcacaggaacctcatcccaaggcaggaacttcaccttctttccctattttcccagctgattgtcttcttgcatcctagatagttagcaatgtttgctaagcatattcttatcattaaacatattactgaggatatgaacatcatgaagtacaggaaggaggtatgcccttaagaaaaagaacaccagatttgaaatctagagaacctgcctcctagtctcacctctactcctaaatagcctgcttaccttgggcttgtcccttttcctgggccgcagttttgccacctgttaacagtgtggggttgggcttggtgctcctaacatcctctctagctcaggcattctaagcaccctgggatgcgggccatgttacttgtaaggaggagcgggtggtatacaatggaagggtgtactggtgattgccttagcacagaagactggggcttcaccttgaataactcagcaactggttcatcaccccatctttgtaagcacctctctacatgcagagctcccagctaggagccagggaggccgtgagggagatacagtttccatctttaggaactagagtcaggttgggagagaagaggcaggtatgtgtgtgactcatcagaagttcaatgtggggtgtgctgaggtccacaggaactgtccagccctttaacttattgctcatatttgcatccctagcaattagggtaggacctggcatgcaaaagtgacttggtgaatgcttatctgtctaatacgggcatgagggtgagaccccacaggcctggaaactccccagaggagacaagccgcaatgtccaggtagaagggagtggaggagtgacgcagcccacggtggtacccaaccatccccaaggccaacctccaggctttcttattcctgtgtcctgaggctggatgtactaattttgtggaacctgttgctttggattcaattttgcaaacatccacagccttctggttatgtaatgtccagagtcagccctggccagttgcccttggctgcctaagcttggtcatgagaccagcttatgtcttcagacagccctggggagagaaaaatgggcaggggtggggaaccagcaagagcaacaacaacgcaaaaagcccactttgcaacctctggcagacagcgcgggaatgccaaagcatattagaccaaagcagaggttcagaaaacacacgaacctgcctggtctggaacaatcctcattacgagacactcggtggtcagcagagagctgagagggaaatagctgggaggcagcagttcctaagcctgcctggtttccttcctaccatcagggcctggagaccagggtgaccagaggcccttcctgtggacataatgtcccattcccccttgctggtgtcagaccagccacgggtggttgtttagagaccaaacaacacttgctagcctatcagcatcagacactcccactcccaggctggtgggcttagaagacacactcccactcccagactggtgggcttaggctttcggttcaccatccttcgcctgagctcatgaatcatggtgctgggaattagatgtaggatccctcgtcttacttctgacagaggcgcaaaggggaaatgacttactcagagtcaagcatttaactaagggcagatctgatccccaagctgaggcatcggaatttcttcccaatcctgtgttctttatatgactcccaaatctccctgccatcttaatcatcagtcaccatctcatgcctttcattcactctgaccctccatagagggtatcatgatccatagaactggtcagtgcccttctatccagagacaccactggaatctgcttgtctctaggtaccagcctgcaagtcagacaagatacaggctagaagtaatagtccgtccatccatcctctcgtgcttccttcccaccctctctctgtgcttagtactgtactatgaactggggatacaaagataacactgcttataattatgataagacttggcatcagttaacatttactgagcaattgcttagtgccaggcattctgctaggtctttgcatagatcagtacttatactaacactgtaaaatagataacaccttgtcctctgtttgacaggtgaggcaactgagacctgggaggtcatataactgttaagattatatggccacaaagtggcaaacctgagcaaaactacagggtctttgcctataaggagataatacagtatggagcagcaggctgattcatcattcctacccactttggggtatataaatgcccactccatatgtttttagttcccagggaacaaaaagaggtcagtttgggtttgttggtttatcatccagcagtgtagggctggacttgtaatatcctgcaaagggtgtatcagaaaaatctttgtaggagggaagagagagaggccagagaggcaagcctgcatgagttttggcactggtccctgggagactttgttctagcagattagacagtctaccctagagagtcagaaggggtgagcaagggcttccttagagcaggactaaaggaacttggagaacctgagactccgagccgccctgtctgacctctctcttctctcactgatggaaggcaggcagaccttctcccgtctgctaactctggagcctctgacccatctctcaggaacacttcagtacacagagacctgcgatatgtgtgtgtgtgtgagggagcagggtgttagaatgttgagagagcttattgcaatcccaaacttggaaattagctgggctgtggggtgaaggtgaaagtttccagaactggctgctctaagctgtggggaccttatctcccatcaggaccatgagaaaccgatccactgtgccaggagttattgtttatgtagcggagacatgctctccagctggctgcaggggacagaacgtgggggacattatgtcccagctggtcctgggagggtcccatggggagacccgctggtcatgtgctttgcatgtcctgactgtaggcagagcagacctccagggacttccttcctttagtggtttgtctaaccaaatgagcaatagcagggtctcgcctttgaagctctagctggaagcatctttgacccccagcccacagggaaccattcttcttgcaatgcccgtggttcttcctgccttaggactctcatccagccctctgcagagactggctccatttctacattctctgcctgtcctgctagacaaattgctgtatagagaaagatcatggccgtgatagctcggtcggtctgtaaataagaatttgtgggtttaaatgagtccgtgatgtacaccagcatccagaacagtgttgatctttggtaggcatgcaagacatagttggaatcattgaggcaactcatgctgtcaatgtagagtgaaggccagacatttcataagaaatatgcaaatgtccccagactcagaaacttcttttttactttatttgtcccttcactccaagggaagctaacatcttggaactttgtgtagatgctaccaagaagaagaagaggggcccagaggcatgcagaacccagctgaaaaagaacaacccacttatgtctgaagttctaaaccagctttaactactcttgttaagagctgaggaagggacttaggagaaaggggaccaaactcattcctcctctccttacgaatttcagtataacttgttctaagctaacttttattgaatgttgtgggctgactgctattctaagtcatttgcttctctcaaacaccctaagaagtgctttgacccattttacagatgaagaaactgagacccaaagaggttaagtaactttccaagtggcgaacacaggtggcagagaagattgaagattcaaactctggctgtcagcctccaaaacctgaatttaccactgatctccatggcattggtttggattagattacctttaacatcttttccaactctgagattctaggattctctgatgtcaggacattataaacctattataactctcctaaatttgtcaaaccaattctagatctctatgattacagacatgatacttttagaatcaatatttaaatcaaggtaggattattacacagaaaacacaactgagtagaatctacctttgccatgttgttcttttcagaattgaccctaaaacacagcgctatgtttgtcagagccagtcatttgtaatgtgtcagaatttcgactctaggcaagtgctaggagctaaaatgcaggttccttcaaacttccaagtagctgcggtgccaagctgatttcgatgagttgagttcttactgagcagttcaaatgaccagactgtaaccaggggcttcattctctcacccacgaagcactagggcagtcaaggggaaagactgacgcagaaggaatgaggttcccatgggctgggtccaaaagacctagagcgagtgcttagttgaaacatttgccaaaacctcaaggaacacccacacaaaaataagaagttgctcggcacagaagtcagggtaggggatgttcttcgaaggccacactccatggcaggcatacagcagcacgcttaaacatggttcctgttaaggctagagaggcaccattcacatagaagaagtcatcatcgtgactctacccaccccgcgcccccaccgcgtaattgaatgctgagtgtggacggcacttcttccagcacttggctgcgttaccgtgctcagttggcaagccttgggggagaagagaggttcagaaggaagaccatctgagtccatcagaacaatgtgtgcttttaacaaggcaggggcgcccaaactcagtaggtccaacagaccaagttatgctatgaaggtcttgtggaccacctacccccgccaaccagtcaccacttaaaagatgagaaaacgccagctcacaggccaaatgggaggcatttagaagagacaccaatgaagagatgtctggctttgtattaattactgtaggtaaattaataccaaatgccaggaagtaaagtagaggcattttcctattataaacccttgggacaagcccagagaccaccagcagtccagggcttgtgtacgctgagaactgaggggataacagaattgtgcaacaccttggtgccccaccgcccccgttaccaaatctcacagttcacagtatcgccttggcacactgggcttgtgtaatactcatggacttgacctggaatcacaaagcggactcagcttctgttacattcattcaccccagtgactctgggcacacactgtgcctctgaaggaggcacagtggccataaatggaaatagcatttgcctgcttctggggaccttggtcatagacttctgaggctttcctgggagccagtctaagataatgggtaagagtatggactctgaaggcagagtcctctgcttggaatcctagccctgccatttcccaactgtgtggccttaacaagctacttagcctgcctgtgactcaggctcctcatctataaaatgggcataatagttcctacctcatagggttgtcatggtgattcgtgggctaatattaaaggagatttctcaacctcagtaccattgacatttggggccggataattctttgttctgggggctgtcctgagtattatgggatgtttagcaacctccctaccctctacgaactgttgtgacaaccaaaattgtctccagacattgccacatgtcccaaatatttcctaggggggcaaaattgcctccagttgagaaccactgtattagattatgtcgtagatacaaatagccaaatatcagcaatttcacgtggttcaatctaacaattataaagtatttaacagttaaaactctttgaactttgtagatacatttatgtgcttcatctgggataaacgaacccaatgctttcaccagacgctcagaagaataaaaaacatggagaatttctagcttgaattcaacgttcaccagccaaatagaatttctataaagtggggtttgtaatacatccctcccagggctcttttaaggatactgcaaggagaatgtgagtgagaatgtttttgtgggctggaaagtgtcacagagatatcatgagaatgctggctgagttcacgggactcaggtcctaaggttgacaaagaaaaaggacctttgtcacagctacttctctggatttctgaaaaggtgctgggatgtcagacatgtgtagccgaaggagtgttgtggggcagttggaatggggggtatggctggctgcacaggaaggtttctctgggaaggcaccaacctggctagtcaagaggatcggtggcttcatctggggtgaagggggccctggggtgggtagatcagtgaccggccactggacagctgaataggggagcgagattccctcagatccaatgtcagcaagccttctgggtactgagactcctctcctgtgttcctcttattttattgatacataataaatggacatattttgagagtccatgtggtattttgatatattcaaaaatgtatagtaatcaaatcagggtaattgggatattcataaccttaaacatttatcgtttcttcatgctgggaacatctgaattatcctctactagctactttgagatatacaataagttattgtttactgtagtcattctactgattcaatgaacactgggtcttacttgttctgcgtactcgtatttttgtacccattaattatatctctttgccccaatccttattacctttcttgcctctggtaaccaccaatccactgtccatctttatgagatttactttcttagctcccacatgagtgagaacatggtgtatttgtctttctgtgcctggcttattccgcttagcaaaacgacctccagttccagctgcattgccacaaatgacaagatttcattcttttttctggatgaatcatattccattgggtatagataccaggttttgtctatccattcatctgttgatgggcacttaggttgatttcatatcttggctattgtgaatattgctgcagtcaacatgagagtgcagacccctcttccatattccgatttcctttcctttggatacatacccagcagtgggattagggatcatacgggtgtccaaactgggaaagaagaagtcatgatgttccttttgcccacagatgtaccgaggcttcaccaagatgccccatgtgcagtacatccatacggaagcttccgagagtctctgtggccttaagctggaggtcaacaagtaccagtacctgctgacaggtaatggccaactctagcttctaggccagggtttggccaaggtccactgtttcttgacttcagaagaacacatacggagtagttgactcaccaaatgtccagtaaattgtaaggagtctctaatgttgaattcatcccacttacccagtgctaggagcttgaggctcctacacttaggctggactttggaattagctccaccactcacctgggggaggaaatctcctaatttgtagcttctcaactttactgtaaataaaaagggagtatctgttcctctccacctcacactcgacctgttaggcccgtctttgaaagttattcatctttaggcagtcagtgtagtaaaggagaaaacaaaaacaaaaatcattataaagggagtgaagagttggcctctagtcctagctccagtatttaatgggcttgggacctttggcaaatcactttacctctccaagcctcattatcctcatctggaaaatggggctacagtccattttaaaaggtgttgggtagggtgaaataaaatcatgggtctgaaaagtacccagccacagtgcctgggctaagtgggaacatagtaggtgtgaattctctctgggctaggctctggacaaaacaacctctccttgttttcttctttcctcctgtaggtcgcgtctatgatggcaagatgtacacggggctgtgcaacttcgtggagaggtgggaccagctcaccctctcccagcgcaaggggctgaactatcggtatcacctgggttgtaactgcaaggtaagctctggggtcactgggggaaggaggggaggtgctgacttgcagccctagaaacatcagctcccaatgcactgggtgccaggccctcggctgggaagggtatgcatgtgttaggccagggcagaggggcaggtctgagcagatatagtaaggattgttgccccaggtggggcagtgaggaaggcagggaaggaagaatgcctttctgctgtaatcggctgcctccatgatgaccacttggaagctgctggggcatgagggctcttgagtccctggccccacctggcagttcaaggctggaggtataggatcctgacactggcaggttctcccaagtggtttcaagtgggctcaccctggtagctgactcatcgctaaccccaccccaggtaggcaaatgggcccaggactgcagagaccagatgctacagaaggtctctctttaccaggcccatccccctgacccaagtatagggccaaggtgcagcctgcctgctgtgggaggaagttgggccattctctcacttcatcttcaaaacagtcctgtgtggttttaattactatgatctccattctgcagatgagagctcagagaacttaagtaactagccctaggtcccacagttcactgaatctggtttccaacctagggcagctagactccaaagtttatgctctaacctttctaattcctcgattccctaaaacaactgagatctcccacctgagacgaaaaagtcctctcagtagtctaattctgctacttactggctgtgtgacctgcagcaagttacttaacctctcagagcctcctaaaactgtgataagaattaaagagaataatatcaaagcacttatcagaatgtctgttagacagcagatgctcaagctagtgctatttatattatgatcactgagggactgatgtggctaggcttcccatgcagtggccccagggtctgaatccaggctcggtagcctcaggcctgggcataccatggcagagtccatcaactgctgcctgttatctaattgcagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacacatctgctgtctcttgccttgttgtgttctgacgccacggggagttatgtatacaccagcaggccttgaaagtctatccccagctccaggcctggacacatccctccctccatgcaccgctatggcctggccccaccctgctccagtccttttcccttgcagaaggaatcttaggagaggtgccctgccttgactttgctccctgattctattgctagagtcctccctagttctgctgaatctggatgtattaatatatctgtacctaatcacctattggtggtacaagtacccccagactggagtccttactcagccctccttgttttcttcctaagaatcccaacctggtggaggtggggaggggcggcctgcaaacagcagtccttgatgtcaactgcctgcttgaaattccaagtatggcttggcctagttgggaacaccaggaactcatgaggtctcacgacagctggtgaccttttcccagagcttataacaacctcctttcagagtatacagcagggcctctcactgtcaatgggctgggctggctgcagacccctcgcctgactttcatcccaccattgacaacgttctaggttttcacccttgttttaaagctactcctactatatgccaggtacagcactttatatacaggatctcatgaaatcctgactactcgatgaggttgctccacaatcatccacggtttttacctgaagaagttggggctcacagagataaagtcattttcctgagacctagtgtgtagacagaactggcattcaaattcaggctagtttgataatgaactctgaattttccccactgtaaggatgcatacagtaagaaaaatccagggtttggggatatgctgggtttcacatgtgcccttcttatctcaaccagcatgttctggattctgtgactcttgcccgatcagatacaggggaaagatcatcaatagaaattctgcttggttagagtgattactcctgaaatctgcagtcctacccatcagtatctccaaacaggactgtctagcccagaagcctgagcttggactctacaaacagccacagtaagtccccacctgggactatggtatactctattcattattctgttcccaaagacgcattccctgcaaggccaagcgcagggtcacagccttgaattcctttgaccagtttacgaagaccatcaactatgcaagcaggcatgttgcaggctctttcctgctgcttagagctcctccccccaacactttctggcttcaggtggagaacccttcacctcattcagaaagacattcacctcttccacccaggtatcctccaaatgggaggctgtaccacatatcctgagctaagccctgcttcccagaggagatctcaggtgcattcagaaattggaaagtgaagaggacatgtaaggaaactgcccttcaacaaccaatgcaaatcaaatattaatattactgctttttattaaaatatgagttgaaatcaggttccacaaaaggctcaagtaaaacaacatcccaccttgaaaacatcttttacctttataatcagcctctggttctaacatgcccccagaacgtgtcccctgatttgctgaaaatctccaagttccaaggaatgtggttcacctttgttatttgccctattgcctgaatttcacctggagagacgacttcccttaggaaatccaggcactcccacaggacactgtgactccgccttagagtctgcgtggtcagtgtacaacccctagagtccacctcctccatccaaagagaccgaggacaagtcatctgtattcattccgcatcatgcaaagaaacagagtaaaaaagggcactcaccattggcttatggttggggaaaaatgtttgctccacaagcgggaacttctcaggacccagggaatggaagatcttaatgagctgagagaactaggatagaagaggagagaacattgatcaactattgtcacccagtataacaaaacctcccacttgatctgaggcctcaagcatctgactgttctgagccgagcttcagtaggtgctatcctaccctgcctataggataaagaccagattccttggctggacattcatcctctccatcatctagccatattaacccctccatttctgcccaagacctagtaagtaggcagaacactgggttcagcccaaccatatttaatgagcacttactatagcctcagcatttcacaccatgtccttctccacctgctgatgttcatgccctgctccttgcctgccataccttctttctagagaggcagcgctgcatggtaattgatggtgttagatgtggatccagccttcctgggttcaaattcttgctttgccacttactagctgtataacctgggaagtcaattcaggtttctgagctttcgtttcttcactcgtaaactggagatccaacctcatgggattgttgtaaggatacagtgtgtcagaggcagtgctttgtccacagcagtgctaaaatgctaggtgttatattaataaatattttctctgctgttgcaacccctctcatttccaacagctcaagccacatcccttcccactgctctcctcctgcttcaacacttgcttgttttgccagatactagctactgtctccggagctcaaaggtgagctctgtcgctatgctttattattggagcaacaagctgaatatgggggcaaggcctgaaggaagacaggctgcaggtgcatggctgtgacactaatatcttgctggagggaagcatagggggtgaagggacctggaagggggacagagtagggagtcaggatgatcccctggagcagacgacataagagaaggagaaagggccctccgggtgtgcattgagactaatgtatgctggagaccctctgcagctgccatgctgtggcgtcagttgcaggtgatgatgagagacgaggtggaagcatgatccatcacagaccaccagccttaaaggcctgaccagaaagcttagaattcacccagaaggtgaaggagagctgctggtggatataagcagagaagagcaaatcagattccgaacaagataaaggaatcaactggaatttgtggtcccatgtggatgcccagtggttaaaggagtggccaacctgacttggaggtcactcaatactaagagcctggacactgaaaacagagtaactaggaactttctgcatccacccaagattggtctgcaaactcttggggtatagccttcagatgcagcacaacagggagtcaacttcgagggtttaagagaactcagaaatatggaaaacgatgtatgtgtgtgtggggtccctcattttgcagacaaggaaattggagtccagaaagggagagtgattccgcaggtaagcacatgagttttgaagaggcctagctctaccactttctactagctatgtgagcctcagtttcctcatctgtaagatggagatattagcaactcctactcataagggtgctaagaattaaacacaatatgcacgttaagggctcaggatagcacacggctagtgctgatgagttgtggttgctactatcgtgataactgtgataaaaggtggggaagggctaacaccatctaggaccctttcctaacagtggcactcgaaaatcttggatgccattggccaaaaagcccagttagggcagaatgagaaggagaccagggccatgacaatagtggtaaattctatccatacctattaaattaatgcatgtagccattcagtaagtactgagtgttccaactctacatggaacttgttccaggtatctaaggcagtgaaaatttttaccacttattgagtgtgtactttgtgccagccacattctaagcgttttcatctattaaatcataaccctaccaggaaggcgctattactaccaccactttccaaataaggaagctaagttcagagaggttaatggggttgctgctcgagtaacacagctcataagtggagaagcctggacctaggaatctggcttcagagctcacactctcaactaccaccctacaccaccaggtgatcacacagagagatagcaaaacaccacagaccagacagctatgagcttcatagagcactttctacataccccaagcctccacattacctatcctctttctgtccttgatcttcccccttgccactgatcataggacatattgcatatttggcataagtattaaagcaccgcacatgcccctgctcactagaatgtaagatccacagggcagggattttggtctgatttgttcactgctatgtttctaggacttacaacagcacctggaacacagtaagtgcccaagaagtatttgctacatgaacgaataacttctaatcagggagacagataatgcacaaatgaatggataaatttatcattctaggtggagataagtatctaggaaaaaaataaagcagggtaagggatttgagagtacttgagcgagtggaggagtggtattttttctttgagatggagtcttgctctgtcaccaggctggagcgcagtggcgcaatctcagctctctgcaacctccacctcctgggttcaagcaattctcctgcctcagactcccgagtagctgggactacaggtgcacgccaccacgcccagctaattcttgtgtttttagtagagacggggtttcaccatgttggccagcatggtctcgatctcttgatctcgtgatacacccgcctcggcctcccaaagtgctgggattacaggcgtgagccaccgtgtctggcgaggagtggtattttaagaagtctttcttacaggtaacatttggatggaaactcaaataaatcaaatgaatgactgaaactaaggaataaaagaagagaaattaaatgttgggtgttggagagagagatggcttaaattgtggcctcaccactcactgagcaagttccttaagtggcctgaagctgagcttccatctctgtaaaatgaagggttgacactcacttcacacgagagcgacagtttgagtgccaggtagcatagttttctgggacatagtaagtgctcaataaatggagtctgctgttaacaataatgatagaatgttcataaaacaatatggtgcatctttatgactaatattataacataacaccatatcataatgttatataataacatgttttgttattatatattattaatagcatatattgtcactgtattatatattatatattacaaagatcaattattacatatatgtaatatcatatatcatatattacatgtaacatgtataatatataacatgtatatattaacgtatatgcatttatttattacaaaactttttttcgagacagagtttcgctgttgttgcccaggctggagtgcaacggcacgatctcggctcaccacaacctccgcctcccgggttcaagcgattctcctgcctcagcctcccgagtagctgggattacagcgggattacagacatgcgccaccatgcctggctaattttgtatttttagtagagatggggtttctccatgtcggtcaggctggtctcgaactaccaacttcaggtgatccgcctgtcttggcctcccaaagtgctgggattacaggcataagccaccgtgcccggcctataaatatttaccataataatatataaaatataaaattaatataattgttaggcaacaattccaacaagagccctaggatccaagttcagttcagttgcttaaataagaatttttactactgaggcctccatgctggggagtgggcttgtcgcagagtgggaggccacccactgcctcccagatccctccaggtcagcctgccctgtcacctaccacccagggcttgctgcagaagttgtagacggagtagagagagttgacagcaggcagccctccatactgcaggccgatgaccaggctgcggtagtcttcccccagggccatgctgtaggcatgctggcggaccaggatgaagtctggcttgaaggatctgctgagaaagccaacagcagtgttaccacactgggacattgatgaaacaccagggcatccggccacagcttgctggggatgatagcactgacttgcagggcggcagcttagttcagaagtgggagcaggtgggggatgagggcagttaaatgcaaaggcacagctactccactataaagtcaaagggctggaaacactatatatattctctctctctctctctctctctctctctctctctctcacaggctctttcctaaattccctgcattgaacatctatttcatttgcaaccagaaaaaaatatatcaaagtgaatcaaccgagattctgcaaggtaccacgcactctactgaatgtatgtattatccatggtgaggacaactgccctaggaggtgagggttgtcatcaactcccatttcacaaacgagcaccctgaggctcaggaagactaagtcacttgttcaaaaagatacgctgcagagaggcagcagggccaggtctgtgtagcctcatggctccggctcttgttcctgcagatctcaaatcaaccaacacatcttggttttttttttttttttttttttcaagtagcaacctctggaaagcagcaagagtagggatttgatggccgagcccatgccaggctatttgctaggtccctctagagacaggatcctgatgagtgctcacaaacagacctgggtaaagatctggaccatctccccattttatagatgggaacactgcagcccagggaaattatgaactttccgaatcacaaagctcagaagcaggagagccgcattggaactcaggtcatctggctccaagtccacatgcttttgactccatcacagggccccaggaggattcacacattgtttgattcataccaccaaagatcaaactatttttggattccttatttttaagtaacacaaaaaaatcagcccaggctggggcaatagggagcacttataaccatttgctacttttatctgattttaaaagtaatacacattctttgtgtataaaaaaacaaaaattccttggcatgtacaaagaagtaaacaaaatgctcataattttacaatgcagaggaaactcctaacaacctttgtatatacatttttgatccaatgatcaatttcaatgtatataatatgcattcacattcataattgctccatactttcttttgattttaatgttttccacataataatatagtgtatatatttttctctactaccaaaaatatcttctaaaatataatttttaatttctacacaatagttcactgaatgatatatcataattaagtaaaccaatcatctactattatcatataagctatttccaatatttcatatacaaatcagtgccattattttaaattattttcataagatagatcctaagaagtgggactaatggattaaagggtgtaagctttttgtaagatacccaaaaaaagttccctttttaaggtacatctcacaaattgtttatgagaatgtccatctcattacagcctcaccagcactgcagtttttgaaaaatatttttttcaatttgacaacagaattccccccaaaagacaccctgtatcctgctattgttttagtttgcatttgtctgattctagtgaaattaaatgctttttattaaccatctgcattttctttcctgtaaaagtctgttcacatccttttccattcaaaacaaaatagggtctccagtttcctattgaggtgagttctgtgtattaaggatactgccctttatccatcatgtgtggcaatgtttttactagatgcttgcttgtctgtttctttttaatggatgtgcatcttaaaaaacaacacataaatacattgtccatggccctggttctgacaatgagacatccactcctccctggcagcgtgggttccatcacagacaacagtggcagcaaacgtggtgtcttactaagaataaccccatccttcttcatgaggaaataataaaaggtctcctgctggccagcctcctattttttttccccattgctgggaattcataagagggacatgggaaaaacaaaaaacaccaaacctggctatctaaaaaaagaggatgcccttccaagaccaccttccaagaggagaatcccatggcttgttttgggatccccgactctggctccagatattatggtgctctctctccagggcttccaaaactcacctctaaatcagaacctttctgattcctcaaaataaaagtagcaggaagctcctcattgtctttacggatttggaaatctacctcaagatcccacatgtgaagtgctcttacaaaattatacatcactcccctgcttcaaaccctcaaaaggcgtctctctttctgacaagagatccctagtgccttatcgtggctacaaggtcccaaatgggttgcctgccactccatcctcatttattttatttttttaaattattatttttttagagacagggtctccctctgttgctcaggctggagtgcagtggtgtcatcacactcactgcaccctcaaactcctgggctcaagcgatcctcccacatcagcctcccaagtagctgggactacaggtgcgcaccaccacatccagctaatttttaaatttattttattattattttttattttttgtagagatgagattttgctgttacccaggttggtcttgaacctctgaacttaagtgatcctcctgcctcaggttcccaaagtgttggaattacaggcatgaaccaccctacccagccttccatcctcattttctatctttctcgcctccctcactgccacacaagccacactgaccaccttctcttccttcaattccctagatgctcttctcccacattgcgtgtaggtgcctcgtcctcaaagccaccattctgtctactctatcaaaatttgccccaaccctcgttttgccctattttctttattcatggctctgtgacaattttatttctcctgtttgtttgattagctgcttaactgtctagttctcttttctaaagatgtcagctcaatgggaacagaggacttgactgtcttggacaaaataggcctcaaaactgtttttaaataaatgattgcatgaatgaatgcatatatgaacacatgaataaatgaatgaacatgatgtgaaatggccactggaaaggggagggatcactttccctgcgatcctagagaagaaaactagactgatagacatagtagccaggagacagcaagtagccccttattaccaaggggttgccttacaagctaacaagtaacaccacgaagaaattcataaccccagggaattcaaggtggccaccatgacctcttaagagtctcagatctaatatgtgaaaaataagcacttcctatgcacaatatatcaggccaaaccaggcatgtgttatagagtgaattctgccattcactgctacagaaggcatagagtccttcttgaaagtctagggtatgatggatatgcaatgactatagagaaattactgacttaagctgggcaacctgtggcattcagttcctccctctgtacccagcaccccaggttctccatctggccagggggtggccaagtcctgcagtcaccccaacatttaaggttgtgacctccagtagttaccgagcctcgacagtgggccaagcactctggcaaaggttggagatcccaagatgacagggatgattcctgcttttaagaaactcacaacccaagaggagttgggtgcaacgtgccctaagcactttttttttttttttttttttgagagacagagtctggctctattgtccatattgtccaggctggtgtgcaatggtgtgatcttggctcactgcaatctccacctcccaggttcaggcagttctcctgtctcagcctcccaagtagctgggattacaggcacgtgcccctgcacccggctaatttttgtatttttagtagaggcaaggttttgccattttggacaggctagtttcaaactcctgacctcaggtgatctgcccaccttggcctcccaaagtgccgggattacagacgtgagccaccgtgcccggccagcatttgttaaattaacaaaggagggagtgagtgggtgagtgagtgagtgaaataattgaggcatgtacaagggcataaggtggtccaaaggatggattcaactctgttaagggatgagtgtgagcaagtgtgtgctggaagccttggtcttaaaagctgaggttgtcaagtgggttgggtttggagagtattccaggcagggggaaggcacctgcgactgaatgaatgtgccctcgttgttgggggtgtagtggactgtgctggttttatctgctctgtacccagaactcctcctttttctagaaacagagcccatgcggaaatcctctctgatcagagaaccacattttcctgggctgtaactggtctaaggacggaacacctgatgtaaaatgggcctgtgagaaaattctcgggtgtgttgtatctgagctctgaaagacaggagtggccagctacactgaagtaatataagctgggctgatgggagaccattttcctgttacatgaagaaatcccatttgtagcagaagtaccagctgggaaaagagataaggagggaggcaagacacctgtcaacattagatgagtcggccaaatgcagtggctcatgcttgtaatcccagcattttgggaggccaaggtgggcggatcacttaaggccaggagttcaagaccagcctggccaacgtggcaaaaccccatctctacaaaaaatacaaaaaaaaaaaattagctgggcatagtggcacacacctgtaatcccagctacttggaaggctagggcacaagaattgcttgaaccagggaggcagaggttgcagtgagccgagatcgtgtcactgccctactgcctggatgacagaacaagaatctgtctcaaaaaagaaaaagaaagtaaaaagaaaaatcccccaaccttttaagccccttccttctcttcctgccgtagagccccactgagcccaagacctgggtctctcgtgcctgggtaaggtctcctttaatctcacacaaactggcacgtcctggccgcaggttgtagctgggttttcttgttatttcacctttaaccgtaatatgagctataatatttgggctcctgatcccaagtctttctcagaagtggctgttggcacttgagaggaaatcaaggacaagaaataattaacggtaaagatgggacaggtgacgtgtcacagggggattactgaatgcttctggcagcgtcaaaaagctggaggccagaggtgaagtgactcttaaccattggagaagtgtaataattctctcaaatatgcagaggtctgtggtggcaagaacagctcttggctggactttgcctgggacctaagttaatcagcagaagcctcattattctcagtcacttgaccactatttcataactgtcccctggtccccaagagccaggttggcaaagggtgatgttcatgctgattttgttcacatgctgagacccatcacacccagagctgattccagccaggcctgcgaaggctccagactttctgacgtccatgtcaacgggcaaagagacttcacgttttctcttaattgtctccacactcttcataacactccaccttggaaaattcaaccttgggtatcaaatctgggggaaggggacaaagggaaccgagtaaaccagcaaatggggagggggaattcaaaacattgaaacaagctccatgctcctgcagacttagggtaccactattctgcaaggataaagccaaggaaatgtgcacgctttgcagatggaggggtttgaatcgcccatatggaaggactttgggaattagtgatgcttcccgccagcccgaggactgcaagaaattagcccaggccaaaaagaaattaggtggcagccaaccaagaatctggtgaggagcagacaacaggatgcaggagggaggcctgtggggcccccatggcagctgccagatgcacaccggtggagaaggggcccggtggggtttacagacagcccggctctctgttgaatccgagggccctctttgtaaagtgctaggaggttaataaaacacagacacgagttgctggaggaaggaagcttccttgtctcgtttcagcctcacaatcctggtatctttattccggtctcttccttcctgaatctctgtccttgctctatcctcttcctcctggtcaccctgggaaccccacatgttatgggttgaactgttgcccccaggaagatatgtcgaggtcctaagcactggtacctgtgactgtgaccttatttggaaaatagggcctttgcaaatataatcaagttaagatgaggtcacactggaggagagtgaaccctaacccaatgactgatgtctttaggagaagagggaaattcggaaacagacacacacaggggaagagaatgccatgtgatgagggagtcagagattggagtgatgtgtctataatacagggaatttcaaggattgctggtgaccttcaggaactagagagtggcaaggaaggatcctcccctggagccttcagaaggagcatggcataggagtcttgatttcagacgtctggtccccagaatgatgggagaatgaatttctgttatttaagccacccaacctgtggtgctttgttatagcagcctcaggaaactaacacactgcacgtgcccactattcccttttccagtatctttcaggacttgctggcttcctttgttctggcgtacacccatgcatggccccattccccacttcctaaaacaacaaccctgacttagtctgtttgggctgctagaacaaaatactatagactgggtgacttataaacaacagaaattcatttctcacattctggaggctgggaagtccaatatcgaggcaccatcacatttggtctctgctgaggcccccttcctagctcctcactgtgtccttacatggcagaaggggcaaggcagctctctggggtcccttttcaaggccacaaatcccattcattagggctgatgacttcatgacttaatcacctcctaatggccccacctcctaatcgcattgggcgttaggattcaacataaattttggggggacacacatattcagaccatagcaaaccccaacaataaaaaaccttcactttaaggttccaaatggactggcagttaaatcatgttcatatttacataaaagaaggagtaagtcaacaaattgataaacgcgtggagatttgttcggatggatgttcaccaaaatgctggccttaaagagtgagatgggaaatgggaactattacattcttcttcatactttttggtactgcctgcattgttaaaaaaaaaaaaaaagagcacagagcatttttacaatcaggaaaaaaacaatgaggttatcttcattctggaaaaaaatggaaaatgaaacagtggagtcacatcatggaaaatgcttatggtacaatttcatgtgacataaaacaatagaatagaggacctgttttatgactaaagcactgtaaaaatgacaggcctggaaggagagatgaaaaccactcatttgttaaggtagtcaggtggcaggtgatttctcttcttttgaaaatttccattttcattatatcgcagtttgtgcatttactaaaactttcggttggtacacatgcataaatagatagataaataagtagatagatgatagataaatagacggtaggtagatagatagatagatatgagaaataagtcccctgtacttggccttgcagccataactagtcattccccttcctctgtccattgctatgcctgatggacaaggcagtctgtgccctctggccccaattccaatgtgccctctgctcctggctgttagtccctttccaccccaatacaattgctccgaggtcacttctaagtgtgaagcccccagatcagatggcttcttctgtgtccttaccttacccaatttctaattataactaaaacacaatgaggctctagtaaaataccatgagacttcaggccctctgtataacttcactcatttaaacctaacaaggaaaacctaccatgaatccgaggcacagagcagctaaggaactcaccaaggtcacgcagctattggtgatggaaccatgagtcaagcttcacagcctgttggctctagaatagggtttcccaacctcagcactgtggacattttcaggctggataattctctgttgtggggggctgttctgtgccttgtaggatattaggagcatctctggcctctacccactagacgcagcagcactcccatgcccagttgtgacaacaagcaatgtctcccaccattgccaagtgtcccctgggtggaaatgcaccctgctagagaagccctgctgcagggctcctcttgtcctctgtggcttctgtggcatgatcactgtcccccttctccgcaaaccctttccaccttgcctcgaagacaccctccgcccttgcttcccaactcccagctccttcactgttttctccctaactacagctcttctccaagagaagagctcctccaaggctcaatctttggttctctgcttcatggaatcatctccattcagggacttcccttaccttgtcctcataggcaataatgaaagtgattcagatttatagagcacttccttggtgccaggaataatttttaggattttacttatgttatctttatcctcatgataactctacaaggtagatacgataataatagctttatttttcaagaaacaaaggcatagagagatgaagcacagccaagaaggtgtccacctgggactggagtgcaggtctttgggcttcgaagtccgtgtgcacaatcaccgtgcaaccagaaccttccaccaccctgaacctctcatcatcacctccaactcaatgtgactggaccccaagtcatcagcttcccccaaagtggatctgaggacttctgttaaaggtctgtcgtgctcccaggaactgggcgtatgtcaccctgaagtcatgtgcagttcttctccctgacattccttaagtatggagccaccagagctgctaagtcttccctccagaagtgtctaggattggtccctacactctccactcctcatttccactctggttttctcctccaatgcctcatgcttgagacaccttaacagaccttcagcttctaaatcctcaacacaagtccttcatcttattcctctctgtagccccagcctagtccagggtccatacttctgagtgttgagtgttatgtgatttccctgccactaccccagggggccaagcaggtaccaccatggttgagtgaggtgggcctcttcggttttctcttctcacacacactctctgttttcatataaagcacataagaatatccttcatttccacaatgctctcttcaaccttttttggaagcaggcatgtcctttcacatatctttcattttgtcactcaatagtatgaagtatatttcacttttctgtaggagggcacaaccactaagacaaagggcagctaatggaagcctctgtggaggatgaggagggagaaaccaggagtgaggaataagcaaatggggcccagtctaaggtctaagccattatggccatgtgggaatgagggtcctgcatggcccttgtgacttttcaaaagatacctaaatctgggtatttatgtgaaattctcaattacttaaatgttgacaatgcacttaaaaaatttttgaaaatcactatactgactggttaaaaaaaataaaggtaaccaacacacacacagacacacacatacacacacacacacactttgaaaacagtctttgaaaacagtaaagtgttctgcaatctctaagtgtctagaaactctgcagctgcagtctctttaagatctgcctgagcatcacatacccttaaacagattttctacccagggaggtaaagtttcatggatctgccaagacacggactgattaattaattattccatttatttaacaaaaatgtattgagcactaatatgtgccaggcacatttatagatcctggagagacagacttggagttgctacagcaaaatgccataaactgagtggcttaaaaacaacaaaaatttatttctcacatttctggaggctaagaagtccaggaccaaggcatcagctgatgtgatgctggggaggtgggggacctgctttctggtttgtagatggcacattctcattgcgtcctcacatagtcgaagggggaagggagctctctcggggcctcttacttataagggcattaatcccatccatgaaaactctgccctcatggctaatcacttcccaaagacttcatctcctaataccatcacattgaaggttaggatttcaacatttgaactctgaggaacacaggcattcagaccacagcagtaaggataggaatatacttttgtgaccccttccctgagtacctagccggtgttaagcacatagtaggtactcaagggatccacatggaaatggcttctcttctcagagtcctggtccatataaagtcaacaacccttttaaaaaaataactgaaaacagaggatcagaaagtggttaaaataatgaggagtggtgggaaaaatcaagacatcttctagtcccagctctgctcttgtgtctttgagattgttgcttctcctctctcagcttcaggttcccgattggtcaaaggagagttgggctatgtgacccctgggggaccttcctgggatgattgtctcccatgccagaacttgaagccaaggtttttgactcccacctcccactgtagctgtgcatctgagctcccctgttacattctgtcaggtgttactggtttgtaagaatcacgattactcattattgggtacttgctgagtgccagatgcttgcaaaaggcatttcaacatgatctcatagcatcctcaccccaaacccctgtaaagtagctacttctcttgggctgggttccctagaagtggaggctaaagtagggatttgcaagccagtgactcatggagggagtcctcttcaggaaaactgtgaggggtgacggtggtagctcaaggaaggggaagaagccaaggagggatattgtcttagagaagctctggccttggcctggtctacaggggggctctggggcaaaaacagtgccatggagttgtcccactttgaggaaagagcgctgggcttctgtatccccaagagcaatcagtcactgaccccctggtgggtggtggtggagagggtttaccctctcagccgtctcagggatgcagttaccatcagcccaagaaatggagaaggccacgggtacagcattaccatgacacctggagccgctgggggcactggctggcaaagaggatgtgagcagagaactgaccagcatttacactccactattactagcccattttgcagatgaggataactgaaacctggagtagttaatatgttcctaagaactactaaatacagaggtctgaactgttaggtacaagttgcgcgtctcgtaaacagccctcgccactgaaggacagggcccatgtctgaaatgcctgtttccccagcacccagcatggcaattgcacccaggggctgctgagatgtgcttggaaaggctgagtttgtgagctgcagctcgccagggcaatggggcctcaagtggcatgtcgccgggaggcagaggggttagccctcacccacgtggtggcctggggcagccctgctctccgacagctgcctgagctccagcgctgtcagcagcctgctcagcgctggggcgggcctcctgccaggctgctgctcggggaaggggaacattattcatcggagagataaggcagctgatgagagatgggcctcagagcagctgttcctcggcagcggctggaacggatgctggggcagtggagtggaggagagaggagtgggggaaggggaaagcccattttgagatgaaaaatgatggtactgccgaggggtgatgggagagcacatttcaaacccaggccaggcgctaatatgtacttatacccaaggccttccccacacatatctctgtctgacaggccacatctgtgctctgtcgggttaactattgaactagtcagagggctcacttatcagctcgctcagcaggaaatatctgcctggtagggcaccccctcccaagctgcttcctcagtgcaagactgagaagctgggcccaaaagatgctaaacgctcctgcctgggccacagccctaaatcacccatctccgcccccagagcacccaggtggcgctgatctcaggtggcccagccacttctcgctggttccctaggttctccatcttccctcaaagctagctgacacaggatggaattttccaggttgaggggcaagagtgggtgagctttctttattttatccattgtttgatagttgtttttttttaaaggaaagatgtgaaaaaggaaccttgaggccgggcacagtggctcacgcctgtaatcccagcattttgggaggccgagtagggcagatcacctgaggtcaggagttcgagaccagcctggccaatatggtgaaaccccgtctctactaaaaatacaaaaattagctgggcatggtggcatgtgcctgtagtcccagctattcggagactgaggcaggggaatcacttgaacctaagaggcagaggctgcagtgagccgagatcatgccactgcactccagcctggcgacagagcgagactctgtctcaaaaaaaaaaaaaaaggaacctcgagggtttcctgggagacaggggagggcaggatgtgacgtctgtctgtgacgggacctgggctgtcaggtgaaacgcctgatggtcttccctgacaagctgcggctgcctctccagcctcctcccctgcccatcggtcaggtcatcttcctttctgaccacatcagagggtttcctcagaagccagggccttccctgtccctatgttctaacatggactttcccactctgaccgcctggctaacattttgtctgtcatcagtgcagggaagggtgtagacaggagtccttaaaagtacctatggtattatatttcttttcattaaaaaaaatctaaaacaaattcggctaaatgttaagatttgacaaactcagttgtgaacataagggaaacaacagttagcatttaagagtgctgggaacttgtatttttcagagtattaccttaattgatcctgacagttgccctttgaagtgtgtgtttaaacgagacagaggcacagagaggacaagcagcctctccaatgtcacacggcagatgcaagtagcctggctccagagcgggtgtcttaaccaccttagtttatgagtgtttgctaaattattctctgtactttttctagccttaaaatagttcagaattttttttttttttaggatctgaagcaaacatggcaaaatgttaatatttgtcaaagtagtgtgttcaactatctatgtgtaagattattccgaactttgcaatatgtatatgaatatttaaaaagaaaacaataaaaaagcctcagcgctattaccacttctcctcagaaggcttctgaagtccccccgccccccaaccagctcctctaagcccttgcttctctgaactattctccaccaggccctgactgtgtcacatcctagcagttgatttacttcccatttccccctccaggctgtgaactccaccagcgagtggtgatgttgaatttatatctgaatttccagggtctggccaattgcaaggaatctagaagctcaataaaattatgaaactaaagggagctatttagggggcccccatgggtgagtattgagcagctacataaagaggctgcagagggtgcagggaacaaatgtggaccctgccctccctgctggagacatatggcagtaatttttaggaccataacccagtaagggcttccagcataaatgcttccagctgcaccctccactgtggacaggaaactgggaacctcttaagacaggatcttgatggcttccagctcagtcggatgcccatcaaaagaagcagagggtaggagcagctttctagaaagccctctgggttttacccactgtgtctggggctgtgtgtgtttactggtttggcagctgtcagatcaaccctcctcattctagtttagtggctcgccaatcttggctgtacattggaatcacccaaggagctctcaaaactagttcttcctcctcttctctgcccctagatattctgatagaattgacctgaagtgcccacctgggtttggagatttttagaagctttctaagtaattggaatgtgcagccaaggctgagaactcctgttaggttctcttttttaaaaaaagatagctgctaccaggtgaactgtgatgatatctccattcagtgcacatttactgagcatctattatgtgaaatgcaccaaggaaggaaagggtttgagattcctgtcctatggcgtagctaagtttgatgaggggaataagttggcaagttttggtgtgtacagatccaacagccggcctcagagtggtagtagaatcttggtatctcctaagcccacatcagacatcactgattacagtataatttcctgctgagtccatagtggtggccaatcaatggctgctggacaagaaagcaaggtggtaacaacacttaggtatgtttcctcaagttctagctgggacttattctttcccctgctaggtgggacttcatatactcataccagccaagaaacacgtcagcatgcagctaccatgtaaaacaaagtctggccgaacctgggaaacgtttctaagctaacacatttcccaacaaatacacacctaacaaatttctaaaactgctggagcatgaactaccctttgagaactactggttaaggccaacactggctaagcacacaagagctcatttaattcttccaatagccccaggggtcaattgattgcatgtttagagcacagactttgggttcaagccccagttctaccactaaacaactgtgggatcccaggaacactagttaacagttccatgcctcagtttacccatctttcaaaaagagaatggtaacaataacatgtacttcagagtgttgctaagaggatcacataagccaatccacataaagaattgaggcaataaacttcagatgtttttctatgaccttggatttcaaagtctcctgtatactgttctaacttgtttttcttcaaagtagcatatcttcaaaatcatttcgtggccgggtgcggtggctcactcctgtaacccccagaactttggtaggccaaggcgggcggatcacgaggtcaggagacagaccatcctggccaacatggtgaaatcctgtctttactaaaaatacaaaaattagctgggtgtggtggcacgtgcctgtaatttcagctactcaagaggctgaggcaggagaatagcttgaaccagggagtcggaagttgcagtgagccaagatcacgccactgcactccagcctggcgacagagcgagactgtctcaaaaaaaagaaaagaaaagaaaatcatttcatatcagtacaaatggagatgcttctttatttataattgtatctcattatgtggctcgaccgtaatttatttaaccagttccctacagatggacagttaggttgtttctaagctttagctattaacaaacacttccgagaatgaaactaatcttaacacttacatagtgtataatttcaattgcctgccactaattttgaatggaatgtcatgtataaaagcattcataagaattttatgcaccatggagttgggtgcaaaaaaaaaaaagacttttgacagtatctgcttatatcttctgaatatgaagatgattttggctgcaaataacagtgatgactaaatcaataaagaaaatgcatgagctcatatcactgagctagggcaatcacagggccgagtaaatcagaggctcaatgtcagactcaaggatctaaatgttttgtgtccttctgactcttgttctcaaggatggacttttgttctcatactgttccttcacgttatcagtgagccaccctggtgccccgggccataccctcatgcctatgaaaaagagtctctttcttgtgtcgcttttaagaagcatggtggatgttccagaatcctcccggcaggtacatctcaggcctccctggtcagaactgcatcatcttccctttcctttttttttttgagatagagtctcgctctgttgcccaggctggaatgcagtggcacgatctcagctcaccacaatctccacctcctgggttcaatcgattctcctgcctcagcctcccgagtagctgggactacaggcgcccaccaccatgcccagctaatttttgtattcttagtagagatggggtttcaccatgttggctgggctggtctggaactcctgacttaaggtgatccgcccacctctgcctcccaaagtgctgggattacaggcatgagccactgcaccaggcccatattcccttttctaaacacctttcccagtgggaacagaatgaccacagctggctgaaacgaaccaggattcacctcatggcaccagaaaggggcctatgtttccttgaagcacatggccaccaaacagctgaataaactcaggatttggcaagcatgaaagaaggcgggcaaccaacagtagacagcacaccttccgaaacctttattttcatggacagccatatgttgttcttgtaaagaactggctcataagcttgtgtgttttaaagaacaatattgctaagtgtgtttacaatgacacacatgggtaaattttaaaaatgcaatagtaactcttaaaatctgctacaagactttaatgaggtctggcaaccccttgacctggaatcagaacacataagcttgagaactcagtcacttctgcgaggtcgtgagaatgtttctctagctctccaagccttgcgtttctccctgtgaaaatggcagcttcgaggagaattaggggtcatgcataaaggaaaagagaaggggctttgcagttagacctggcttaggatcccggctcccccagctgtgcgactctggacacgttttgagcttcagtttcctcatcggtaaaaaggggataaaaatgtgcaattcatagagccatttaaaaatatatactttataaaggcatgatttgcataaaataaaatgcacccatttgaaacgtagtttgatttgcttcgacatatgtaacactaatataatcatcatgccaaataaaagatatactttcatcaccttcacaggtgacttgtgtccctctactgtcaatcccctgccccttattcccttggccctgggcaaccactgatgtttcagtgactatggattagttttgcctgttctagaatttcatgtcagtggaatcatgaaatgtgtactcttttgtctctagtctttttttcctcaacataatggctttgagatttgtctgcatagttacgtgctgccaagtatggactggaaggcagcccgcaggaccctgcctctcatgttcaagcccttacatgcttctcccccggagggggtgggatctgtgactggtttgctgaatacggcaaaggagatgggttggcaccccatgataatgctacgtcagataagtctcagtcttgctcccagatgtattcttgttctcccttgctttgaagtaacaagctgccatgttatagaaagacccatggaaaggcccacatgactcatgcttgtaatcccagtactttgggaggtcaaggtgggaggatcgcttgagttcaggagttcaagaccagcctgggcaacatagtgagacctcatctctaccaaaaataaacaatattatccgggcatggtgatgcacatctgtagtcccagctacttgggaggctgaggtgggaggatcacttgagcccaagagtttgaggctgctgcaagctatgatcactccactgcacttcagcctaggcaacagcgagaccgtgtctcagaaaagaaaaaaaaaaaagaactgtgtgcaacttcccgctgataaccagcaagaagccaaggcccttaatctcacagtcacaagaaaaatgacttgtgccaacaacccaagcgagcttggaagtggttccattgccagttgagcttccagataagaactgagccccagatgacaatcttgatgtcagtcttacagaagactcagctaagccatgcccagcccctggcccccacaaactgtgagataataaatatgtgttgtttgaagctgataagtttgtagacaactaatatacatctcttagtagtttgttcccttttatccccaagaagcattcccttatgtgcatgtaccacattttgtttattgttcacgagttgacaggcatttgggttgtctccagattggggctatgatgaataaagttgctatgaagattcttataaaagtcatttagataacatatttcatttttcttggggaaaggtctagaggagaatggttggctcatacggtgcctatatatttaactttataaggaactgccaaactattttccaaagaggctgcaccacgtcacatccccaccagcaatgtaggaaagttagttattccacagcctcaacgacagtttgtactgtcagtctttttaattcaatacctcattatagtttttatttttatttccctgatgattaatgatgtttaatatcatttcacatgcttgttggctatttttggatatctgcttctgtcgagtggctatttgagtctcaagatattaccatccctagggatgttttaggaaagcatatgtatgtaacatgactggcatttagtagacactaaataagatataactattattctagatgttattatttttaaggtcacttagagataaagttatatgattccataaagggcccacacagtatgctttaagaatctgttctaactcatgttctcttggggaaaagtctagcaggggaatgattggatcatatagtgcctatatatgtaactttataagaaactgccaaactattttccaaaggggctgtaccacgttacatccccaacagcaatgtaggagggttacagttactctacagcctcgctgacagattcgactgtcagtctttttaatttgacatctcattataatttgtattttcattttcctgatgatcagtgatgtttaacagaggagaaggagaaggaagaaaaaggttaaataacagaggaggtgaagcaggaatgcaagacgcccccaggatttgagatggaagacttcatgggcaggaggtacaggtcatgcatctcaaatctgaaaacctgaaatctgaaatgctccaaaattcaaaacttttggagcactgacatgacactcaatggaaatggtcactggagcattctggatttttttcattagggttgctcaactgctaaggataatgcaaatattccaaaatctgaaatcaaaaacccttctggtctcaagcatttcagatgagggatacttgatctctattgcccagtttaagggatgatgagttctgccttagccacattgaggttgaagggaaagctggccctctaatcggtctcatcactgggcctcaaagtagggtgagtgctgaggagcccaactttgccagacatggcatcccaaaggtgccaaacacctctatttaaagcagcagagatctcaagcattttgttacaatctgaagtctattagtgcctgtgtcagccctgcagtcactggggtggaggccgcaggacagagctaaacatgtgcaaaaggagtgtagggatcttggaataactctctatcaggaaggctaaaattagctcatctccctcctcaccactcctcttgccccaactataattactcacctttgcccccagctccattcctgggttctaaacactcttgcttcaggggggctttggaagggtttgctttctaaagcttccggaatggggtaagggtagaatgagcttctcagggcccaagttttcctccacaaggaaaaaaaaaaaacaaaaaaccttttataggaatttttctgttaataaatgtgacatgtgcttatttaaagaaaataaaatcaaatagcacagcaaggtataaagaagaggataaacgcagtagtcccaggatgtaaagataatgtttacacgtcaatgtgttccctctcatattttcagtatgtaaacaaatcaacgcatatatttgtaaataaaatagaattatacatatatgccattctgtaatctttttaaaactgactgtatccagggatctttgcatgccaaaatataaacttttagatctttttattgagtatctagtatttcacagttgttgggcatttagattttaaaaaatatattacaaagacttctggggaaaatgcctttatatctttttggattttcctaactttttatcaaaagtcattagtagggaatttacttactgaatcaaaggctttgaatgtataaaggtatgttgttctctcagaatatttgtattaatttccatgtttatcaatactttactagatggccagtttcacctactctgagcaacattaaattgatctttaatttttttttatcctaaaaaaaaatttcgtggtttcctccatttgttcttgggtaattattgagatttagctgctttttttttttttttttttttttgagacagggttattactctgttgccaaagctggagtacagtggaaaaaatatagctcactacagactcaaccttccaggctcaagcaatcctctcacctcggcctcccaagcagctgggactacaggtgtgtgctacctttcctggctaatttgtgtatcttttatagagcattttcccatgctgcccaggctggtctcaaactcctgggctcaagcagtcctcccaccatagcctccccaaatgctggggttacaggtttgagccactgtgcctggcctgatttagcaccttttttttatttgagacagagtctcgctctgtcaccaaggctggagtgcagtggcatgatcttggctcattgcaagctccgcctcccgggttcacaccattctcctgcctcagcctcccaagtagctgggactacaggcgcatgccaccacgcctggctaagtttttgtatttttagtagagacagggtttcaccgtgttagccaggatggtcttgatctcctgacctcgtgatctgcccgcctcggcctcccaaagtgctgggattacaggtgtgagccaccgcgcccggccgatttagcacatttttaacctgttttttcacacgccacttcttcttttgggcaagttgcctgtttatatctactgcttatttttagattagaatatccatcttcattgatttataataactatatatatagagagagagagagcttcccttgtgtctcctgggatggatgctcatttggctggcactgcacctccctactagcgtgtcctcttggactgcaaaggatgcaatggtaaaaacttcatttcctagacccccttgcagctgggagcctaacaataccagattcagccaactggaagcacttgctggactctgggaggcagaactgagaccacaatcacctcccacctctttggctgttccctgcatgcagacaagttcctgaagacctaactgcatgggattgtgatttctgtccagggccctgctccagtttcttaggtaccaacgaggagctgaggtggcagcagcttccagactttgctttctgaatcccagctatggcagagggctcttgaattgacacgttggccatctgggggggtcaattttgcagggctcagaagcttcctggaggccacttctccagtccttttgatgacattctcgaaacctaaagccacgtcttaagcacctttctgcataaaatccctacaacactttctgttgcttgtgctgagccctgatggatttttctgatacttcccatggcttctgaatcctgtcacttctttgtactttcccaggtcttcccacatcccactccagccactgagtgattccctcttctctgtaaggaggtctgaagagcgctcagcattctctgaggatttatagaattcttcacatccagatttctttgcaaatgataatagtggaaaccaatgagcttgccatccgacttcggttcatatcctggaccagccattcctgcttaagcaaggtgcttaaactgtgcctcagtttgcttatctgtaaaaattacaccatagcgatggcaatgcctaatatacggacctgttttcagggccacgcacaccaaggcaggcagcaggtgctcaatacatacttccgtataactcattcagcccccttttcctgtcttaatgtgactctaagaaagctactaagccctctgagcctcagcttccttccttaatactaggaaccttaataccttcctcacagaactgctgtgaggaccagaggaaatcagacaattggaagtaaattccaggtctatataaaaggtattatttggagaccaggtattgtttcaagattcctttttagctaataataataataataataataataataaaaagctggctgggcgcatagctcatacctgtaatcctagcactttgggagaccgaggcgggcggatcatgaggtcaggagttcaaaaccagcctggccagaatggtgaaaccccatctctaataaaataatacaaaaaattagccaggcatggtggcacacgcctgtaatcccagctactcaggtggctgaggcaggagaagtgcttgaacccgggaggctgaggttgcagtgagctgagatcacgccactgcactccagcctgagcaacagagtgagactccatctcaaaaaataaaaataaaaaataaaaaagccaccctgtgcacagtcattgtcttattcaacaaatacacgctctgcacctattctaggcagtgtgctgggagctgaggatacagaggttaatgggatagacgtgatccttggttttgtaggatagtgtgggaacagacaaaacccaaaacctatgtaaacacatacatgctattacaaattgtgatgagtgctgtgaaggaaacgagactctaagtagtaaaaaccagacactggtaccagcatgggagagagagatgtatttctgatccttgaaagtatagtattggagagatctattttaaagaggtgatctaggaattcaattctgctaggtggacatataaactggataccacagccacccacagccccagaatcacctcccacccatctcccatctccagtcttctgctgtaggtcttagcaagggagaggatgaagagttctttgtccctgggttatcagggaggctgcatgaatgccagtttgctgaagcctggagattatctgggggaagctacctatttctggggtaggctaggtgaatgagtgaattgtaaaaacttagagaagtgaatttaagggaaaaagagaggagaagcttagagaatatgagaatcaggaccataaagagaagcttgggagaagaagaaaccaggaaatgcccaagaattctgatagtctggaatctatttctggaccctataaaattaaaaagatgggccctgcttcctctggaggcaacatggtagaatagaaagaatctgaatcagggtcagcttgcctgggttctagtctcgctctcacttttatgaccaggggcccaacactctgacccttcttcatctgcacttcctccatttgcgtatgagaataatcaatgtttgctctgcccccctcccaggacttatccattcactccattcctcaactatacattgggattaattggatacctggcactgccgtaggcactgggctgtggagatgcatgagacacattctttgctgtcacggagctcatggagccctggaagagactcacatagacagagacattgccaacatggtaaggaaaatggtgaggacaccacaggaacagagaaaggagcctttgtcagttgacacagtaacaggggcccaggatattgtctcctgcaggagtcaacccttcagtagagtcttaaaaatcagtagagtttggcagtaagtggagattaggaattaaggaactccaataagagaacacttgcataagcactttgtagctgagtgactgtccacgtgtggggaaggagcattttcactccagagtctggtaagacctgagcaaacccaactggtccacacctccacatgctgtatatgctattcctttggaatagaatgccctcctctattttgtctgcttggaaaatacccactcatccttccagttggcttcaatatccccttcttcgcaaagaaagccttctttgaacatggcagtgagctggcctgtcccttgctgggcttcactgtatcacatacattcctctctcatggccctcagtccttcaacagtgcacatttgtttcacaacttggttttccaccaagctgtgagctcatcaagagcacagatgatggtaccttctttcttgcaatgttatcacagcctatactatgacaatcagacagtggacactcaataagcattggtccaactggatcgagtcttgttctagggtagacaagatcctgggaccctgttactggcctacttgtgtgtcatttatcctctgaaagtcttcaccttgtaatacttatgtcttctacgcaataaactgagagcaagggcctggtgaatcactgctaagaaacagaaattggagaactgtggagtaaaggcttcagtcaccaaattgtagcctagagaataaaatgtccttctcttttacatattatagaagaagaaaacagtcaagggtcctaattctgttcctactactgattctgtgactttgcacaggctgctctgataaatgctgtgggttggctaacccaacaactacaaccttcctctcttttgtctctttctattgcagagggtggaaatccagatattcaatcttgccaggctcccttgtagctagtgctagtgacacgtgacccaattctggtcaatgaggccaacacagaaatctgctaaggacttctggcaaagtgtcttaaaggaggaggcctgagaggagaagagccaccaggcacgaccccgtcatcctgacctgacattgacatgatgcctccacctgtggcagtcaagttgggacagcaagatggttcatcttatgtgtcaacttgactgggctacaggtgtttaaacatctgattaaacgttattctgggtatgactgtaagggtgtttctggatgagatttgcatttggatctatagactgagtaacacaggttgcctgagccattgtgggtgggcttcatcagatctgctggaggcctgcatagaataaaaagctgagtaagggagaattcgctctccctgcctgcctgttgaagtaggagttgtgagtaggaggataatgccaatatttcaggtttctagaaatgtaaatgatccatagtataaacctccaccaacatgtaagaagaggcagatgaaaaatattgaagcatcgttagcatgaaaatagcggaccattcagccgtagtttacatctcagctgatatgagtgactgaagagaaggcagttgaagtgtctgatgtgtagtgcatggctaagaataatcctgtaatgatctgaaggattaggcaggcaccaaggagtgagccgaagtttcatcatatggaaatgttagatagtgtgggaaatcagtgaatgagtaattaataatttttattagcaggtgtgttgaaaactaggacatcagtctcctcctgactctggacttagactgggactcacaccattggctctcctgggtcaccagcttgccaacagcagatcctggaattctcagattccataatccagtgagccaattccttatagtaaatctgtagctatacttgcatgtacatctatctatctatttatctatcatctactattggttctgtttctctgaagaactcagactaatacagacagtatagtattgagcatgataacaaaatgccaataatctaagaatgacaggaaagaatggcaaagagtgacctgatccttgacagcaaacctctcattgcaccaaatctggaaacacctagactcttgctatgtgagaaaaagaaatgtctttattgcctatgcctctacatgtcaggttttctgttacttgcagctaaaagcattcctgacgcatgcaattatctcccatctctaagccttatttctcgggttacacaatggccttaaatgaaaccgacaaacatttccaagtgtctcttagatgcacggctctgagtgaggggttcaaagggagccagcagagtagagcttaagagtaggaactctggggctaggctgctcggcttagaagcccaggttcaccaacccagcctgttatttaacctctctgtgtataagaagggtcatactagtactattaatattaatagggttgttgggaagattgaattagttaatccacgtaaggcccttagaatagtgctcagcacatagaaaaatgctcaataaatgctaattatagctaagaactagacataggtcaagccttctgggagtttagagtctagctttcaagtcaagaaatatacacacacatataaatatgatattgaaactataaagatatacatgtataattgaaaacagaatcatttaacttcttaaattctaaagtaaacttagcctgtaatcccagcactttgggatgctgggtgggaggatcacatgaggtcagcagttcgagagcagcctggccaacatggtgaaaccccgactctactgaaaaaatacaaaaattagctgggcatggtggcatgcgctgtagtcccagctactcgggaggctgaggcaggagaatcacttgaacccaggtggcagaggctgcagtgagttgaggttgcgccactgcactccagcctgggcaacagagtaagactctgtctcaaaatataaaaataaataaggtaaacttagcagctcattatcataagacataaaggctaaaaacttaactgcctccagagaagacttagataaataggcagatgataaaactataataatatgttagtcaaagaaagtaggcattttgaggctagcctcagaatttgaaattaattagaaccaaataaaataggaaaagataacatttcatagtgttttatagcttttaaagcattttcatgaaatctaacaactttgtgaagaaagggtaaacgtgaaattttttccatatgtgatctcattttggctgtcaccttgttcgaagatgtgtgtaattctccttttacagttgaaaggccatgggcttatggtgaggcttacctgagatgatacaagtgaacacagtctctaacttttcttaaacaactccaaaaaatgcaagacattcaccaagtggtggcttagaagtcacgtattccccagtgatgtttggtaacctatgcccctgtccccaccctggtctccagaaaaggactttaacctacgtctctctctctgaggccttgagctgcaggaactcttacatagaggactctttctggctccctttgagtctctaaagttaccgtcccctggggccaagtaggttgtgaaggacctgctcctgactccaccccagccacctgccctaccgctgagcacctgaggcctctctagaatgtgagtacctggacccggcgcccatgggtgtaagataagagtgccggcagacctgttgttttcttctaggaagtctcagattctggaagcatgactctctctctaatctcctgagagctaaggcccacacttagggagccccacacatccaaggaggtgctttaagagctgggctgctctcttggatgctgcgtgcagctcatccctgcctgggaactgggtccttgccttcctgaagcagattctcagtcatgacaatcactgttacacacagagggggttcccaggatgcccaatgggcaggcactgtaaatctgcttccccgccggcctcccatcctgcagagaaggcagccgtggagtcagacctggattcagagggttaagaacacagggtctatagctagatgatctaggttcagatcctgactcagccacttcttagctttatcacctcaggcaagttactttcatggtctgtgactcagattccttgtggaaaatgaagatcataatagcgcttacctcacagagttgttaagaggatttaagtgagttaaagaaaaaaatgcctggcatgtagtgagcgcatgatgaattttagctattttatttgttttgtgatttttgagcaagtctttttatatatatttttttattttagggacagggtcttgctgtgttacccaggctggagtgcagtggtgcgatcacagcttgctgcagccttgaactcctgggctcaagtgatcctcccacctcagcctcccaagtagctaggactacaggcatgggccaccacactcagctattgttttttgtttgtttgtttgtttttgagacagagtttcgctcttgttgcccaggctggagtgcaatggtgcaatcttggctcactgcaacctccacctcccggcttcaagcgattctcctgcctcagcttccagagtagctgagattacaggtgtgcgtcaccacatccggctaatttttgtatttttagtagagacggagtttcaccatgttggtcaggcgggtctcgaactcctgacctcatgatctgccagccttggcctcccaaagtgctgggattacaggctgagccactgcgcccggccccagctattgtttttattttttgtagagacggggtttcactatgttgcccaggcttaagcaagtctttaacgtatctgaaccccagtttccttgtctatgtaagggggatgattacatgtgcccagagttcactctcctttctcccgttggtaatcacatcacacttgtagctactcatctgttgtccacctatctgcatacatctgcagcaaggcactgtgcccatttacttccagctcccaaggcttagtagagggcttgacacataggtgctcctaaatattcatcaaatgaagaaatggcactgttgtcaggattgaatgaaacaaagatagccagtctgatagaaaaaacagtggaatccctatatacatatatgcatgtgtgtgcatgtcttggggagggaggaatttggaccattgagaaatgggctggtgtcctaacttagtccttatgacctgtgtgactgtaggcaagtagctgacctctctgagtttccatgtcctcagctataaaatgagatggtgggctgggcgcggtggctcacgcctgtaatcccaacactttgggaggccgaggcgggtggatcacgaggtcaggagaccgagaccatcctagccaacatggtgaaaccccatctctactaaaaatacaaaaaattagctggatgtggtggcgtgtgcctgtaatcccagctactcaggaggctgaggcaggagaatcgcttgaaccaggaagtcggaggttgctgtgagctgagattgtgccactgcactccagcttggcgacagagtgagactctgtctcaaaaacaaaacaaaacaaaacaacgaaaaaaatgagatggtagattgacctgattaggaagattaaccaaggtaagttatggtcggcatcaagtactgtgcctgaatcctagcgggtggttcacaaacggcagctcccttccccacttttctgatgcctatggactgagccagtgcacaatgaaaatggcaataatgaacacatattgagcacttactatacacagggcactgtgctaagaacttagcttatattatctacagtgcagtggttttgaaatggggtttaggagaagaaatccttttgtaagcaggagtgggactggggaacggaggcgttaatcaagtgagactttcatacaactgagaaaaggttaacttccccctaaagaaggagcgtgtgtgcagggaatgaggggttggtccatgatggaggttatgggcccaccagtggcctctatatggctttatctagagcatttctgaattcatccacttaaaatttaattaggaaaaagggttattctgcttaaaattaaattagcttggaaacaccacatataataaggcctggagttaaaatgctgggttcttgtcctggccctgaaactcactagccagaaaccctgaacaagtcaatttccctcttttgagccttcgttcttttacagttaaaacaaggaagtcggccgggcgcggtggctcacgcctgtaatcccagcactttgggaggccgaggcgggtggatcatgaggtcaggagatcgagaccatcctggctaacaaggtgaaaccccgtctctactaaaaatataaaaaattagccgggcgcggtggcgggcgcctgtagtcccagctactcgggaggctgaggcaggagaatggcgtgaacccgggaggcggagcttgcggtgagccgagattgcgccactgcagtccgcagtccggcctgggcgacagagcgagactccgtctcaaaaaaaaaaaaaaaaaaaacaaggaagtcagatggtatacttctggggcctttattagctaaaatattctgagagagcgtgaccttctagtactgtctcccatggaactgtcctggtgaaacccagagatcagctcatgaagatggacttgaggcaagagagagctgaaatgaaattgggcttgagttgccactcagcccagcaccatcttttcagatccttgttctgaagcagcagatcctcttcatcttttcagccctgaaggaatcccttacatccgggtcactgcaaagttccgggcaaatttcctgacaaacttctgttcattttttaaaacccattgtaaatgttatggtcatttgttcattcaataaacatttattgaataaatactctgtgccaggtgttcttctaagggatttggcagtgaacaacaaaaacaacaaaaatccatgccttctatattttaagagacatccttttttgaccaactagccttttgcatagactttgatagttttactgttctaagtgacatgtcggcttccctattagactgtaagctctatgaggccaagaactgtatatactcctcacttcatccccagtttcccaatggaatacctggcagactgcctgtatttttctcttcctgaggatttaaagacctggacatgtatactatggtcattatctcaccatcctagccaggaaattgacatttatttagcatttttttctgggaagacttactgcctagtactttcctacttatattctaagatggcacatttaattatttgatcaatatctgccccttgtccattagactatcagctacatgacggcagcggaaatatttggtttactgatgcagcaacagcatccaatagatgtatctagcatacaggtagcactcataaatgtttgctgaatgagtgttaggatatggagaggaaaatgtggtgatgcaaaattatgcaatttgcagtctttaatgctgatcagtctagctgggtactgggagcacacagatggtgtatgcttaaaagcttatgaataggagttggcattttaatacagtaacaagtacttgaacattgactaatacacagttgcgtgtgacaaagtgccacatttctggtatagataagtgctggaaaacaggctttggagccagtgagatctgagttcaaatcttaattgtgcttcttagaggctgggttgttgggtgatacttaatccacctgaacatcagtttcctcactgggacatgagcactgaattagcaagtatatagtacagtgtctggcttttagttgatgctacataaatgttagtgcttcttacttcttgccactaaagagaatcttgtccctcctttcaggcccaagtccaattccttatcttggtgaacccttccctcactgcacagctcacagtcatcctgcttgtcttggagctcctctcataatgatcagccaagcatcctgcttcacatatttagctttctatttatcaaatactttcaatgtgcctaatatgcaccatagcctcgtgtagatgttttacaggttttagtttcttaatccccaggacaaccctccgaagtcggttcccattttacagatgaggaaaatggcaccagtgagatgtcactaacttgcccgagggcacacaactgggaagcagtcctgccagtatttaaatccaggcagtctagctgcagatgctgcatttggaaacccaagggccacatggcctttctgccttacgatgtcaaccaatcatggtttgagctgggccagccttgctggctggagctgaagctactgaaggggaggacagcccagctcctgcctcccagcatctctgttcttctgaggagagcagagcccctcttggaaagggcccattccaaggtctcaaagatttctctatgagatctgggaggctgcacagctttgttgggcacatgagaatggaaccagaagacccccaactctacacccaattcctcaccatggaaaggaagtggaggcaccttccaggcagccccctaggtggcggctgttcccaacacacatttatttagcatgagcctagggcttggttctggggataaattcttaagcaagacaatatgaaacaactgaaataatttgaaacaatatgatgagcttaaaatccatgcagtccccaaattccaggctggtctgggtcaagggagaatgtagtcagtgagggtttctaagcacaagtgagcagtaacaaggaatcaggaagatgggtgtgagttggccatgccaaagatattttctggagctgggatggcaacatgggtattccaggcaagactggccaatacctccaaggtctgaagatagaggaagccatttgaaataccttctccattcaatctctgcaatcttgtgaaaaattcattggttttttattagcctatttttcagatgggaaaattgaggcccaggttgtaccttgcttatgatcaccttgctaataaatggtagagctgttcactccaaagcattcacaccagcttctgagaatagaggcttttataaaacaagcaaatgcaaggaggatgggactcgtgggcaggttcatgggactaggttctaactgaagatgtggtaccgtcactgaccatgggaaaattactggaactttctgagctcctttttccacatctgttggcaaatagagaagatctgaatatgtctcaagtcagagtttgcaaaacagtatgctgcattaagcataacccctggagacaaaaaaaaaaaaaaaagttggtggtcctggatgtattttactgaggaggacactgaggtttagagcagttaataactttcccagtttacatggctaaaatgtgacagtgccagaatttaaactacggtggtttggattcagaatcacagtcttaaaaaacacgctctctactgtttttcgagtacagagaaatgataattgatgctcagcccctatgtctgggatacattagggagtggtggggactctggtgagctatagagtccatgctctgactaaaggtacactcctgtgactgaccttgagtaagaccagtgaatgtttggtgccccaattttctctaccctaaaattgctataattatctcttcatctcatagggttgttttgaagactaaattaattaacatgcctggcacatagtaaacattatgtaagtgcaagctgttatgacctgtgaggtgatctttgttttacacattcgtttttttaaaaaatacccatctaacaagttctatgtcttaaacattcaaaacacctacttatatatagtacagggaactgcgcacaccactgacgatcaagttttgacaactgttctggggccttttcctcctccttctgagcaacactagagcttgtgggtagggggagggggcttgggaaaagaattgagctctccaggccacaagcatgcgcttcgcacatcagcagcagcctccatagctggctgctgtagcccctcacagagctcatggttaccatcggcctccaggctgtaaagaatgtgaggtgcaatgggcagccttccaggtacccaagaagggaggcttcatcctttcaggatgtctcaggcttcagataaaacccttcctgtgttccagctcatagctggcaggggcaatcggcaatgactgacgacaatgggtgacttgtcaaaaagatgtgtgtgtgaaccaaatgccagctagctggagcaaagcatgcattcaggaggctggtgggaagaccatcaactgcacaatggtttgttttgcacctactatgtattgggccccgggccaggcccagtacatagtagtacatacatttcaggaggtggtgaaattaataataatagtagttcacctgtatttactgcctcagagcaccacaacagacattatttctcttaatccttggcacaagtctatgatgtaagcaggcctcatttccttgctttaaaggtgggtaataaatgagacttgtttaaagttataaattatggcagagatatttggccaagcttgtttccttttccacctgggtatccccatctggactacatttcccagcaggccttgtggttgagtgtgggcatgtgacagagttctggccaatgggatgaatggaatgctagtgatactgcaatatggctctgcgaggcctggcccataaaaatctttccaagcagtctatcctctcctcctcccttggctagcagatgcagagagtctgcagagggctctgagtacctagcgatggtggagtcacaagatggaaggcgcctggttggattcctgaggaactctgaagaaggtcgtctgctgaatgccacactctactcttgattgagtgagacctaggcttcttttgtgttagaccaccaagttttttgtttttttttttcataacagatagcctgccctaatatacacagtaaaagcagaattggggttttagaggcattttgcttgtacatgtgacagttttttcgaccatcttccaaacaggcagaaaaatctccttatgcatatagagtcttgggattttataaagcatttgaacaagtaatgggacagtttcttccttccactccacgcaacacttggactgtggactcttgtccactgtgggaagctttcaggtggggtaagatgtctgggctagccacagctctggtatcatttgctcagcccttcgcaattgtcctggtagacaataaagtgtcagtgttgtaaggcattctttgcatgcaatgaattaacttccctcctgtccatggataatggtacaaattatataccgtccctcagagaactgtgaaaatagtcatcattatgtgcttttgtgttctgtggttcagatgagaacccccaattgcaagccccttcccctctctgagcttcagttttctcatctataaaaccacagggtggaattaagtgaactaaagagtctcttgcgagctcgaatttgctatactctcacaaaaaagcaatattttgtatgagtcagacactgtcccacattatttcacttagtcattgaaatgaaggaggatacaaataaggtattttggggaaaataatagagaaactggaattgcccaccttcagttgtttcctccaaagtttctattcaataaactttaggggagtggcaaagtggtacacagtattactctaacttgcaacttcactgagcctgcaatctaggtgggaggacaaaaaccacacttagggaaccaataaatgtcccagagcataaggcaaagagtctgcatggtcaggaagacaaagggggacagagggaaagagacctaccttggttgccaccctccaccctgcctcaaattcctgactgcagacacagttacgctctgagcacttgctgtgcgccagacactggctgggtgttttgctttcacactgcatttgattctcacaggcgcattgccaggagggcatgattctatctggttaaagaagtggagcttaggaggcacatggtcagtaagtcacttatccaaggctcccacatagctgataagtaccagagccacagggtttgaagcaggtctgtgtggctgcaagagcctgtattccctgcactctgcctctgccctcctatatgggcagctctggcctgagattcaagctgcactaacttccccgggtcttgaagaagagatactggcaccccctctaagggttcgtgccctttcattcatgaatcacagtcaggtatcctgaggaaacctcagcttgcagggcatcccatggcagagaggtcggacattcacagagaggtgcagcaggtttggtatcattggcagagccctggatattctaactgggaaactctggtacaaaaattccaaggtttgcacagctagaggcccatgggaaagacctaggagcagctgaaactaactgaccccacctggaagcagatcccctccaaggacacagagggaagaaaagcggcaggaagtagctggtctggttgttctcaggaaggcgcacgacctggaagagagaaacgtctttccctgcaaacaacgatctggcatttctcagtgtgtgctcctgggaccctctgcaacacagctcacttagcatgttgaaaaaggggattcttgggcctcaaacacaatgaatcaagatcccctggagtggggaacaggaacctgcatttagccaagctcatcagatagttctaatgctcaccaggatttaaaaatggaaaattccacttatttgaaatgattctacttagttcttccttagatgccctattcattcctgccattttgcccatcagtgatgcttaaccccaggggaaaaatagtaaatatattaatatctttttttaactttaagttctgggatacatgtgcagaatgtgcaggtttgttacataggtacacatgtgccatagtggtttgctgcacctatcaacccatcacctaggttttaagtcctgcatgcattaggcatttgtcctaatgctcaccctccccttgccccccaccccccgacaggcccgggtgtgtgatgttcccctccctgtgtccatgtgttcccattgttcaactcccactaatgaatgagaacatgaggtgtttggttttctcttcctgtgttagtttgctgagaatgatggcttccagcttcatccatgtccctacaaaggacatgaactcatcctcttttatggctgcatagtattccatggtgtatatgtgccacattttctttatccagtctatcattgatgggcatgtgggttggttcaaagtctttgctattatgaatagtgctgcaataaacatacatgtgcatgtgtctttataatagaatgatttataatcctttgggtgtatactcaatagtgggattgctgggtcaaatggtatttctggttctagatcattgaggaatcaccacactgtcttccacaatggttgaactaatttacattcccaccattaattaatagatatatttatatctattgtgtgctcatcatgtgtcccagattcctgtaagcattttaagtgaattaagtcatttaatatcctcacaacatccttctaaggaaggtactttcactagcctaggattacatataagggaactgaggcacagagaagctaagaagctgtgaaaagccacacagtaagtggctgggccagaacatggacccaggcagtctgattcccaagcttgacctctaaacccctacagcatgcaaacactgtgggaagatccatttattgaagactcactctgtgctaggccccatttccaggtactttcatgcattcaacagacattcagcaaatgcctactatgtgccaggaactgctctaagctctggccaggctgggaggtgagtgaagcactcaccttgggaactgaatctaaggtgggagtagggagccaaaaaattcactaatcaagggaaacaatattttagtgtaatattttttaaaaaatatcaaattaacaagctatggcccatgggctggctcacctgtttctgtaaatagttttattagagggaaataaaaaacaataaagaagaaaatactaaaaaccttgctctaatggagcttacgtaaatgacctcatccaattcttaccatacatggccccaaaaggctgctattgatatcattacagggtaacatacaccactctgtctatgggtaactaacgattatagaggctgacaattatggagtgccagacactatttttaagtgccttatagtattattttattccttgcaacctccctataagggaagatcattatcatccacattttacaaatggtgaaactaatgcacacagaagttttataatttgtccaatgtcaatgcagccagtaagggctggagctgggattttaacccagacaggcacactccaagaggccataccttttttcttttttttttttgagacagagtcgcactctgtcctccaggctggagtgcagtggcatgatcctggctcactgcaacctccgcctcccaggttcaagtgattgtcctgactcagcctcctgagtagctgggattataagtgcccactaccacgcctggctaatttttgtatttttagtagagatggggttttgccatgttggccaagctggtctcgaattcctgacctcaagtgatccgcccaccttggcctcccaaagtgctgagattacaggggtgagccaccacgcctagcctttttttttttttttttttttaagagatgaggtctctctgtatcacccaggctggggttcggtggtatggtcatagctcactgcaaccttttaactcctgggctcaagtgatcctcccacctcagcctcccaagtagctggaactacagatacactccacatctgacccaaggccatacctttaaccacagattggcaaattatagcccagaggtcctatctggcttatcacctgtttttgtaaataaagttttattaggacacagctatacttaatcatatgtgtactgtgtgtgtcatgccataatgatagagttaagtagcggtgacaggccacgtgggctgcaaagctgaaaacagattaggaccctgacctctagggtcaagggctaagcagtttaagctggttaatactatggatttagatggagaccattgagacactctaactaacttgggataagcagaacactaggtaaacagagaattaagacatcctaaaaaaccctaaacctatcaattaatttaggctgttagggcagattatcatagcaatgagaccccaagagaaagactggacattcccaagtaaggaccatctaattctttctttaggcttgataggcctcaccacaatatgatacactgaggttcgctcattcattcattcattcagtcaacatttacgaagccccttccctggactaggcggcatgctaaaccctgggaaagaaggacgcatgggcacccatgagggaggtacacagcaagatacagttgacaagtcatggtctttagagatacacctgggttcatactccacctctgttctcttctggctgtggacataactccactctctgagctttggtgttgaacattggatataacccagtggttaaaggcaggttaaatcccggttccttcacaaccattagctgtgtgaccctgagcaagtgactttgcctctctgaacctcagcttcctaatctgtgcgctagtttacttcagggacaggatctaggcaaagctgcccagcacaccgtaggcctcagtggatggctgcaattctttattacgatgatggagacagtttaggagagctgtctgcggaaagaccccaaatctattaggcatgttttatctttgctctcccagggtcttgaataaacaacgtcttcatccagtttttaaaagacactctaattctgtctcagaatatactgccacccccgcccccccaccccttacctcacccccagctgaaatttggccggctcagtgcctggctgctggcctgaatttccaaacactgttggtttagcatttctcaaatgtatcccattaacactatgaacctgtcagccttctctcctctttgagctcaagtccgaccatcacggcgagagacagagccagtagcatgagcccagcctcctagactcgcctttgtgaagcagtgcagttcccgggtcggtcggcctgggactgggggcacctgtcagcatttgcatgaagagtgtaccctagtcagacgcacatacaagcggtgtgctcggagactgcgagaaggcgcgttggaatgaggggctctgggaaatgcaagcaaaatacattctctgggttggcactggaggggaaaaaacaagaccttgaaggaggcttagcaaaaagccactgctctgggaaatcaggaaatagctctgccctggcacagtctccaactcactctgtgtgtcactgagcacgctacttgccctctctgtggcacgtttattttaaaatgaatgggttaggctagcccacgtgtttttaaactcttgtctggcagtggaactcttttctggaaacatttttacttggaattttaagatataaacagatgaaagtgtttataactaattctctgggttaaagagatgggggtggggagaggagagctggaattctgatcactcagcaccccgtacccccaaaaagctcaaagaaactaggaggcgcctctgtggaacagggttcgagaaccacatgacatgatggatgatctgtagaattcccccctgccctggcagccttggatcctggtagcctgctgataacagcaatggctattatttattgagtacgttctttgtgcaagggactggactttacttctgtgtcttttacttcaagagttagtagacagctctgattcagaccccagcttcaccaactgagcagctgtctgaccttggacgagttattcggttggtgcaaacgtaattgcgcttttgccattgaaagtaatggcaaaaatcacaattatgtttgcaccaactgaatagctaacctctcagtgcctcagattcttcatctggaaaataggtcgttcagaggattcaaggaattaatctctctaaatgtgcttagaacagtggcaggtacatagtaaacaattgatgctagccatttttatcatggctgcctagattttatctaacctttataagcaccattctatttcacaggtgaggaagctgaggctcagaggtgaagtgagtgaccttagatcacacagctagtaagtgatggagggagaacctgaatccaggtcagcttaactgcatggcttgtggtcttaacaccctgcctaaactgctttgctcttgacccaagaagtcacacacagacatagggtcatagcaatttgcacgaggagttccaagtctagatagaagagttgctaatgatgactatagtgatttatgcttataggagctctggtgtcagcagtctggggtctgggcatctttgcaaattcagatcccacacagaaaggaggtatttggttaacagagcccagggatatccaatgttctttcctgcaagccacgttctccagcctttcctactgacctataagacatctgtgcaaattagaaaaagggcaggggcagccccaagctagagcacaggtaagcagacatcaggctgattttcaatccccacttggaggacaccgtatgcctttgcgtggtgcacaagctgtgcaaccttatccagccatcttgactcttctcctgcctcagtgtttggtggagagagaataaacatggccagatgggagacaaagaatggtctcaaccttgccctgatgcctgtgggggcctgggatgggaggggggcagcaggagcatggaggcagcgcaggcaggaagcaaatgcaagccacacagtcactttatctctttatgtttctttctctcagctccgagggtggtaataaaagatggctgcacggctctccccgggaaactgaacgggagccaaaccatcatgtggtgaacaaatgctgtgatcgctcaactgcagagctgctgctgcaccgtattaaaaaggtgacagcctctcctctgacccttgaaccatggaaatgggcagccaccagcccacccactcagaaagccccaatgctctgtcaccagcagaggcccaacacccactccgacgtcagaaaaagaaggtggcatggtgtagttgtcagaacatggactttaaattcagacagagctggactcaaatatcaactccaccctcataagctgtcgaactttgggcaagacactgaacctctctgagccttgatctcacatttataagatgtagcttatcgtacgcatcaagaagggagaatgtaagaatttagaaataatacatgcaaagtgcccagcacagttccccgacacaaagcaagtgcttaatacatgggagctatacatatagttcctccactgactcagtaaagactgatagttgcccgcagagctttgggcacgatggaggtcaatatgagagggcatcagtggtttctctgaggagtgacatttgagctgaggaaaggatgagcagaaggtttttttggtgaaataagaagggaagagcttctcaggcagaggaaacagaatacgtggggcctgggataggaaagaagagatgaagattgaagagctgagaaaaatgtggctgaaactgagacaacaattaaagttttaaagcactcactcttggctgggcacggtggctcacacctgtaatcccagcactttgagaggtcgaggtgggagggtaagttgaagccaggagtttgagacaagcctgcgcaacatagtgagacccccccatctctactaaaaataataataaattagccaggggtggtggcatgcacctgtaggcctagctactcgggaggctgaggcatgaggatcactttagctcaggagattgaggctgcagtgagctatgattgtaccactacattctagactgggcaaaacagcaagaccttttctctaaaaaaaaaaagtctcactctaacaaggctacatactgaataattccaacaacatgacatctagcaaaggcaaaactagacgaagtttgtgaaaagatcagtggttgccaaggtttgggtggaaggagtgataaacaggtggaatgcgggatgtttaggggagagaaattattctatacgataccgcaatggtagatacatgtcacacatttgccaaagcccatagactaaataacactaagaatgagccccagtgtcaactagggactttggacgacgatggtgtgtagatgaggttcgattataaaaactatacccctctggtacaggatagtgagggagggaagctttgcacgtgtaggggcagaggcctatgcaaactgtactttctgtacaattttgccatgaactgaaaactgctctaagatgtaaactctattaatttttttttttttttgagatggagtctcgctctgtcgcccaggctggactgcagtggcacaatctcagctcactgcaagctccagctcccaggttcacaccattcattcccactcctccagagtagctgggactacaggcacccaccaccatacccagctaattttttgtatttttagtagagatggggtttcaccatgttagctaggatggtctcgatctcctgacctcgtgatccgcccacctcggcctcccaaagtgctgggattacaggcatgagccaccccgcacagccaagtctattatttttttttttttaaagaaaaaaacagaaaaactctctggctcctgtgtagagaagagattgggggcaggcagaggagaatgtgggccagttaggtttttctattttcttgctgggctcttaggggcaagttatagaagctctgagagcttcagtttcttcatctgtgatatggggacaagaatataaagtgacacagtgtgtggggaaatgcctcacagaaagcctggcacagggcaggcgttcaattcatgctgccggagtggggaagaatgacaatgcgaagagccgcaaaaggtgtcaggacacaagagctctttgtgcaggcacagtgggcatcctgtggtgccgttttgtggcaggtctcactgtttattggcaggaacaaataaaaatagcaaaagtctcactctttaacgggagaggcaaaacaagcgtatgttccaagcataaagttgtgttttgtgctttgatgaaaatcgacaataatcgtagctaagatttattgggtgctgactatatggcattgttgcaaggcatgtttgtaagcgtttaatgtgaattagctcatttcactctcccaaccataacttaggttagtttctattattatctccattttgtgtttggggaaactggggcacagcaagattcgttaacttgtccaatgtaagtgacagcgctggcttaagagagaatcaaaagatacaaacctgagctaacagaggaaatgggatgagcatgcttagaacagttttgaaatagacaaaaaagacgagtcatagtcatactcaatcatgtagaaagcagcatggtgtagaagttaagagcatggatttagaataagccagcctggatttaaattctggcttctccacttttggggtaacctcaggcaagttatttggctactctgtgactcagtttccccatctgtaatatggggatagtaacaggccctatcatgtggagtttttttttttttttttgagacggagtctcgctctgttgcccaggctggagtgcagtggcacaatctcggctcactgccagctctgcctcccaggttcgtgccattctcctgcctcagcctcccgagtagctgggactacaggcgcccgccaccatgcccggctaatttttttttttgtatttttagtagagacagggtttcaccgtgttagccatgagggtctcaatctcctgaccttgtgatccgcccgcctcggcctcccaaagtgctggaattacagacgtgaaccaccatgcctggcccatgtggagttgttttgaggattaagttggaaaatgcatggaagctcactagcttatcacattatatggcaaatagtaagaacttgatacatgtttgaaaacaaaggaaggctatagagatttctaaaagagtaaatttggagcttcaagcaaggagtggggctcaaactaaggctcaacagttctcatataaccaggtgctgcagctggtggctgcaaatatgaaagcaacttgacctctgccttcagggaccggacagtctggtggggaaggcaggctcaagtgcaagttatttttttaaaagcaggctataagaattattcattcaatgagaacacatggacacagggagaggaacatcacacgctgaggcctgctgcagggtggaggtctgggagaaggatagcattaggagaaatacctaatgtagatgatgggttgatgggtgcagcaaaccaccatggcacatgtatacctatgtaacagacctgcaccttctgtacatgtaccccagaacttaaagtataataataataaaaaaagaattattcattcaaccaaaatagtgccattcattctaagtactagggatggagtgaattatttacaaaacagataaaattcctgccctcaaggggcttatattctggtgccagaggttgggtaaggaacatataagcaagcatagcagtagcaatgagggctgttaaaaaataaagcaggatgacggtatagagatccacctgtgttattctgggtaggatggtcagagaaggaagtggtaatatttgagcaaggccgaaatgtagtgaaggggagagccatgttaatatctaggggaaaagctttccagttgagggaatagcaagtgcaaaggccctgaggagagaatatgcttgacctacacagaacagcaaaggatggaagtaccattgtgggtaaggggcaggagggtggagaggcagcagcagaagcctagatcatatgaggttttgcaaaccatagtcaggattgtgaatttcattctaacagggatgggaagcccttgtagagttttaaacatgcatttggcatctgatttagtttcagaagaatcactctggctgctgtgtagagaacagattgaagggggaaatggtggattagcatgtcttcaaattctctggccctccttccactgagaggtggggtgtccttaaacctaggtttcccctgtgcctgtctttgaccactagaatgagggagaagttgtgctgtgtaacttctgatgctagtccttaagatacctgcagcttctgcccctcttgtaatgtgccctcttgaaaaccagctaccacatgagaaatctgactatgctgagaccacatggctgtgaggaagctcaatagccacgtgaaggagcaccaaggcaacagactgaatgtgaagtttacttggaccttccagcccagccaagccacaagctgaatgcagtcaagtgagtcatcccaggcaacactgcatggagcagaagaaccacccagctaagccctgcccaaattcctggcccacagattgaaagcaaataaaatggttgtgggtttacaacacaaagatttggggtagtttgttccacaaaaaaactttatacaaatctccactttataaatgaggatacagatccagaaaggaaataattactgtcggtaagtggttgagctagactttgaacttataacttctctaggcaagttcaattttttttcttggtttatgactgttgctaaaatttccacatttattttaaaaccacatagaacaaaataaaatcatacaacatgttattctgtgttttagttgcctgcatgctgctatttttcccaggctagctgtgcaatggcttttaaagtggggtctgtagacccctggtgctagagtcacttaggcgaagcttgaaaacatgcaaactcctgggtctcacccaggaatctgactttctggtaccagggcacaagcatttgcattttaataagtagggtagaggtttcctaaattattcacatcacgaaaggtttgaatgtcaataaactagtggatcaacaagccctcaggaagcagatggacattttaaatgaagatagagagtttgcaaacagtaaatgcaaactgtaaatggagcactccatccctgttgtggggctctcctcactacactgtgttgcctgggtgaggagggggccctaagatggtctccccccaactcttctccccatgaggctcatctcagggagcagggaagggtgtacaagactagttgtggggtatgagatgaagcaggggtagagggaacattcagagagcattcactatatttcaggcactaacaattgaaagacttcctcatttagtcctcaaaaagaggcattatttccattttacagttaaggaacctgggagtcagaggtaagattacttgtacaaagccatacaaacagcaaacgggaagtcaagatttgaacccaggactgccagacaccaatgctagtgtttttttccaatattaagctgtgtcaaccaggtggaaggatcgtgtgatatgaaatcatatcagaactggagacctactcctccacctgtcagctatgtggcctcggaaaaacgtcatttcacttctttcaaagggaggatgaaatgtcctaccactgagaagtactgggtacccaacagccttttagtaaaaggtgattgcttctgaatgagaagacgccaggatgccaaggccaaaagtctgaagtggccaccgggcaatttctcccacagtggcatatgtcagggcaggacaggttcttggggggtggtggagtgggacccagagctggagtcattccgggtgtggctccagcacatgggaaagtgcacagggtcagcggggcgcagccagcggcctcacagtctttcccatccccagtttctgtgcttctgggaatcaggagccacactgtttttctctgtcggacccgagctctctctcccaggggagttggcagatctgccgctggcctgttggctggaggtgcacagcagcggagcctggcatcgctttacaggctcacactgcctctttcttgtgctgctctcttcccgttcccacgccccacctctgcaagtccccagggatcctgctttctccggcagtggcaagggcagaggccctgggtgaagagattagatgggggcttccccctccaaggctgctctgctgggcccctggacgaccctaagtgcctgaccttgcagaccacatccccgcctggggacacaaggctgtgggtggtgggctgtcaggaagtctgtgcctggtgcaagccaaggcctgactcccctcagccgtgagcttttcactttgcagagttgtaggattcttattcatgcaaagagtcggctggtcatgaatgccttcagcaaagatttaggcattgtgccaggtgctggggccacaattcggaaaaacagcttaacttgatcctcaaggaaggttcagtccagggggagacgggggaagtaaataataattaccctcctgaatcagttatagtacaggaagagcagtaagaccagaacacatagctgttggtgaagggctggtgcattccttcattcaatgaacaaatagttattgagaacctgatatgtgatatgggaatatagtgggaacaaagcaatctttctggctatctagaccttctgttctagaaaagaaacaacaaaataaattatacaatagcatatcttatatctctatattatttaatattatatgtctctgtattagcgatctagctagaatcgcttcaggcagtgataaatgtttgaaggaaaaaaaatgcatagttgggcctagagagtgcggacagcacggtctggcagggtctccctgaggaggcgacatgagatcagaaactcagtaggaggtgcatgggtaagagtggtcacatctgcagaaatgtttcaggaagaaggagaactagcaagcgccgagctagtaacacagacaccatggacatgctttacacataccacatctatgaagtgaggactctgtccccacttcaggtggggaggccaagagctagaaatagggagtgactgatcgaaggccttgcagcttggagaaggcagagccgggatccagcccaggcggtctgctttgcctacacaggtggcctctgtgccatgaagccaggccgcctacctgggctagtcctagatgctttgtgagctcggaggtgggcaccaaattcaacttcagggagggagagaagcgggcacagaagcacaatcttgatggatgagagcaaggtacatgccaagccaaggaagtctctgcctttctccttcccctcatttggcccccaagctgccacttacctgtgtgcatgtccacccaaagttgagagagagggaagctccaccctccatacacacggggctcgctctgctcactctgttttcctctccactcaagtcacctcctcaggaggccttccctgcttcccacacctcaaataccaacttctctgttgcttttgcttcacctgtttctcatgacctgcccttagcccacatatctgcttacttattgattgttttctgcaactctagtatcagctccacaggagctactgtctatttcattcaccactgtaccctctgtgtctggcacataatgaatgaaaggaaggaaaggaggaagcagcttaatgcatacagagacatttagaagaggtgaagggaacacttttccaaacacacacacaggtacctgggagtgagtgcaggaactgtgttctatgtaatgtttgctggagcctggcactcgaaatttgcctctaataaattctgttgaatgaatggatatctggaatttgaaattaaaagttcaggaagcccagaagaatctgggcaattatgtatgaaataaggagtaaagaaatgttattataaaaattaagtttcttgatgggatgttagagaagtcccaggatagagattcaggagtcaagggctcattgtggctcaggggctgatacgctgggaggatttggaaaagccacccttctctcttccctaagtcacagtttgcccatctgtaaaatggggacacatagaaaagtctaaggggctcttctgactctggaactctaagattttatagaccatcccctcctctgggacaagcccatgcatctccctcttgccccaaacatcctccctacaaacagtaagcctgggtgggagctggggagggggaggatctgagagactctgatgcctttcgtcaaggtcttgcattactgatgcttcctggctcctgctcttcagccctctctgaggtctgaccttctaatgagcggatgcacattatcagccgctgcggtttgaacgggtgcctataatttagtgttgcctaatgctggaaactgagagcagaacttgcgtaattagattggggtctcattaacgtctgcctcctcgggtgtttttcattcttggtttctcctgccctgtatttgcaatcccttctgtctgtataaacatggctgtccctttttatctctcccttgtggggccaggctagaatttgggtccagaacagcgaaggcactcacaaagcatgaattttaacatgccccgggatggcccctgctctgctttctaaatagagaacctggatgtctgggttgcgcttaagcacctcgagctggctggctggccaccctgggtttgggtttggacaaaaaccagaggaaggagggctatcaagacagctgctgcaaatactggtgatttaaccaacttgtgtacaatgcttggccatttacaaagcactcctagaatctgaccttgtaagcagggacctggtctattttgtccactggtcccctaagagttattctctttttgtgccctcctgaccccattctatgctttttccactcttctctgccctgctctgagctacaggagatgggtccctgttggcagcatcaactcagctcccttgctgaaaggtttctgcttgcctttggccaaagtgaggccccagcaggagactggaaggcagagggagagaagggggtggtacttctctctagtgcccactgtgctttagtgccatgactttgaaggtagctgagttcctccccagttatagcttcaatggaccagctctcctgctcaagtctagattaaacctactagatttagtctagaaattctattctctccttttgtcccttcacccctagggataatggtttccttctgttgtcagattctaaatacctcacgttcccttagcccctcacactcctccataagttgccccttccttaaagtctctttatttagaccatttaggggtgaattctgtcttttgcctggtccctgtctgatacaatacccaatgtctgaagtggtccctggaacatagtaggtccttaataaatgtttgtggaatgaatgcacaaacttttcatagatgacatctcatgtcatccttacaaaaactatgcaaaataatattattaccttttacagattaaaaaacactgaagctcagagaggtaaattctcatacctgagcaacagatttttaagggagggcaacactcccatactgtaccctgaatgagctgtagcttcactctgcaccctggagaaatctctacatactgctgctttctgtacagagactgagtgtccactcacgccagcctggtgtgggctcaacaggaccagaggctggtggagtggacaaagattcgaagacacttggaaattcactcggtatagaatcagagacctgggttcaaatccaagtggtgctactttctaaaagtgtgatctggggcaatgaaatcaatgacaatgatttaactgtcccagttgtgactcagtttcttcctctctaaatggggctataataattattattacacacttaatttagtgattatcctgatccaggcattgtgtttagcatttcacattatactaactcatgtaatcctcactgcaaccctatgaggaggtattgttattattattattaggaggaggagggggagtattacagataagttactgcccacggtcacacagctgctgtcaccgtggcaaatctgggatgtccaccaaggcagcctgcagcctgctccagaactgtgttcttaaccttcaggctatactggctgtctacattattattaggccatttcatgagttcgtaacaactaggtaagaagaccatctatgatgggcacttagcacagccctggtgcacaaggtgccatcaatagtggtgactgacttttccttgttccccacctaaaagtcagatgcatggatcctctccatatttttcttccatgtcgttgttcgattgtactcttgcatggcattcatagtaggagacatatggcttctttaagcagctctgccccttgccacacacaggccttggagccagactgccttgggcttgaatcctagctttgccacttattggctggagaactggatgtcattaccccatccattggtgtttcagcctttttatctataaaatggtgattttaatagcacacaccctatagggttgtcgaaaggatgaaatgagttaattcatgttaagtgcttggagcagtgcctagcacgtaggaaatgctataaaagtgtttgctaaataaataaaagttcatgaattttgtatgtgcaattcaagctggcttaaacaaaaagggattttttttggctcaactaagtccggatccagagccttgaataacatcatcagggcatcgtctctctgcttggctgtgtgttcctttaccttggcttcattcttggcagattgttcactcaaggagagagatggccaccagcagctccagacatacatcccatccgctctgtggtcccagcagaaaacatgtgcctttcatccaagagttctggcactggcctggcttgggtcccagtgagatattccaattgactggggctagtcatgtgccatcagctgcacacaccacacagactgcaagttggggagggggtcacctcaatggaatcctaggtgctgtttgccaaagcagaaggaatggaagctggagaaagccagcaatgatcttctctgccatccatcctggtcacctatattagtcagggttctccagagaaacagaactaacaggatatatcaaagaggagatttattatggggattggctcacatgattacagaggctgacaagttccacaagatgctggctgtgagctggagaaccaggaaagctcatagtgtgatttggtctgagtttgaaggcttgagaaccaggagtgtcaaccgtataatttcccagtctatggctggagtcttgagaattgggtggctgctggcatcagtcttgaagtctgaaggcctaagaaccaggagcgttgatgtccaagggcaggagaagacaggtgtcccaggtcaagagagagagatttagctcttcctctgtctttttgttctagtgggacccccagcggattggatgctgtctgaccacacggtgagggaagatcttccttgatgagcctactgattccaacgctcttccagaaataccctcacagacgcaacaagaaataaagttttaccagccctctgggtaaattaaccatcacatcaccattcctgaagttgctccttgtgagcaagacttcgggagatctagaccttggtcacaatgcatactggaagtgcttacaggcaatttcaatacaacgtctacatgtctttgaaagaatacacagcaagtcaagagcactgtttaacattcctattttgggagaccatagctaggacttgttatggccctatatgcctgtggaagattccactgtttttatttatttgtttattaaacttttattttaggttcagggttacatgtgcaggtttgttataccagtaaacttgtgtcataggggtttgctgtacagattattttgtcacccagatacaaagcctagtactcaatagttattttttctgatcctctccctcctcccacccttcaccctcaagtaggcctcagtatctgttgttctctttgtgtccatgagttctcatcatttagctcccacttataaatgagaacatgtggtatttggttttctgttcctgtgttagtttgctaaggtaatggcctccagctccatccatgctcccacaaaagacatgatctccttcttttttatggctggatagtattccatgtatatgtaccacattttctttatccagtctaccactgatgggaatttaggttgatttcacgtctttgctattgtgactagtgctgcaatgaacatttgcatgcatgtgtctttatggtagaatgatttatatttctttgggtatatactcggtaatgggattgctggatcaaatggtactttggaagattctactgattccccccactgaaggacacactgagtcacaggctacttagtgtgtgtgcacattctcatgggtctgacatcctgtaacaaatcttgctaaagtgagctacctggctgagattgtaagcaccatcctgggcatgagacagaataaatctcaacagccatatgggtccctgaacccaggcctttagctatactggcactgtcttcacagccctggctactcaaaatgtgatcttccaacagcagcatcagcagcatccaggagcttgttcacatccttgctgctcaaactgaacctgcaagaccagatgcactggcttcatctgggagctcaaagaaaactcaaaatctcaggccatacctgaagacataatggatgaagatctgcattttaacatgagatctcccagaggtgtgtaaacacattaaatttcaagaggcactgctatattcattttctagggctgctgtagcaagggaccacaaacttaatgactttaaacaagagaaatttattctctcatggttctagaggctagaagtccaaaatcaaggtgttggcaggctgggcttggtggcttatgcctgtaatcccagcacgttaggaggccaaggtgggaggatcgcttgagctcaggagttcgataccagcttgggcaacagagcaagaccccatctccaccaaaaatttaaaacttaggcaggcatggtggcatgtgcctgtagtcccagctattcaggaggctgaggtgggtggaccgcttgagcccaggaggttgaggctgcagtgagcagtgatcgcatcactgtaccccagcctgggtgacagagagagaccctgtctcaaggaaaaaaaaaagctattggcagagttggttttctttctgagggtttggcaggagatgcctgtctcctagcttctgatgattgtcagcaattcttggtttgtcaatgtatctccccagtctctgcttccaacatcacagggtgttttcccgtgtctaaatttccctcttcttataaggacaccagtcatattggattaagggctcacactactccagtataactgcaccttaatcatcacatctgcaacaatgctatttctaagtaaggtcacgttctgaggtactacgagttgagacttcatctttttccaggggagcataattcatctcataacaactgccttcaaagtctgccattcctgaatgctggaagaactgccaattagcaaatacctggaacatttctgtaactttatttttgtaaacaatgttgtaaattcaggaagaatatggcaggtctagaataagacttgaagatgtctatttttgcaaagtgattcttgtgttcaggcagcatacctaggagtgtcctcagcttttcagcccgtcctgcctcagtgcagggccatgttgagaacaatctggggatgtttcctactttggctgccactagaatcacgaggggagctttaaaaatatgaatacctaaatcccaccctcagagattccagtgcaatacgtctgggacactgcttgggtatcaggattttaaaataattcctaggtgattctaatctgtagctaaatctgaggaccaatgggatagttgttcttttttttttttttttgtggcagggtctcaatctgtcatccaggctcactgcagtggctcactgcagcatccgctcccaggttcaagtgattctcatgcctcagccactcaaatagctgagactacaggcgcacaccaccacacctggataatttttgcatttttattagagacagggttttgccatattgcccaggcttgtctcaaactcctgatctcaagcaatctgcccaccttggcctcccaaagtgctgggattacaggcgtaagccattgtgcccagccgggatagatgttcttgtttttacctgttacaaatgaaggagatccagccaccctaccaaatagggaagcagacacgagtacaaaaaataccaaatatgagcacagattcctaaacaatagcattttaggctttttatagtacttgtgtgcaaaatgagggtgctatgaagaagtacatgaaagtatatatttagcattattctcctaatctccaataatcaggaacttctttatgtctccttatagttttgtccatttttgaagtatatcttgaggtatttttatatagtgcttatacatttaaaattatttcttctaagtaaatgaatctttatcataataaattacttccttttccctagtaatgcttttcaccttcgagtctattttttcccccagacattaatgcagctgcatcagtgagctttcttttgctgcacagttgcatggtatatttttcccctttctttaactttcaaattttctatatgcttatattttagatgaatgtcttgaatggaaaacatttagattttttaaaagttacactgataactcttctctttaattagtgcatttagtccatttacatttaatgtaattattggtatacatacactggtgacacaaatatttaacaactcccagagtactttgtggggtttgcagttctcacaaatgaccatgagagggcgaatccagaagatgcacaggcatttatagccttgaagagacaggagaaaccaagcattcactctctggggttccactactacttctgaggttcttccctacaatgtctgggcatcctgtggccaggggagaacaagaatatgggcttggggacaggagtgtggtggactgggggacacaggaacagtctcatggggttaaggtggctgaagtcactcagtaggctcaaggcaatggctatttacctaccggtatagaaaagtttcaatattttaataaccagcactgctgtataagcaattcagaatgatatcagatcagacctgctgttatattgggtgtaaatcaaccatttactttgtgttatttacaacacctgttctgtgttggtttttaaagcctgctattaatatatttacttttttttttttttttttgagacaagatgtttctctgtcacccaggctaaagtgcagtggcgtgatcacagctcactgcaggtttgacctccccgggctcaatcaattctaccaattcagcctccctgagtagctgggaggatttctgctatttttttgtatttttcatagagatggagtttcaccatgttgcccaggctggtctcaaactcctgagtgcaggcaatccacccacctggcctcccaaagtgctgggatttacaggcgtgagccaccacacctggccatgtttactttcttccctgacaatacaagggcctcagaatatcttaattccatttaccctcaatctctactaacttaatgttgtatattttaatccttcatatatttttaaatccataaaattattttattgtcttttgaagacaatacctattaacaccactttctttgcccttcatataatcttgcagctctacgttaatctgaggtcattttatttttgcctaaagtacatacatactttacagtttccctttgtgaaggtctgtaaatgtttttattttgccatcattcataaaagatgtttctctgaggatagaattataggttggcaattaatttctctcagcacactgaagacatttttccaccactgttctcaggaagctgccagtctgttactttaacaaaagtacagatgttccttaacttacaaaggggctgcatcccaataaacccattgtaaactgaaaatatcctaagttgaaaatgcatttattggccgggcgcagtggctcacacctgtaacctcagtactttgggaggccaaagtgggaggatcatgaggtcaggagatggagaacatcctggctaacacggtgaaaccccgtctgtactaaaaatacaaaaaattagctgggcatggtggtgggcgcctgtagtcccagctacttgggaggctggggcaggtgaagggtgtgaacctggaaggcagagcttgcagtgaaccgagatcgcaccactgcactccagcctgggcgacagagcgagactccgtctcaaaaaaaaaagaaaaaaagaaaatgcatttattacccctaacctaccaaacatcatcgcttagcctagcctaccttagacattatcagagcacttacattagcctacagttgggcaaaatctttgaacaaaaagtctattttataataaagtgttgaagatctcatgcaatttattaatgctctgctgaatgagtgtcactttgcatcatcacaaagtcaaaaaatcataagtcaaaccattgtaaattggggaccatctgtaatctgccttttttcctctggctttttctttctaaatatcactattgagtcttggtgtggaattatttttatttatccgcttgaaatttgccaagcttctgctttcggtggtttggtatctttccaaaacaatcatttcttcaaatactgtctctgctctattctcttttacctctctcttttgagattctgattaaatgaatattaggccctctcctagaatctaacagtctttcctgcacctccgatctttttctctctgtgcttccttcaggataatctcttcagctgtacctttcatttcataaacgctttttcagccatgtctaatgtgatgttaaacacaataattttgattactgtagttttcatttccagaagttgtgtttaaaaaaaaaatggttgtatcggctggtcgcggtggctcacacctgtaattccaacactttgggaggccaaggccgggggatctcctcaggtcaggagtttgagaccagcctgaccgacatggcaaaaccctgtttctactaaaaatacaaaattagcctggtgtggtggtgcatgtctgtaatcccagctacccgggaggctgaggcagaagaattgcttgaacctgggaggcggaggttgcagtgagccaagatcatgccattgcactccagcctgggcaacaagagcgaaactccatctcaaaacaaacaaacacaaaaacctggttatataactttttttagtgtccttttctccgcagatatctccatacctgatttttttcaatttgatatgtatagtttttaaaaataacctgtgtgataattctaatgtcttctgtctttgaggttctgtctccattgtctattgttcctgtttcacctggttatctttgactacgtactagctattatacaaaaaaattatttgaaggatcatttgaagcctagcttgaaagtgccttcctttacataggatttgcttttatttctggcatgtctgggatcaccataaaccaagttcaatgcctgaggtttcctggagggctggggtattcaaactgcaattcaagctgcaagtacttgtgagggctcacctacttgtaattcatgttcacctagaagctgtagtcctttggggaatctcagcttattgtggagagggtctactgttacactccctattgtgagtggccctgagtgttgatttctgtctcccttgcctccactaagctctcaaaaccagttgcaaatttggctgatctagtgaatactctcaggatacaggtggctttgtactcatttacctgtctgggttttcattttcccatcagtctcttcctggtaattccttactgtcacaccaactcttagaaggcctttaaagactgtaattatttagtatcagtttttacgttgttttcaggggaaaagctggtccaaatgacctagcccaccgttactggaaataggaagccaaatgtctttcatggcatacagtaggcactcaataaagaatggctgaattagttgaattatcataatttaccaaatgatatggtttggctgtgtccccacccaaatcttatcttgaattgtagctcccacaattcccatgtgtcatgggagggacctggtgggaggtaattgaatcatgggggcgggtctttctcatgctgttctcgtgttagtgagtaagtctcaagagatctaacggttttataaaggggagtttccctgcacaggctctcgttctctcttgtctgccatcaggtaagatatgcctttcaccttccaccgtgattgtgaggcctcctcagccacgtggaactgtgagtccagtaagcctctttttctttatgaattacccggtctcgagtatatgtctttatcagcagcatgaaaaaggactaatataccaaacatgcacctttttttttggatctgtctttatttgcagaggctgtttcctactcttaggatatacttctctttccctacacccagcctgagaatgtccacattctaccattggaccaggctcagaacaaatgttaccttttcctcaaagcttttcctgttttccctccttccccaaatctgaatcctgtctcttccttctctaaaccctcatgagacctagtgtgtatcgttctctgggtacttaactagatagcaatgtattcatacatgtgtttatctcgcctatggatttatacattcttgtcatttttggcttctgaagaaacccctcacttgctctccaattcagcataaattacaaacagatttctgaacatattatatatctagtgcttttagttttggtctacttggagaagattctatgaacacttagtctgccatattgcaggaagttgaatttcatttattctaataaaccttccattcgtaccgcacttcagagttaacagggtgctgtcatacatgtgagtttctgtaaactttagcagcctctaacttcagtgcatatcatcatgctgcagatgagaagtagaggacaaaagggactaaataatatgccagagcagagcctcaaagccagaaatggaacccaagtcttttctctccaagcccagggctcacttggggacaccacaggtgctgcacgtatgatatgtgccgctggtcattactactgcaaccacacctgggaagcagacattctgtacaggaaagtacatgtggcaaaggagttaggtcgcaggaagtggacggaggggtgggctacatgaggttccacgtatgcaattctcagaaggttctgcatattttaatcctacttacctcaccactttggtcccatttctcacgacctgcatgtccaccatgcagcccccggtcacataggcagctaggttcaactctgagaattcagcctgaagaataaagcaaagcaaaaaaggattcatcaaataccaacggtggtaacaacggttaacacatattgggtacttagaggtacaaagtacacctttaaagctcccctcaaacttaggaagttgccgatattattttcatctttctttttgaaagatgaggaagctgaggctctaagaggcctggtggcatgtccaaggcagcacaattaatacaaggccaaactggattgaagcccatgtgtctctgattcaaggacctatgcttttaatccttgctaatttctgcctctttgaaggtggaagaggcaattccagctccaagaccagaacatgccagatgctgtttgatgggacattttctctagattttctcaccttcatgctctacagtagtatggcatcatgactctgcagatgctgtttgatgggacattttctctagattttctcaccttcatgctctacagtagtatggcatcatgactctgcagatgctgtttgatgggacattttctctagattttctcaccttcatgctctacagtagtatggcatcatgactctgcagatgctgtttgatgggacattttctctagattttctcaccttcatgctctacagtagtatggcatcatgactctgcagatgctgtttgatgggacattttctctagattttctcaccttcatgctctacagtggtatggcatcatgactcggtgattatttctctctattaacggacccaccccccaccctggtcatatgcccagttttcttctcttggtaatggcccctcctcttgctccatccatctggttacagcagcagcaccatgtttgttcattgacatactgcccttttggtcacagttgatggggtaagcatctgactcggggtggaagaatgagatactcttccctgagagtttgaaactgatgagtgagtcatgcagtttctttctaggtggttgtatctttaatgcacaaaccatgttttctgtcatctgcactggcaaagcacagaaaaccagggtggagagagacagagagagggaggaatgtcacagtcaccaagagaggggcaggggcaagagatggggatgtttatgtgccagctacagacctacctttggattttgtgagttcatcttttgggttgcctatttgtttaaatgagctttcatggatttctgttgcttacaaccagagtcccatggaatacatccctcttaccagatgacatgctccctgggatttctcactataaccacctgtcttagtctcccaaggctgctgtaataggtggcttaaacagcataaattcattctccacagttttggaggctagaagtccaaaatcaaggtgctggtagggctggttcctgctgagggctataagggaaggatgtgttccagacctctctctttggcttgtagatggccatctgctccctgtgtcttcttacattgtcctccttctatatccaaagctcctgttcttataaggacaccagtcatatacactaccctcactttaatagcctcactttaacttgattacctctttaaagaccctatctccaaataaagtcacattctactgtgggttaggacttcaacatatgaattttgggggtgacaagtcaacctataatgctatcggctaaaatgcatagcaccaaactgtgccttatacacagtagatgccaaaagcaatttctttgggtttaatggataaacataaccactcacatgtatgaagcactcactatgtgccaggtaccggcctaagcattttacacatatgaattcatttaatcctcatgcttgtccagatgaggaaatggaggcagaaaaagatcaaataacatgcacagcatcatatagtaggtagcagagctggtattcaaacccaggcggtgtggcaccagggcctgtgtttttgttgttgttgttgttttcagacagagtttcactctttcacccaggctggagtgcagtggctcaatctcggctcactgcaacctctgccttccagtttcaagcaattctcctgcctcagcctcccgagtagctgggattacaggtatctgccaccacacccagctaatttttgtttgtttgtttgttttttagtagaaagggggtttcaccatgttggccaggctggtcttgaactcctgacctcgtgatccgcccgcctcggactcccaaagtgctgggattagaggtgtgagccaccacgctcagctggccctgtgcttttaactgccacactccatggcccccactgttcagctgaatgaggcattaggtggcttataactgggaattttagggacctaaaaacaacccatttaaagaaaaaagtttacattgaagggaaatatcatttcatggcaacttaactgtatctccttggagtcatttaacaggaattatgaccaaagacccagccatctccccagatagcattagagcaaaccgggagtacttacgcctcttgctgtaattaataacctcattatgctgtggcaaggcgaaaagatcactgtgaatgagtccaggttagtaaatagtggtaatggcctagttattaagtttaatgccttaaacattcagtcccatcatgttcaagattcttagttggcaaggtcacaaagaagaattaagaagaaaagttgttgcttatgtgcgcagataaaaagacattagaagaaagttgcaaaacaggatacctggtcaccaaatatatgcagagagggagtgaaacagaatcttggaagatagaatctctgactcaaaagtggcaaggacccaagggctgtctcgctgcccaaatggaaagagagatacctggagagaagtcacactcaggcttggatgtacaagttagaggttcatcttgttcagatgtgggtgtctagagttatttctcagttgtggtttatgaataattacaggagataactgcctgggttgcaaggtagccagcttccgtgggatcaagcagaaaggtggcctagcaaagtaaaagggcattcttctgttatttaactgtctaaaaccttcagcaccatggaaatgaacacagaggtgtccaaaccaccttcccttcaagatagcttgatagcctttctggtagaatatgaaagagcagccatttggaagactctcatgaaaattgtagtgaattgaattgtattcctcaaaaagctatgtccaagtcctaacctctgatacctgtgaatgtgacctctttgggaactagggtcttttcagatgtaatccagttaaggatatcagatgaaatcatcttagactggtgggagttgcgggggaggcacactaaatccactaacaagtccttagaagagaagagacgaggaaaagacagaaagacacaggaaagaagatcatgggaagatggcagcagagatggagtgatgctgccacaagccaagaaatgctgagagtcactagaagctggaggagccaaggaaggtctcccctggagccttcagagggtgtgcagctctgctgaaaccttgatttgggaattttggcctccagaactggaagaaaataaatttctgttgttttaagccactaagtgtatggtaattgtggaacctagcaaattaaaataataactttgggaattgaatgcaatttcagtatcatattcaaagtcaccagggctcgaagaaggtcaatgtggccaggtaaagctcctttattcacttcaccaaaaacatgcgcatagaaatctgcacctagactcattctctctctctctttctctctctctctctctctctctcacacacacacacacaaaataacaaattagttattcacctatatcgcaaaaaacgctactatcagaattacttaaatattctgcatgagctaaccttttcaccacaaattattttgacctctaaggcttttggtatggtatttttttttttttttttttgagatggagtttcactcttgttgcgcaggctggagtgcaacggcgtgatctcagctcactgccacctccacctcccaggttcaagcaattctcctgcctcagcctcctaagcagctgagatcacaggcacccgccaccgcgcccggctaatttttgtatttttagtagagacagggtttcaccatgttggccaggctggtctcaaactcctgacctcagggcgatccacccgcctcagcttcccaaagtgctgggattacaggcgtgagccactgtgcccagctggtgggataacattttaatactacacattaggcactgtggtatggacaaatgagtactcagagagactacattcacatgtaagctgttcaatatactagctgatgagtttagtgaagttactgatttgaatatcaattttgatatctttaaaacagaggtaatgatatcaataatatctatctttaaatgtttttgtgatgattcaagacaatgtatatgaaacatccagcacagggctgagactcagtaaatagttgccattattattttcaaatattccattgtcttagtaagcttaaactgaaagcatccaaactggtgtaccctgaaaaagaacaactccttcaagtatttataacatatacatttaaaaaatatatggaggtgtgaaatgtaaagacttctgcatatggcaacaatgaagtaccagagattacatatacactcccatcttaaacaacaataaagccagacaaactgcattacatatcagttttcaggaactagacaacaggcatttcaggactatgattcctgtaagagggaacaaaattatccctatgtttatcctagcttactgcctagaggcagtttccaggcagcagaacagcatgggagaaggcagagttcatcagtttcactgagttaaggatacaaagattgaagttcagggtagccatggcagctaaaatttgcaggacagagtataggaaaagatgaatctgcagagaaaaaataaaacaaacaaacaaacaaacaaacaaaaaacctcacaaactccagggagatctatgtctttcgctgagtaactaatttgagcatacatgaaaggaaagtaatcaaggccaggaaaaagccattaggaaacaatctccagaatccacagagctgggaagaacccatgtgctcaccagctagagggtaaagaccttgtcaaatgggtaggttactcaaaatttcatagtgggactgaattatccctggccaacagcatgctctggatctaggacgaccagtttgtcccggtttgccttgggctttctcagctttaaaactaaaagtcccatttctcagaaactcttcaatcccagttttacagtgaaagtcccatgtcttggaaaactccttaatcccaggcaaactagaataatcaatcactccatgtagatctgtcccaagaaaagcttaaaaccaagtcttgaatggatcaagtttattacaagtaacttaactgcatctcagaaaaaactaaaccactgtttaaaggaatctaacaaaacccagcacccaacacatcacattcacaatgtaaaagtagtgacattcaatcacaaattacgaggaatgcaaagaagcagaagaatatgacccacaacaaggagaaatcaacgaatagaaacagacgtggaaatggagagatgatgggaagagcagaaatggaagttaaaacaactgttataaagaggttctcaagaatgtagatggaaacaatacaatgggagagaaagaaacatattttaaaaattaaaaatgaaacttgtagagataaaaattataatatctgaaatagaaaatgcaccgctaggcttaacaacagattagacacttgtatcagtctgttctacactgctatcaactacctgagcctaggtagtctataaagaaaagagatttaatcagctcacagttgtgtgggctgaacagacttctgcttctggggaggtgtcaagaaacttacaatcatggtggaaggccaagggggaagcaagcactatcctcatatggcagagaagcaggagagagagagagcaaagggggaagtgctacacacttttaatcaaccagattttgtgagaactctataatgaggacagcaaggcggatggtgctaaatcattagaaaccacccccatgatccaggcaccttttgccaggccccacctccaacagcggggattacaattcaacatgagatttaggtggggcacagagccaaaccatatcatgctgctgaaaaaaatgctagtgaacttgaagagaaaacaataaaaacaacccaaaatgaagcacagagacaaaaatacacacaaaaaaaagcaaagaaagaaaaagagagcagaacctcagtgagttatgggataatattaaatagtctaatatatgagtaattaaagtctcagtaagagaagaggtagggacagaaaatttaaaacaaaatggccaaagtttttctacatttaatgaaaactggacctaacaagttcaatgaatcataagcagaagaaacaaagaaaataaacagcaggacatagaataaccaacttattaaaaaccagtggtgaagagaaaatcttcaaagcagccaaaggggggaaaatacattttatataaagagaaacaaagataagaatgataaacagcttcttgtgagaaaatagaaaaccagaagatagtagtaaatcttccttaaagagctaaaagaaaaagaaaaccaggctgggcgcggtggctcacgcctgtaatcccagcactttgggaggccgaggcgggtggatcacaaggtcaggagatcaagaccatcctggcaaacacggtgaaaccctgtctctactaaaaaatacaaaaaaattagccaggcgtggtggcgggtgtctgtagttccagctactcgggaggctgagacaggagaatcgcatgaacccgggaggcagagcttgcagtgagcagcaatcgcgccactgcactccagcctgggcaacagagtgagactctgtctcagaaaaaaaaaaaaaagaaaaagaaaaaggaaaagaaaaagaaaaccaaccaaaaaacaactgtcggtatggaatattatacccagtaaaattatcttttaaaagtgaaggcataggccaggcacagtggctcatgtttgtaatcccagcactttgggaggccaagacgggtggataacctgaggtcaggagttcaagacgagcctggccaacgtggcaaaacctcgtctctactaaaaagacaaaaaatcaacaaggtgtggtggcacgcacctgtaatcccagccacttgggatgctgaggcacaagaatcacttgaacatgggatgcggaggttgcaatgagcagagactgcaccactgcacttcggcctggacagcagggcaaggctttgtctcaaaaaaaaaaaaaaaaaagtgaaggcacaataaagacttttccagacaaagaaaaattgaatttattataagtccaaaatgtgttaaaggaagctcttcagacagaaggacaatgataccagatggaaatttgtaccaatacaaaatgaagagttctagatatggtaaatatgtggataaatacaaaacccttatttttcagtttaaaaatatcctataaaagattattaactgtttaaagcaaaacattgcaggcatcatgggagtttataacctgtagaagtaaaatgaacaacaacaaggacacaaagaaagggaatgagaaatggaaatatactgctgaaaggttctcacagtatatgtgaagtggaataacactatttgaaggtaaatgatgatgaggtaaggatgtacattttaaaccatagaacagtgccttgaaaaggaaatatagataaaataaataaagtatacaaattttaagtttatagcttgatgaattttcatttatttatgctgtgtaatcaatcctcagatcaagatatagatcatttctagaacccctgaatcctccctcatcctcattccagctgatctcacccccacaccatgatgctaccattttaatgtcttctatctcatagattagttttacatgttcgtgaacttgctataaatgaaatctcacagtacatgcactttggtatttgccttctttcatatctgtgattcatccatgctgctgtggttagcagcagtcattcttttttaatttctgtgtagtatttcattgtctgaatattcaataatgtgtttatccattctgctgatggtagacactttaactatttctattcatcagctactaagaaaagagctgctatgcaccttcttatacatctcttttggtggacatatacattcattttcctgggttatatacctagaagtggaattgctgggtcagaggataggcatacaggatttagaagatacagatggagaattttcctcagtggttttgccaatttacataccgttagcaatatgagaattacagttgctctgtgtctttttcaacacttagtattgtcaaagtttttaattttagccattcttcaggtgggttgtgtagtaatagtacattgtagttttagtttacatttctctgatgattaatgatactgaccactttttcatgtgctaattaacaatttaggtaatttcatttggtgaagtgcctgttcaagttttttgttcacatttgtattcttgtttgcatttatcttattaatttataaaggtatctcaaaatatattgtagatatgagttctttgctggatatattcatttggaaatttcttcttccattctgtggcttgtctcttaactttcttagttttttaacgaagaatatatttatgcacacacatatgtatatatgaagtacaatttagtattttttttacagttagtgtatctattgtctttagcttaaaaaatgtttgcctatcccaaggtcatgtaggcactctcagtgtttcctgctagaagcttctctgttgagtatttcacatttacgtctgtaatccacctagaatttttaaatatatactatgtgaggtaggaccgaaggttcaatttttttcatatggttattcatatactttggtaccatttattgaaatgagcactctttctcaatagaattgcattggtacctttgccaaccaccaagtcacttcataggtggcagtctatttctaaattctctattttattctatttatcaatttgtctatcctgtttcaagttgtcacaattaatgtagctttacagtgagtcatgacatcagatagtataatattctaagacagaagtgacccaaacaagccccagtgatgacaggagcaaaggcaagataggatgaccatcctctgtctccttaacctactgatcagaaaaaaagttgtcttatttgctcactgcaaaatacacatggacactggtcaatcatatgacctcaaaggctctgtcctgaataaactgattagatgtttccctagcaatatgattgactagacagaatgtgttctactattccttgctttgcaaccaacccaccattgcagccagacctctcaaagacctcctcaacgaaaccctcacttatcttaaaggttaaaaaaaaagttttattaattaaaaacaaaaaaatccacaattcttaacagcttgttagtatggtcagctggttgagagggtaataaatggaggagaaagcacatctattcttttagatcatcacctatactgaggaccggcacttatggcaactcactattgacatgctcacacacctctaaaggtttctctttgctttataacgaactttcacacttcagcatatttctaaacattctttaacattttaacttcttttccaccttgttgaaagcttgagcccactctctcatttgtattattttttgcgcatttgttgctagccagtgcatttttaaaaatttctttcccgggccggttccaagatggctgaataggaacagctccagtctacagctcccagcatgaacaacgcagaagatgggtgatttctgcatttccaactgaggtaccaggttcatctcactggggtgtgtcggacagtgggggcaggacagtcggtgcagcccaccgagcgagagccaaagcagggcgaggcatcgcctcacccgggaagcgcaaggggtaagggaattccctttcctagccaagggaagccatgacagacaccacctggaaaattgggtaactcccaccctaatactgtgcttttccgagggtcttagcaaacagtacaccaggagattatatcctgcgcctggctcagaggatcccacgcccacggagcctcgctcattgccagctcggcagtctgagatctaactgcaaggcagcagtgaggctgggggaggggcatccgccattgctaaggcttgagtaggtaaacaaagcagccaggaagctcaaactgggaagcccaccgcagctcaaggaggcctgcctacctctgtagactccacctctgggggcagggcatagccgaacaaaaggcagcagaaacctctgcagtcttaaatgtccctgtctgacagctttgaagagagtagtggttctcccagcatggagtttgagatctgagaacagacagactgcctcctcaagtgggtccctgacccccgagtagcctaactgggaggcacccccaagtaggggcagactgacacctcacacggccaggtacccctctgagacaaagcttccagaggaacaatcaggcagcaacctttgctgttcagcaatattcgctgttctgcagcctctgctgctgatacccaggcaaacaaggtctggagtggacctccagcaaactccaacagacctgcagctgagggttctgactgttagaaggaaaactaacaaacagaaaggacatccacaacacaaccccatttgtacgtcaccatcatcaaagaccaaaggtagataaaaccacaaagatggggaaaaaacagagcagaaaagctgaaaattctagaaatcagagcgcctcttctcctccaaaggaacgcagcttctcaccagcaatggaacaaagctggatggagaatgactttgacgagttgagtgaagaaggcttcagacgatcaaacttctctgagctaaaggaggaagttcaaacccatcgcaaagaagctaaaaccttgaaaaaagattagacaaatggctaactagaataaccagtgtagagaagtccttaaatgacctgatggagctgaaaaccatggcacgagaactacgtgacgaatgcactagcttcagtaaccaatttgatcaactggaagaaagggtatcattgattaaagatcaaatgaatgaaatgaagtgagaagagaagtttagagaaaaaaagagtaaaaagaaacgaacaaagcctccaagaaatatgggactatgtgaaaaaaccaaatctacgtctgactggtgtacctgaaagtgactgagagaatggaaccaaggtggaaaacactctgcaggatattatccaggagaacttcccaaacctagcaaggcaggccaacattcaaattcaggaaatacagagaacaccacaaagatactcctcgagaagagcaactccaagacacataattgtcagattcaccaaagttgaaatgaaggaaaaaatgtcaagggcagccagagagaaaggtcgggttacccacaaagggaagcccatcagactaacagtggatctcttggcagaaactctacaagccagaagagagtgagggccaatattcaacattcttaaagaaaagaattttcaacccagattttcatatccagccaaactaagcttcataagtgaaggagaaataaaatactttacagacaagcaaatgctgagagattttgtcaccatcaggcctgccctacaagagctcctgaaggaagcactaaacatggaaaggaacaaccggtacatctggcatgaaaaaacatgccaaaatgtaaagaccatcgatgctaggaagaaactggatcaactaacgagcaaaataaccagctaacatcataatgacaggatcaaattcacacataacaatattaaccttaaatgtaaatggactaaatgctccaattaaaagacacagactggcaaattggataaagagtcaagacccatcagtgtgctgtattcagtagacccatctcacgtgcagagacacacatagactcaaaataaagggatggaggacgacctaccaagcaaatggaaaacaaaaaaaggcaggggttgcaatcctagtctctgataaaacagactttaaaccggcaaagatcaaaagagacaaagaagaccattacataatggtaaagggatcaattcaacaagaagagctaactatcctaaatatatatgcgcccaacacaggagcacccagattcatacagcaagtccttagagacttaacaaagagacttagactcccacacaataataatggaagactttaacaccccactgtcaacatcagacagatcaacgagacaaagttaacaaggatatccaggaattgaactcagctctgcaccaagtggacgtaatagacatctacagaacactccaccccaaatcaacagaatatacagtcttctcagcatcacatcacacttattccaaaattgaccacatagttggaagtaaagcactcctcagcaaatgtaaaagaacagaaattataacaaactgtctctcagaccacagtgcaatcaaactagaactcaggattaagaaactcactcaaaaccgctcaactacatggaaactgaacaacctgctcctgaatgacatgatcaagtgggcttcatccctggttgcaaggctggttcaacatatgcaaatcaataaacgtaatccagcatataaacagaaccaaagacaaaaaccacatgattatctcaatagatgcagaaaaggcctttgacaaaattcaacagcccttcatgctaaaaactctcaataaattaggtattgatgggatgtatctcaaaataataagagctatttatgacaaacccacagccaatatcatactgaatggacaaaaactggaagcattccccttgaaaactggcataagccagggatgccctctctcaccactcctattcaacacagtgttggaagttctggccagggcaatcaggcaggagaaagaaataaagggcattcaattaggaaaagaggaagtcaaattgtccctgtttgcagatgacatgattgtatatttagaaaaccccatcgtctcagcccaaaatctccttaagctgataagcaattcagcagtctcaggatacaaaatcaatatgcaaaaatcacaagcattcttatacaccaataacagacaaacagagggccaaatcatgagtaaactcccattcacaattgcttcaaagagaataaaatacctaggaatccaacttacaagggatgtgaaggatctcttcaaggagaactacaaaccactgctcaacgaaataaaggaggacacaaacaaatggaagaacattccatgctcatggataggaagaatcaatattgtgaaaatggccatactgcccaaggcaatttatggattcaatgccatccccattaagctaccaatgactttcttcacagaactggaaataactactttaaagttcatatggaaccaaaaaagagcccacactgccaagacaatcctaagcgaaagaacaaaactggaggcatcacgctacctgactttaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctatttaataaatggtgctgggaaaactggctagccatatgtagaaagctgaaactggatcccttccttacacctcatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaacattgacaaatgggatctaattaaactaaagagcttctgcacagcaaaagaaactaccactagagtgaataggcaacctacagaatgggagaaaatttttgcaatctacttatctgacaaagggctaatatccagaatctacaaagtactcaaacaaatttacaagaaaaaaccaaacaaggcgatcaaaaagtgggcgaaggatatgaacaaacacttctcaaaagaagacatttatgcagccaacagacacatgaaaaaatgctcaccatcactggacgtcagagaaatgcaaatcaaaaccacaatgagataccatctcataccagttagaatggcgatcattaaaaagtcaggaaacaacaggtgctggagaggatgtggagaaataggaacacttttacattgttggtgggactgtaaactagttcaaccattgtggaagacagtgtggcgattcctcaaggatctagaattagaaataccgtttgacccagccatcccattactgggtatatacccaaaggactataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaaggatgagttcgtgtcctttgtagggacatcgatgaagctggaaaccatcattctcagcaaactatcacaaggacagaaaaccaaacaccgcatgttctcactcataggtgggaattgaacaatgagaacacttggacacaggaaggggaacatcacacataggggcctgttgtggggccgggggagggggagggatagcattaagagatatacctaatgtaaatgatgaattaatgggtgcagcacaccaacatggcacatgtatacataggtaacaaacctgcacgttttgcacatgtaccctagaacttaaagtataataaaaaaaacttttttcccttatttttaacagaaaaaaagaccccatgccataatatattgctttagtaaatgaagatggctgcatgtaattctgattgttttaggggggaaaatagccatgttatacatttgtaggagattatgtctagacatcattaaggacaaataggttttaattctttggtctctagatgagggctatatataggcacagacagagctcttggtattttgctactcttgctaaactagctgtgagaggttttcaacactgatctcaatgataactgaacgtactggactatctgagcttttctgtttgtgtataactctttaaatatgtacttggaggaacgaataaatggtggaaaagggattggccttgaagtctggagatcagagatctaaatcttgaatttgacactgacccagtgtatggccttaagcaaacccctcacttcctctctgctcttaactctcttcatctttcaattaaagagctataattaattgaatcaattatgtccatggtctatttaactgttatatgttcatctttttctcaaccaatgtcccctaactgtcatcaaagaaatcatctattatcatggcatactttataagaaagaaatgccagccaagtaggaatattttttataagaaagctgttcattgttttatacccagctcctggcacacagtaggtattcaaaaatacttatcaccaaaattttttatattttacagatgaatggataccctcacacattaagcaacttgccttctgaaactgcattgccagggcctccagactgtgacaaggaggatgttttcaggcagagagcaggggaaaggctcaacctaagtttccaggaacaaaagcacaggtgagaatagggctatggggccaatggaatggtgaggtgtcgtttgtagctgggacatggagtatatggaagcacataatagaaggcaaaggttgctgggagaccagttcatgaagattttgagtgccctgtgaaggaacgtgaatatcattctacagcatattagtcttctattgctgccataaaagttatcacaaatttaatgccttcaaacaacacaaacttattatctcactgctatataggtcagaagtccaggttagcttggttggtttctctgttctgtgttgcacatggcccaaatcaaggtgttggccagctgggctcttattgcaaggctctgggaggaagccacttccagattcctccaggttactggcagaagtcagttatctgcaattatagaactgaggtcctcgtttcctgggagagactctcagctgcttagggctgtatgttttccttatgacgttgtactcccatcttcaaactagtaatggcacactgagtacttttcacttttcaaatttttattgacttcttgtctgccacatctccatctccagtatgagaaagttctctgcttttaaggacttgtgtggtttgatggggtctagttggatactgtagaatcctctcctgtcttaaggtccataactgtaatcacatctgctaagttccttttgaataacattttcataggttccagggactagggcatagacactgtagcgggctactaggaaacactaagggttgcagaggaggggagtaactcaattcctaacgacaaatatttatgcagcacattcgaagttccaggctctgttataggtgctagatataattggaatcatccattaagaaaatctctttgggccaggcgcggtggctcatgcctgtaatcacagcactttgggaggccgaggcgggcagatcacaaggtcaggagatcgagaccatactggctaacatggtgaaacctcgtctctactaaaaatacaaaaaaattagccgggcgtggtggcgggtgcctgtagtctcagctactcgggaggctgaggcaggagaatggcgtgaacctgcgaggcggagcttgcagtgagccgagatcgcgtcactgcactccagcctgggtgacagagtgagactccgtctcaataaataaataaataaataagttcctcggtatggttttgtgttttttcttcttatttcatgttcgttgagcttcttgggtttaaaatttccattaagtttggaaacattttttcattaaatgtttttcattaaatgtctaaaaaaaaaaaaaagaaagaaagaaaatctctctgacattctcctaggtcagaaggagatacaggttgaacattccttatctgaaatgcttgggaccagaagtgttttgcattttggatttgttttcagattttgaaatatttgcagtatatatacttaccagttgagcatctctaatcccaaaatccaaaatctgaaatgctccagtgagcatttcctttgagcatcatatcactaaaaattttggattttggccgggcacagcagctcacactgatttaatcccagtatcttgggaggccaaggtgggagaatcacttgaagccaggagtttaagacgagcctgtgtaacaaggtaagacccttatatctttttaaaaaattagccaggcatggtggtgtgcacctgtagacccagttaccagcggggggcgggggtgctcaggcaggaggatgcttgagctttgagttcaaggctgcagtgagctataactgcaccactgcactccggcctgggagacagagcgagactctatgtcaaaaaaaaaaaaagttttgggttttggagtattctggattttggattttcggacttgggatgcttaacctgtaagcacctgtttgtaattaaactcgtgtccagtttcaggaacacgcccacacacccacacacacgcatgcatgcgtgcacgcacacaggaatagagatggaatgcattcaatttcctgtagggtctttggctgcattttcaccggcactggcacctgacaagaaggtaatgccaagcagataatattactgaaagcacggggtattcatgtctagttactaataattgcatttgcgatgataatcatgttgatgacagaatggaaaatggtgattgtaatcatcatcataatactaagctgaagcatgttattaggccaacaggtcaataggaaagaagcagaaatcgagacatggacgtggatgactgactggaatgtacacaagaaaccaagaatgtgtgggaatgtgaaggtagcagctgtcagctttgaccttgaagcctgactgagggaggattgtgacacaacgagatgttgtccagagttcctgagaaaggcaagatgctggcagatagatttgtctggaatcccagggtgactgataagatactgggaattcctgtcagttggtgaagaagtatctggtccagactgtacccttaaacccaacccttaggcgtgttcccctgcccatggccttgggcacttgcatattttgcaggagaaacagagagagaaaaagagacagagaggagacagagacacacaggtactaagttcacaggaaaaagtcagcactctcagcacctctcctaatgctagaacaacttcagaccccgtggtctgttccataaggtttttcttactgcatctcataaagagaagcagttagtctactggtcaggaatcacaatgccacatttgctagtgggcagggtcatggccgggggtgattctggcctccacattctgcctctctgtagctacgtgtctgttgatctgggtggtcattgtgttaacttcctctttcctgctttttaagtcctgaaagatactatctttaagcattcatctttctctctgcaactctgacttccaatctatgagttggcagccataaactctaattcccgggagcttcttctgattcccaggaggcccggatgtcctgctattttttcatagttgtcattgtgaggccttgtgacttttgagtaagaacagccacatatctagttagtaacatccgcagatgaggtttggcttcaagggagggtaagaggttgcactgcttagttctaaagcctaaactgagggattcagcccagatttagcagaggaactaagggtagcgaacctggggcagctaacgctggactgtaatttcagtggtgatttgccgttcctcctttggttgtcagccatcttaggaacctataatgaggggtgtagcaggggtggtgctggtgattgtcaaggaaggattagggcattcctgagccctcttgcaaattatcatcaaaattctaccctaattcctagcagactgatatgtttactcttgggaatgaaactgtatcattaaattcctttaaaaaacatcagcagtctgcatgtattatgatcttcctcacttcctaaattctttcatagccaaagacactcattcaaaaaggataaacaatagcagtgataataaaaaggaaacacaaaccctacatgacttacaaggtctcacatgatttactctgatgcctccccccatccccctagttccgacttgctcagccattgccacactgtcaaacacaccaagcaagctccagcctcctgtccccaccaccaaagggcttccctgagccagcagcatggctgccttcctcaggccattcagagtccctctcagtggcgcccccagctgcatcctccctgcaaagcaccctgctgggttccacagccaatttccttgcttattcttccctaaagcactcatccctacgtgacataaagatttacgtccatctcaattaactattcaatggtctacctctctcactcaagtagaagctctgcagggcagagattttatctgctttgttcaccactctatctcagctcctaaaacagtgcctgtgctccgtcaatatcactcaatgaaccaatgcccattttgcagatgtcaaagataagacttaaggaagcacagagactgttccccaagttccaccctggaaattatgtcagctgggacccatacccaggccaacatgcttcacaagtgtgattttctggtgggcaggaggtgacatcaagtgcatgccagttatttgaggtgactcccgttggagtgtgcagagttgggccagctcggactcagtttgtggcctacagtcgcccttgtctttcaccttcccggtcttgtgcacaccagtttgcagcatctgtcagcgaagcccatgggccccctcccctcctccattcggcctcttctgactgctccaccgatggcagacacttggcaggtggcctgaggcctgcagtcagcaagaactgcttcctgtccacttcccggcacaggctgtatttttagcttgctggtcctgggggggatcagtgacttccttggctggcatctcagggctgagctctttcccaccagttcagactcaccttgcagacgaaaaaggctttgagagtctgcccactcacctagcagcccattccagatgaggaaatcttgctcagtagaagcactcggcatctcagtgaaggcctggcccaccagaaaaatcatagcatgcctgtgtgtgtgtgaatattgaatgagtgtgtgtgtgcgcacacgcatgtgaataatgtgtgtgtgggggggtgtgtgtgtgtgtggacaggcagggtggggagggataaacacattaaaaatgtccaaataaatacaaaaacacagaaaaaaaataaaataataaaaacctacattcctaaatgttcatgtattagaatattcaaaattaggatgggtttgccacattgtatttgaaaaatcagactggtctcagtggctcacacgtgtaacttcagcactttgggaggctgaggcaggaggattgcttgagcccaggagttcgagaccagcctgggaaaacatagtgagaccctgtctctacaaaaaatttaaaaatcagccaggtgtggtggtgcatgcctatcgtcctagttacttaggactcgaagcggaaggctcactcgagcccacgagttcaaggctgcagtgagctatgattgcaccatcgccctgcagcccaaggaacagagcaaaaccctatctcaaataaataaataaataaatagaatttaaaaataaaaagcagtgttttgcagtttacaaaatgtttgatgtaacataatgttttctggaatcagaacaaacgagtttgaatctgatctccacccctgccttgctgtacaactttgggcaagttagccttcttatgccttagtctctcatctgtaaaaagaggctatggtgccttcatagggcagttgtgagcattaaatgaattaatccacttgaaagctcttagcaaggtgcttaggcaaaaataaatgtgtaatgaatgttagctatcaaggttatactaattaatttgattatcacaacaacattgatagaagcatgggtattagcctcctcatagttgataagaaaactggagagcagagagtgttcaaatgacttggctaagatcacaaagctattgcaccagagagcaaggacttgaactcaggtcagtctgattctgtttgcatccatttattcatttattcatttaggacattcttattgagcagctgctctgccagggctaggggctggtgacacagcagtgaaagtaacagaaaaaattccctgtcctcaccttatattctagtgcagaccattaataataaatataaataatacattgggagaggaaagagaaacactggcaagaagacagagtgccagaagttgagttttgtgttaaataaaggggtcaggagaagaataaatttgatcagtgatatgagcaaagtgaggtagcaaaacctattaataaggggcgggggagggggctttccaggcagagagaccagcaggtgcaaagaccctgaggctggagtatatatacagaattcaaggaacagcaagaaaattggcgtgcctggaacagggctagtaaggtggtcaggaaagaagatgagatcagagaggggatgacggaccaggtcacagcaagggtttaggattttattctgcatgagatgggaagatgttggcatctttactatccttatcaccaacatcatcatctccactattgtcaaggaagataatggtggagatgattctcctcctcatccccctcctccttcttcatcaacatcatcacacttggcaatataagatgttagggagtcaagtttgagaaaaatcatcagttagatgtattgttctgatttttaaggaatttcttaatggcaaagttttgttcccaaaagcctagatgtacatttgctaggatcgaggtggggttctggtgactggaggccagaggaccaggcatgccctaattctgtcctgatagtcgccccttcctgctcagggttcctgagagagttgtacccacacccaacaaaacaaaacaaaacaaaacaaaacaaaacaaaacaaaacaaaacaaaaaccgcacctgagaatcaaagtaaaacatccattgccctttgccctatgccaggggagacttcaaggttggggagagcctttaataatgtccctaggacaggaaggaggttcatcgaaggggagaaaaaggggcctttaaggggaacaggatggtgagaccaccacagcttcatctctccccacctccagagcttttagaaggtcgacagacctagaaacaaattttgctaactgcaatgaatttttgctacctgcagtggatagggcaaatgttcagagattttaagaccacagcttagatacaaagaaaagaacagtggttaatgtttccttgacatttacgtcccattgctatgagctgggctccacatgcttagacaccattctgccaaatgctctgcaaagtgtgtgaaaaagtgtcctcgcagccctctggctctcctgatggatgggttctgggtgcattaagatcaagatgtggaagcacagtccattgttgggggctaacactcagtagtaccacagatgaaccagaaactgcaagaggaaagcagtcctgggaagagaggctgtttggggtaagaagatgctgctggagctgggcactgtggattctaattctgcagaccatagtgaggggacatattgaaggagctgaagcggggctggtacagttatatttctgtaaatgtttttttttttttccaaatggaaaactcaaagttataatgtgatgagaggaacatcttgttcatcaaagctctaagaaattcaaatgctttttccttttcttttttttttttcttttcattttaaaggtccaaaatctttctcaggattgtaggaaggaaaaaaggcactcagacttccttttctattctcattgctacccatagtgcagacctcgccttcttgttctagaactactgtctccctgtatctcatttaccctccatatgatccagtctgcacatccagggaacagccctgcacccccaggtgaggacctactacttcctactactgggacctccaagaatacggccacctttgaaccccaaatgcatagaccctgctgttcctatcacagctccagctaagcaccagacactttgaaaggccagcgggttcagcactcaggatgctaaatgctgcaaagaaaaatgaggcagataaagtgatggagaagtgtgcatggaagtgccatttcagatagggggtggggggcaagcatttctgaggaggtgacatttgggcaaagcacctgaatacagtgagggcatgagccatgcggacacctgggggatgaggggcccaggcaaaggccttgatgcacttgcttgatattttaaagatttttatgtttttcattgtggtaaattatatacaacataaaatttatcattttaatccttttttaagtgtacattttagtggcattaagtacattcatggtgttgtgcaaccaccaccgctaaccatctccagaactttttcattaccacttgtgatggttaatactgagtgtcaacttgatgggattgaagaatgcaaattattgatcctgggtgtgtctgtgagggtgtttccaaaggagattaacatttgagtcactgggctggggaaggcagactcacccttaatctgggtgggcaccatctaatcagctgccagtgaatataaagcaggcagaagaacatgaaaaggctagactggcctagcctctcagcctacatctttttctccatggtggatgcttcctgccctctaacattggactccgagttcttcagctttgggactcagactggcttacttgctcttcagattgcagatggcctattgtgtgaacttgtgattgtgtgagttaatactacttaataaattcacatatatatatatatatatataaaatctcctattagttctgtccctgtagagaaccctaataccgccccccccaaaaaatgttatacagaacctgtccccctcccagcccctactaactttttttttttttttgagacagagtcttgttctgtcgcccaggccagaatgcagaggcacgatcttggctcactgcaacctccacctcctgggttcaagtgattctcctgcctcagcctcccaagtagctaggattacaggtgcccaccaccacgcccagctaatttttgtatttttagtagagacagtgtttcaccatgttggtcaggctggtctcaaactctgacctcaaataatccacctgcctcagcctcccaaagtgctgggattacaggtgtgagccaccttacccggccacccctactaatttctatcctactgtgtctcaatagatttgactactctaggtacttcagattactggaatcatataacatttgtccttttgtgtctgacttctatcacgtaatatcatgttttcaaggctcatctatattgtagcatatgccagaattccttttttgaggctgaataatattctattgtttggacatagcacattttgttcacccattcatctgctgatggacatctgggttgtttccaccttttggctattgcgaaccatgctgctgtgaacatgggtgtacaaatatctgttcaagtccctgctttcaattcttctgggtaaattcccagaagtagaattgctggattgtacagtaattctacatttaatttttgaaggaactgccatactgttctccacagtggctgcctcattctacattcccacatcagtgcacaaaggttccaatctctccaccttctcaccaacacttgttattttctgttgtttgattttaaggaagagcaagacagcccgtgtggatggatcagagtaagccaggaaaatagggtcaggaacaaggtcagggcaggctaatcaggaagggcccttaggtattgggaaggactttggctatggcttggagtgagactggcacctctggagagatggttttctacccacagaggggcataatctgatttacaataaggaagttaagcccagtgcttttaactccagaagcacgagggctccaagattagcacaatcctcttttctcccaagctgcccaagggttaagtaaacgcaaacatgggtaaatgcagtgaaaggagatatttccttcccctggctgacacacctgatgcaggaagcagactcgtgctctctgggaatgagaggcctggccggacttgtgcttccacaagaaaatgaacatcgccgggatgcaggatggcttagcacttctcctgtgagtttctgaaagctaccgaacagcctaaggccccatctgttttcaatcttgttaaaagggcctcatgtgctggcgcctatttaaaataatgcacacatggagtttttaaaatgaagaagaaaaaagccccgcgctctccccaccggcacagcttatgtgtttattttggagcaagctttggagcaagacacagctaatttctcttcccgaggttgatttgcaaatccccataggcttttgctccaagcatttaaggcagcttggtatgaactggtcaccctttcaaaagtctgctgtgaaatatctccaagttaagcctaggctcaggaaaggagggagcccaagggccactttgctccttgcaaataggttgtttccctgatcccttttccctcaatagagactcatgtttctaaaggctgaattcctcttctcagatgctcattttcttccacaggggctaccgtggttccaccccagcatgactcagatagagcttcgcgctaacccaaacctaatctccaaaacggggactgcaagggacagtgtcagggaaaagaacccacctgtggcaaatgcattccgcatcaagaagcaaaggcaatgaggtctgtctgtccatattctgaggagcacagaggccctctgcacttctgagacaacaacatgctcaactcacaatgacattcacatgtccagtgtccacaaatagctgtaatggatcatttccaaccctgtaggctcagagaaaacatcccgtaaacgtagcatcacttccacaaccacatcaacagcagctccacacatctcagggacttcataaacgactccccctagacccagagcaagggaagtgcaaacaggatacaagcaaaacaggataagtgtgtccggaatggcctcccagtgattgctcacgtcgctttctgcatcttcacacttgagtggtagcaatacccaagggtggtgatgacaataattatcccagccagtacattagtaggagaagtagtagttggagtctttggagaggtagaaacaaaaatggtgatactagtagtaatagcactagatgtggtagctgtatgaatactatccatagttccagtgacaatataataattattacatactatatttgtattagatttaaaatctatcatagttttgttttttgtttttgttttagcacttactatgtgccaggcactagtctaagggctttgcatgtagtaatgaatcctgacagtaacctggtgagacaggccttattatccccactttagaaaggggcaccgaggcatgatgagattagtatgttttatgagatcacatagcagggaggtgacagaccaagtatgcaaacacgagtctgaatccaaggtccctgcttttgactgtttcactaggctccttccaacatgcggcaaagtccgagacaatgggagcagcaggacgatagaaccccagtgagggaattacttctcggaggggcacagtggctcacccctataatcccagcactttgagaggctgaggcgggtggatgacttgaggtcaagagttcaagaccagcctggccaacatggtgaaaccccatctctactaaaaatacaaaaaatagtagggtgttgatatgggttggctgtgttcccacccaaatctcatctagaattgtactcccacaagtcccagtgggagataattgaatcatggggttagttcccccatactattctcatggtagttgataagtttcacgagatctgattgttttatcaggggtttccgcttttgcatcttctgcattctgtctttgcttgctgtcatccatgtgagatgggacttgctcctccttgccttccatcatgattgtgaggcttccccagctacatggaactgtaagtccaattaaacttctttgttctgtaaattgcccagtctcgggtatgtctttatcagcagtgtgaaaacggactaatacaggtgtggtggtgcacgcctgtaatctcagctacttgggaggctgaggcaggagaatcacttgaacccaggaggcagaggttgcagtgagccaagattgcgccactgtactccagcctgggtgacagagtgagacactgtctcagaaaaaaaaaagaattacttttcaagaggcagcctaaggagaggcctcagacactttttttttttctccttgagactcggttgctcaggctggagtgcaatgatgcgatcacggctcactgctgcctcgacctactgcgctcaagcaatcctcccacctcagcctccccagcagctgggactacaggcgtgtgccacaatgcctggctaatttttaaaatttttttgtaaagatctcactatgttgttgcccaagctggtctcagactcctgggctcaagtgatccttttgccttggccttccaaagtgctgggattacaggcgtgagccaccatgcccaacttcagatacttttttttgaggctcaaagggttcaggaccttccagctacgcatcaaacagagcagtaattttaattttttaatctgcttaaatattgggttttacataaaatttaattggaaacaaaactgttctattttgaaaaaccgttagaaagcaacagtgtgctgaggctttggagttagacaggtatcataactatgtctttcattgtctgtattctgatgctttgacccctgggccttgctggccctggagggaatgcccttcctaggttagccaagacttggagataccaaagagcttgcctggagcacgccctctgaatgcaaaccaaccaacgcaggctcaacctcctctatatatggggctgtcacactgcagggcactgcccatctgccctgatcaccccagggataggcaccaggcaactagggacagcccctactctccaaggccggttgaaataattcaaactcaccaatcctaaacctgtttcccctgccttgctcactcctccccacaaattcacaataaaagctctcgcccacatctccctatcattccctctgtctacgaacaatcatggtgctcccctgtgccccccgcctgcatgtggcatggggtgctgtgcctcctccttctaggggactgtgagtgtaagagctccttccttcttgacagtcatgcatgtgactgcgcgtcttgcatgctcaactaaaacaaatcctggttatgtttaagacaacaggctctgaccagcttcccccatgcccctcaggactttcgacaggtgtcaggcctctgctgggttgccgggtacaaagcctgggacacactgaccagtgtggatcatgtcacaaacagtgctgagcgtggggtcagacggacctgggtttcaattgcatttctagaacttcctagctctgggatcttggggaaatcacaggcccttttgcctcagtggctctacctgtaaaaatagggcataaggtcctgaccctgtccctatcctgaggctgctaacaggaactgcaggagagagtgaaggtgaagtttctccagagtgaagcccacaccaccataaactgtctttagggtacccaaggggctccttgcacaaaggtgtgtttttgagttgttcggtctagaagggggtttctcaaccttggcgctattgacattttgagctatgtaactctttgttgcggaagactgttttgtgtattgtaggaggtttagcaacatacctggcctctgcccacaggtgtcaggagatctcccctgttgtgacaaccaaaaatgtctccaggcattgccaaatgtctcctgttggggggattggggcaaaaatcacccctggttgttagctactaatacagaagaggagacaggttaggctaagcgtatcttcctctttctagcatctctctctctctctctctctctttctctctactcttccaaggatgcccaacagttcacagagtacccaggtacctctgtggtaaagtagggctctaaggagcatggttggaaaatacttgtttcagtagacactctaggctagaaaaagtagagttgtgttgtcagtgggttttggtttcacccccatcatatatttaccaactgagctcatctcatgatccaaccactttatccataatttaccatcctgtttaagtagcctcgtagcaaccccacagaatgtgagaactgcaagttcttttcaggtcatccagtgggtttggtcttgctgccagctctggctgctgtgcagagaaagataatgaggccgcccctcagctgggctggaaggcattgccttcattgaacagcggagggccgggggttgcacatgctctgtatatttcccagttcctccttttacaaatgagtcaacttacatccaaagttcccttagtgttaactaaaacagaccaaattctcaacgtgtgctggacatagtagcattgcggttactagctccattctgtgaatagagaaacattagcttggaaccttgaaccactcccttgaagtcccccaggtaacaggaggcaaagccacgattcaagcccttgtccatctgatcccgggtacagctctgtccatcaaaccaaagtgtctcaaaatatggcttcttcctactgaggcagcaaaaaaatgttcctccacacaaataaaatactatagaggagtcagtgagaaggagcctgtttacttttagaatctctttttttttttttttttttttttttgagacagagtctcgttctgtcgccaggctggagtgcagtggcgtgatcttggctcactgcaacctttacctcctgggttcaagcaattctcctgcctcagcctcctgagtagctgggtctacaggcgcctgccacctcacccggctaatttttgtatttttaatagagacggggtttcactatgttggccaggatggtctcgatctcttgaccttgtgatctgcccacctcggcctcccagagtgctgggattacaggcgtgagccactacgcccagcctacttttagaatcttaatgtaatttcccattaaatacatgcagagaacagttaaggtaagactgaaaagaaacccaaagccacgcggaagcagtatgatggggagagcagatgatatctcaggaatgaggcggcgagttagctgtgggagtgaggaggacacagtgttttatagagcatgggcagcttgggagccagacggaagccagacagacaggagttcaaatcctggctctgccaattctaagctgcgttgctgggcctctctgaaccttagtttctttgtctgtaatagtaacaggtaactcacaagatcactgtaagcagaaaattgggttatagatagtaaagtcttggcagagtatcggcatctatctatctatctatctatctatctatctatctatctatctatctatctgtctgtcttacctacctacttatctacctatctctctctatatatatataaatatttatctatcaatatagataataatgactcttaaacaatttctctctatatgggtataaatgtatatatatagatttgtatatgtatgtatatgtatatatacatttatatagagagagggataaatggcttaagatattattattgtctctattattgacattacaaaatacttttttttttttttgagacacagtctcactccatcacccaggctggacagcagtgatgcaatctcggctcactgcaatctctgcctctcgggttcaagccattctcgtgcctcagcctccgagcagctaggattacaggcatgtgccaccatgcctggctaatttttttttttttttttttttttcagtagagacagggtttcaccatgttgaccaggctggtctcaaactcctggcctcatgtgatctgcctacctcagcctcccaaagtgctgggattataggcatgagccactgtgcctggcccaaaatactaaatttaatgaaggtgtttaggggaaggaaaacctagttctgaactgattagagaccgcaaaacagaagcctggagagttaggttctagagagatggagaaagcataagtatatggatggatggatggatggatgactgaacaaatggtcagatgcatagatattcattatatagaaataacacttttggacaccaacatgcagaacttgagggaaagccaccataaacaagaaaccttataaattaattatttgcctcctccaatgtctctcatggggaccactaagcagagagaggaaaagagaggtggtgagaaaacgaggctggtgccaggttaggaagggccctggtgctgcctaaagactttggccttcatcccatagacattgaggagcctgcaccgtggagagctaagggagccagtgagagaccaaagcaattgtacaagaataagcaaattaagacgagtaatcaaaatctggttctgtccaatgaatgcaaagtttggggtttctggcacttggctggcccagcaaggggaggttcaggcccctctgctttcccttgcttttcctggcagcactagagggggtgagccttcccgtctcctccctgtctggacagaaggcaggccctgaggtgggctgggtggggagggcaccagttcagttccattttaaacaggccaagaactcacccattagctcacgacatgaacctcagggctgttgcttagggaagaaaggaaggttccagcaacatggcttaagaactatcgcaaggacaaaaaaccaaacaccgcatgttctcactcataggtgggaattgaacaatgagaacacatggacacaggaagaggaacatcacacaccggggcctgttgtggggtggggggaggggggagggatagcattaacatgttaaatgacgagttaatgggtgcagcacaccaacatggcacatgtatacatatgtaactaacctgcacgttgtgcacatgtaccctaaaacttaaagtataataaaaaaaaaaaaaaaaaaagaaaggtcagaaaacccagagaggctgtctgtggtccctgagaacatggatctgaaaaattgctttaggctgtaagaagcaggtcatttttcaagtctggctgggcaacaggtgagtcaggggaaaacaggtagacacaggttatgatcacaattctgccactaactaagcaatgacctattcaactttgccaagcctcaatttcctcatctgaataataatgagccttacacctcaggagttgctgaaggacgaaatatgttgaaaagttaaacgcatgagggcaatgaaaagcacatcactgaactaatagtttattttccttcttgaccatatactcagaactccacaagtacaacccttgatgccccatgacagaacttagctccatttcctgtctggtgctgaccttttattattgccaagttcttccccttaggatgtctaaagtcagacttggcaaggaggagacaaaggcagatggtagtttgactctacagtaaccagcagcatgacccaagcaagaaactgcacctcgatcagtccccattcaacagatgagatagaaaggtggtcaatgcaggggtcagtggtatgggctctggagcatctgggtccacatctcagctctgccatctcctagctgtgtcgcctcgggcaggacacttaacctctctgagtctcagttccatcagtactctgtggggtggtgatgaaaattaaatgtatacagataaactgcttagaggatggcttgcacattgtgtaaatgttaatgtcaaatcttgctttacctgcactgtactatatcaatgatttatctgcatgattcctgcagggctaatgctttgtttgtgttgtttaccatgccaaaggctctttgggttcttgcagtagcctaaagcttttctctttagcttctttcatctttccccactctggataagtttgagaaatatatattgaacacagattaggtatctgggtccttggagcacctattatgtaccgaataagtgtcctgccagcctccccaccacagtctaccatagcactgtgtaccctactttcacggcttctaacagtttgtaattatggtgcgtacgtgtgtgtgtgtgtgtgtgtgtgtgtgtgtgtgcatgcttgtgtgtgtgcgtaagagagagagagacagatagataatatgattaatttctggcccctgccattagatgttaagttccatcaggtagagattccatctggctttttcgttgttgttgttgttgttgttttatgatggagtctcgctctttcgcccaggctgaagtgagtggcacgatctcggctcactgcaagctccgcctcccgggttcgcgccattctcctgcctcagcctcccgagtagctgggactacaggcgcccgccaccacacccggctaattttttgtatttttagtagagacggggtttcgctgtgttagccaaggtggtctcgatctcctgaccttgtgatctgcccgccttggcctcccaaagtgctgggattacaggcacgggccaccgcgcccggccagattccatctgtttttaatcaccattgtaacctgagcacgcagcacataggcagtcaatgaatatttgtggaatgaataaagatactgtccctgttcccaatgagcccagagtctacagggagcgaggggcaggtgaattagtaatctcaaagtcatctgggaagtgtgatgtagacacaggtatgaggtgctaggggagtacagggaagaggcacctcaccctgcctggatggagggggagggcagaggaagcagcacagacatcatgttggagctaatgttgaagaatctatggcaaaatctaagaaaggatgtcccaggaggagagacgtgcataagcaaaggcatggagatgtgactccaagatggtattaccatgggtgggcactggggaaccacagcagtttggtgagaccgaagtctaaggtagagcacgggaggagatgagcaaggaaaggcaggcaggggcaagctcatggagggccttgtgtgcagagcttgagacccccaaaacaagtctaatgcacaggtcagccctttatgcatgagaggaaagtgaccaagccttccctggattttactgcttcaggatacaccttcccagatgagccagcataaagattaagaaccataaacaggcagggcatggtggctcacacctgtaatgtcagcactttgggaggccaagctgtggggaccacttgagcacaggagtttgagaccagtctgggcaatacagtgagaccctgtctctacaaaatattttaaaaattagccaggtgttgtggtgcgcacctgtcatcgcggctacccaggaggctgaggtgagaggatggcttgagcccaggaggttgaggctgcagtgagccatgactacaccactgcactccagcctgtgtgacagagtgaaacctgtctcaaaaaataataaaataaaataaaaagaaccataaacacagattcttcagttaaactgactctgaattccagttctgccacttgtatgctgtgtggccttgggtaagcctcaggttcctcatctggagaatgggggaactcatagtacctgttcatcagagtcatgatgaggatgaaacacgctaatccatatgaaatgcttagcgtgtgcctgacacttagtaagcatgtgattagatactgcctatgatcattaattccttcagagcccaggctgtacagctgccatctgcctcaggcaccgccagtggaaactctctcaggtcaccctctaaaactccctgagatgagggggccaagactggaccaaaacgggtccagtttaggttgaattctattgtaaagtaaatagtgccttagaactactaaaatcctatgtgatactaaagatagacattgtagggcacataaactcgttctctgctatcagcctcccagctccttcctgagggactagaaaatgcgcccagactgtgtatgatccaaaggaagtcatttcaatgcctaagtcctgttgatatgtcagctcactcccctcctcaggagactctgcttagagtgggctgggagattccttagacaatctaatagattagtttccagtttagcataacagccagacagatttttgcagtgaagtcatccaagtcaattaaaaggcatttttccctgctgtgagttcagaagtccctttggttcattccagttttctgggatgtttcataataggttccaccctaggttaattaataacccttgattcccactgaaatgcaaaggctcaaatccactgtgtaagcacatccgggcagaggctgctggcagggctggggtgagcccagtgggggctcctctcatcagggagtgggccagaccccaaatggtacagacaacagcagagctggcagaaaatgtagagtagccacacaaaagctgaaggccacgctggagaagtggtgtaaccaggggcagtagcgcatggggagggagatcatcaacagatgaaggaatcacaaggctggggattaggcagattgggagcaagttgacatgtgcagtgtgaaacggcttagtccaagtggctggactaaggtggtgaacaagaggaggttggcaatggctcgctttcaagaaatgccagctgaaacacatcatgtgggtctgactccatcctctcagtcttaagaaaaataggtcatctcttctcctccagtttcaaatacgaattacaggtatgagaatggctcaagtggttaaggaacacagtggcgaggatgtacatgcattcacttaacacttatgaagtcccttccatgtgcctcctacccaagcatcatattcaaggatgagatgacttttgcaccaaatccagagctgagcttttctgcctccagtctcaagccaccattcctatccagcgaatcttctaagaccactgtcagcctgtgcattctaaaatgaaatcacggtcacagcactccatggcttaaaaagttcaatacatacatcctgcctctaggacacaattcttagttgcatgccttgcactaatagcccaccctgaatagactgccctccaccttctttgtcagcttcgtctcccaccaacccttctcatgcatggcataccctggtcatttgccctgtacgtgacaagctgagacttgaatcatgctctttagctagaaggcccaatgtgcacatctgcccactcaccctcacctaattcttgtccccaaacccagctgcacatcaggttctctgtgaggtctttcctgagaacatcccaaggttagacaaatctctacgatagagagatcctcgtcgcaacacattttggccactgccttcaatgtctatcttcccaccagataaagaaccctttgagtgtggagggctctgtcattaggacaaagtacagagcaggtgctcggtgagtgcttcttgaatgaaggaacaggttcagataagacaagctctgtttgttttgttacacatccttcaagaagtgaaagggcttactaagttctccttcagaatgtccacttaatttccactggagtctcatttatcaatggtactaacagggggccgtgctgatgctgatgaagtggtgtggcagtaaggaaaggtgaatttccaaacacagcagctaaaggccaaggaactgagctgggtttcccagtgcaagaggatggactccctttgactcccatgcctccttccttctcatctccagtgcaggtgctgaatggtgccaccaaaccaggatgctgtactctcctccagcagaaaagaagaggagagtctaaagggtcatgcaacgggcaacacagtccatgttgtgttcagaatcagcggggctcattcaaccttggtttcagcattccccagccctcgctgcttggagctctcctttggctatcagctatggttcagcactctatcctaggctcctcccaagaagaaggcttctcacaggtaaacgtgaaaaacataaacttcatttgtttttgctatttttttgcttgctattaaaaccatcagaagggactaatggcttcttaaaagggaaaaacaaaagatggcatgggcagggggagaaatgcagtgtgaaaagcagggacccaggagatgaaagctagtgctctccacactttggactccaacaataatttcacgtgtgtgctaagtcacttcccctctctgaacctttcagctgttaaacaagggagcaggattagataatctcctaggacactccctggctctatccttccatgactatgtcacaccttcaactcactcacgcattcactcaacaaacattcattgcattttttcttcaggtccagagtctgtgctatctactatcaaagagacgttagaaatggatgacaggtgccaactgaatgttgtatatcaatgggaactatgattgaacatatgtgtaaataatcaaaacacacacacaaacataagctttttatattttttatcccacaaactgcactgcaaacttcttcagtgcatggattatatcctttctatttctgaatgcttcaagagactgaagcctagaaactactcagacaaatgtgtttagtgacgtgaagctgatcataaaaatagttctaatatttattaagcactttctatatgctaggctctgcttcaagtgcttcatgcagtcttatagtaacttatttcagtctcacaactatatgcgcacttactattttatatgaggaaactgaggcatggggcagttaaattaccacctcaaggttactcaggaagtggtggggccgggattcaaacctagttgatctggcttgagagtccaagctattatactatccagacagtctaaagacatagagcttagctgggcgtgttggctcacacctgtaatcccgacactttgtgaggccaaggtgggaggatcacttgagcccaggaattcaagaccagcctgggcaacatagcaagaccccgtctctatttggaaaaaaaaaaaaaaagatatcacgccactgcactccagcctgggcaacagagcgagactccatctcaaaaaaaaaaagaaaaaaaaaggtaaagacggagagctacgtttaaagacaataatgaacatcagcccttgggggaaaacaatgaaaaaatatagaattgttaacagagaaactatgcaggaataagccagaaacatgaaatgatgaataataaccattggggttagtcaggaaaagaggactgttttgctgggaaaacacctcatatgaatttgtaatttacccagtagatcaaaagagtagggtgagataggaagatactgtgggatacgtactcaagctggaaggggaaaggcaaaaagctttgtaaagacaaattcatgaccagcatatattctgataaatgtactttgattaagaactaagaccttggagttagccagacctgggttcaaatcccatcttcactgcattcttactagctgtgtcacatgcctgggcaatttatttaagctctctgggtcccagtttcctcagcaacaggcatactgtgtggattgaatgagttactgcatggaaaacacttaatgcggcacctagcaaatagtaaatgttcaataaactttgcttctatcatcaatgttattgtttctccattttctgtagagttcttaagttgatgagcctaaaggtagacccaggaagctgataaacctacattaatcaatgccatggttaggaagggaaacactcacttctctaatgagttatgtttcagctaatgggccctagtattccacctgctttttttatccccccagctggttcttagatttgaaaagaaaaaggcctccatggagacctgcacgcttttaaaaataatacaaaacagaacatctgaggtcagggtaagccaagccaaacaaataaatcttgcaggattgtgttaacaaaacaaggcttagtggatcagagcgggtagagttctgtccgactcagtcctgcagagaaacaccaagctctggtgaatttcaaacacaaggaggtcaaataggaagatcaaattatggagcacttcagagttcagcatccatgcctgggctgtaaccaggaaagcattctgtgcaggatggactccagaactcacgggtcacgtacagtcctagaaatcgagaccagaagagtcttacggatgaattctatgtgacctctatggaaagtaattttgcaatatctatcaaaattataaatgtgttctcttaggttgggttctctggaaagcagaccctgggatggatattagcctggggggaggtttattagtgaattccctgggagctccatcactggaagggggaagaaaagaaaggaagcaggactgtgagaatttgggccacacagccgtctcagcagaggtctccggcaactctgcaagaagctctgaagccggacagcccttcagagttatcccaaactggggtgatggggacagggatttattatagcctctgacggccagtcattggatgtaactgccaccaggaaggagatgtgaccttggaagaggcagctctcctcatctgaggcactttcaaggaggaatgacagaggaatgaagaaaagtccttcattcctcaatgtgcattacagcatccaccacctgcaatgcttttggaacaagttatcctatttctagaagtgaatcctacagatcgattaataaatgtttgaaatgacataagtttagcattgtctataatagtaaaattatggaaaacaaattatggtgtatccatatgacagaccccaggccatccttaacaagaatgaggcaggtctgcatatactctcatggaataaactccaagaaatattaagtgaaaaatgagggtgcagtggagtatggataaggagaaaggcatgtgtagatgccaagtagccaaaggggtggactgtgccagtcactgtctattgccactcatccttctatagtctctcctgcactatgggagctgaaagcctaaaatctgcattccccagatccttttgccacataatttcagctcatttctaccaatgggaggcattcatgcaggaattgaaggtagaaagaaggcagcaacaattctgcttctagtggtagttacagaagcttcaccaacaactatagcagtttgaacaagtggtggcaattcctgtagcctcagtggaagcacaggtctggctaagtgcagtagcccacacctgtaatcccagcactttgggaggcccaggcaggaggattgcttgagcccaggagttcatgaccagcctaggcaacatcgcgatgccttatcactacaaaaactaaacaaagaagaaaaaaaaaaagctgggcatggatggtggtgcacacctgtggtccaagctacttgggaggctggagtgggaggatcacttgagcccaggagtttgaggctacagtgaaccatgattacaccattgcactacagcctgggtgaaagagggggaccctgtctcaaaaactaaacaaaacaaaacaacagcaacaacaaaaaagagcccaggctcctcattcctcagtgacaatagtgacagtgacaaacagtgaatgtaggactgttgtgcctctgggtaaaatgatttccccttttgatccatttgtaatcaatcctccttgttaaattccctctgaaatacatagcatggttgatgtttttctaaccaaccaccctctgtgaaaagcatatatatgtatttgctcattgcatttaaaacttctctggaaaggtgcccaagaaactagtgataatagttaagtacatggaagagaactagattggtgcgggcagagtgggaggcagacttttcaccacataccactgtgtagcttttcaatttttaactatttgaatatactacttttacccccgccaaaaaagaaaaagattaataaaggttatctcctataagcacattaatttcctgtgaaatattccccaaggtagccacccagtttctgccacagcatttccagcacaggaggcgccctacctacaaaaaaggcatggcccattccttattagttcagcactacttaacagtttctgtgtagaccaagttgaaatccatcttcctgtaggattgcaccaatagactgaactcgaactccagtgaaacaatagagggtgatacttagcacagaaacctgggttcagattcctcctctatcacccatttctgctgcttgtttaacatctctgagccccagcttcttcatctgctaaaagggacaaagtacccatcttttgttagtttgtttgtttcagacagagttttgctcttgtcgcacccaggctggacgatcttcgcccactgcaacctctgcctcctgggttcaagcgattctcctgcctcagcctcccaaatagctgggattacaggcatgcatcaccacgcctggctgatttttgtatttttagtagaaacagggtttcgccatgttggctaggctggtcttgaatttctgacctcaggtgatttgcctgcctcagcctcccaaagtgctgggattacaggcatgagccactgcacccaactcaaagtacccatcttaaagaggcattgtgaggttgaaataagattatgcatgtcaagtgctttaatcaatacttttgcttattgttcttgatatttacaacactggaagaaaaaaatatacagtggataagaagaggaccctgaagtcagactggctaggttcaaaaacagacccatgccacttattagttgggcaaccttgggcaagacacttactctctgtgagtctcagtttctgaaagatggaggtgataacagtgcctacttcacccataaaatgcattcagctttatctcataaggactcaacaaatggtaacttactttatcaaccatacttgttcaagaggtagatatttgtaaagagtagactgggacctatcagagacctttcttcctccggactaaacatctccagttccttaaacgaatcctctttccttattggccttagtttcccttactccaatcccttttcagaaggcattccaggttgctgcaacccccttccagagcaacacacaactggatctcttattagagtgtctcactagcattgtgtgtgtgtgtgtgtgcatgtaagagggagtgtatgaactatcaccttcctgcattctaactgctgtggtttgatagtgcagcctgaagtgacatcaggttttaggggagtagcaatctcaactgtagtttattgagcacctaatacatgtgccggaaacaaatgttcagcatattacattaactcattttgtcacacaataactctagggaataaaatttatttcatcattttcaggtgaggaaattgatttagagatgttttaggtaaaaagcaaacacagctaaaatatgactgagctgagatttcatcttcagtctatcttactctggagccacgatcttaacccctacaccgcatttcctcccacacatattaagctgtgctcaactcaaatgttaggtctttttcgtttttctcatgtgatgttaacaagataggtctccccagctgggtgcggtggctcatgcctgtaatcccatcactttgggaggctcaggcgggtggatcatgaggtcaggagattgagaccatcctggccaacatggtgaaaccctgtctttactaaaagtacaaaaattagctgggcctggtggcaggtgcctgtaatctcagctgctcaggaggctgaggcacgagaatcacttgaacccaggaggcagaggtggcagtgagcggagatctcaccattgcactccagcccagcgacagagtgagactccgcctcaaaaaaaaaaaaaaaaagtctccttaatcctgctccttcacagctgagtttttgaactcagcccatcagcttaaggtcgtcagtcatcattttttagtttttgcagagacagagtctcacaatgttgcccaggctggtcatgaactcctgggctcaagcagtcctgcctgggcctcccaaagtgctgggattacaggcgtgagctactgcaaccagccgaacctgcactctccctctcactgaggctgcaggaattgccaccaccgactcgactttatattgtattcctattcaatttgatcacatcaaatttaatctggcgtattctctctcccatctagtttaaagtcattagcaaatgtaatttcataagtcactagtaagaaggaaaacaaagccaaggacaagccttttggcaagccattagatttctcccaaggtgtatttatttctatcaagtaatcatttcctaatgaggatgatgttcaacctgttaccaaaccaccaaactgaattaacatccaacttacacttctctatcttgttgacaactgtttcttgaaatatcacctggtctttatggtcaatatctacagctaaggtccattctaagaaatgtcccagaaagaattgtgggttgaaggctgaagtgcatgtgagaaaatataaatacggggtctgaagtgtttaaaatattttaaggggaatatctcatctttccattcagaagacattgatgttaaatacataaagggcagaagatgaacaggtctcccaacagcagcctcccctggacagtttcctaaccccatcccaacccaatattacacaaggacagtactcaaaggagcaactagtattcatatgtaaatccatgggtcgttctggcttccttcattggattgggagttgctcaagggcagggtttataccttctcttgccttttgctccacctgctagagcaaggcattagtgttctttctgccttggtacctctgtcaacacggaggaaagactggccgtggtgatttcagtcttctcttttaaaaattagagactgaggctctaccctagcaagtcctagtccactgatgtcccagaactgtgagtctacttaatattaatccattcatcaacctcactgcttggtcccacagaggggtgacttgtgcctgtggagaaaaagaccctttgcctcaaatataaacagaggagagtttgacatgccaaccatcctggcctgatcctctcagaccctactaggatactgctgtgagggccccgcagagccagtagggcattctgggtaatagaatgcaaaatgtgctgtctcctccacgggcctccccagggtttcttgattcctggctctgtaaaagttgaggcaagcagtttttagactggggggaagaggatggagagaaggggcggaggcttcctctaggccaaccacaactaactcattcgctctgtccagcaaaacccagacagtgcaattatctggttaatttggcccttggttgggagacaggatcccaaaatgtgaggccagctcagactaaacagtggcttccgtcctgagacttttcccaagtgctaaaggatgcatgtgagattcctggggggggggttgcttgtgtgttccacccattgatacagatgggcaaagacaagtgattctgattccaagatggatttggaaaggtatgtctactggggaaaaatgcccaaatgacctgctaattggtttcctggctaattcaccttctggctttcatagaggggcaggttggaaatcagaatgactctaaattagccaaggtttctcagtgtgattgtagacttcatagactggctgacgggccccagagcccctgggtgagttattcttagggcaattccctgatggtcctgctcatagattttgtactgacaagttgggccaatggcattgctaagataaaaggggaaaattaaaacatgcccctgggatttccacacatgggatgaggcagggtgagctcagctggcaaccaagtatctaccagatggtttatggaaaacccagatttttgaggggagattaagaagtggtagccatgtgtggtggcctgtaatcccagcacgttgggaggccgaggcgggtggatcacgaggtcaagagatcgagaccatcctggacaacatggtgaaaccccatctctactaaaaatacaaaaattatctgggtgtggtggcaggtgcttgtagtcccagctacttgggaggctgaggcaggagaattgcttgaacccgggaggcagaggttgcagtgagccgagattgcgccactgcactccagcctggcgacagggtgagactgtctccaaaaaaaaaaaaaaaaagaagcggtgacttatcgcccctggaaactgacaagcagcctggaatctgtagaatctatcagttattcatcctgcaaatatttccttcagttctcttttgtgccaggcccagtgctacttagggtaagatccagacagtcatagtctccaccctcatgcaaatcgtcccactcaaaatgtgtggctagaaactcagataagggccaggaagaaaaagttgaggagctatgaaagggaataaccaggttacctgatttaaatctggaaagactcagagaaggagtctttgaggaaaggattgtaaagctaacacttcaaagaacctaatttgctttttgaggaagatcactctagcgttgggatgaagaatacattggagatgggtggaaaacatgaagttgtgaggctgttgatgaggaagactggacgagagttgagggtggtccagccaaggatctaggtgatggggatgaagggagaagtggagggaccaggaaatatcagatgcggagtcagcagggtccagtcattgaatgggtgcagtggtacagggagaggggcacatccgggagccagagcaggtttctggctaaggtggaaggtagatggccacactcttcattgagagagagaattagggaggagtagggtgggcgcaggggaagatgatgtgtcctattttggagaaccacaccgcattccctgtcactccataccctgtacttctggtctccttatctttgctcacactgcctcctccattcacacgctcttcacgccaccatctccacttgttgacatcctatccattctttgatctatttcaaacaccactccctcctcgaggccacacctgagtctttcagttgactgtgacctctgctgccaggagtgctaagtttggacctctcatccctggcttctacctgtaagttcaaatcccagcttcactgcattcttactagctgtgtgacctgcctgggcaatttattaagctctctgagcccaagtttcctcagcaacaggcatactgtgtggattgaatgagtgactgcatggaaaacacttaatatggcatctagcaaatagtaaatgttcaataaaagtgtgctaccatcatcaatgttattgttctgtaggccaggtgtggtggctcacgcctgtaatcccagaactttaggagaccaaggcaggtagatcatttgaggtcaagagtttgagactagcctgaccaacatggtgaaattccatctgtactaaaaatagaaaaaaaataaaaaataaaaaaattagccgggcatggtggcacatgcctgtagtcccagctactcaggaggctgaggcagaagaatcacttgaactcgggagacagaggttgcagttcactccattgcactccagcctgggcaagagagtgagactccatctcaaaaaaaaaaaaaaaagaaagaaagaaaaagaaaagaaaagacttagctcacctctcctcctagaccacaggcatttggagactgggcctcttcttctatatactcgttctccacatattagctagctagcatagtagactcttgacaaatatttgcaaaatgaacaaaaataacctgttctctgccatggaaggaaaaccagtagacattgggttgacttgaaagccacagaatcaaattgaaattcaaagtgtaggtgttttaatattaagccaacttagtttgcttagaagacctttctgtttctctgacacggtaagctcaaaaagtgcagggagaagaacagtcatgccccccattttaaaaattgtattttgaaatcatttttacagcaaggaccttgtctatgttatttactgtttgcctttgatgatgaggaggaggaggagtaggaagaggataaagaataatgatgctgatgataaatgggtaacatttactaagtgcccagtatgtgccaggtactgttcaagcacttttcatggactaactcgtttgatcctcacagcaccctatgaacacaggctgatgctattattgccccagttggacagatgaagaaattgaactggagggagtgtaagtattgctcaaccaaggtcacaaggttagtaaggggcggtgttaggattcaaacctggagtatggctccagaacctatgctcaaatgtgctctcctaaggctgagcacagtgtttggcagagaggaggtcctcgcggaacgaacaggagaaagctttgatctggagccaggagaccacaccttccactcctgattctgccactgcctccctacacagccctaaaaaaatctgtgtttctttccacataaaatgagggacctggatattgatattaatagcaatagcaagagatagtatttgcaattctggtcccttctgaggttttaaataatttaatccccacaatgatataaggaaatcaaggcagagagagattaagtcacctacccaaaacctagaaaatgagagaggcaggattcaaggcccttcattatgttcctaaactatgctctctagcccaggtggctgcaaggagatgccccaggggccaaaaggaacggtatagaacagacagaagttgggctccacctgcccatttccatcagagcagctctacgtgtctctcttttgtagaatgagttcctatttgacatttcccttgaagaaagggtctctgctaaaacataaaaggttggaaaccactggcccaaacaattctgaaatttaatgagactcccaagtataagcttggacttttctggtaatcttggctcattatgaccacataagatggggaccaagattgcatgtaagaacagccccagcggcagaaaaggtcagttgacagtgctaaagacacagctcccacctacctgctccactcggatctcaatctctccattcaccttcttcccatggaaatacttcgacctgtaaaggggaagaaatcagctgagtaaggatgcaggctgttttactcttttctcccttctcccaaaggccttaccccagaggtgcatattgagacacatcctcagccatcctactgtctcctcccaccttcactactgattttctcagtcttttttttttttcttttgagacggagtttcactcttgttgcctaggctagagtgcaatggcctagtctcggctcactacaacctctgcctcccaggttcaagcgattctcctgcctcagcctcccgagtagctgggattacaggtgcctgccatcacatccggctattttttttatttttagtagagatgaggtttcaccatgtcggtcaggctggtatcaaactcctgacctcaggcaatccacccacctcgccctcccaaagtgctgggattacaggcgtgagccaccgcgcctggccgattttctcattctttataggtggtgtgtggtagaggggagatggtggataagattggaggctcaagttctagttctgtcacgtcacttgacctctctgcatctcagttttagcatctgtaaaataatgatattaataattttgctacaggccgggcgctgtggctcacgcctgtaatcccagcactttgggaggccgaggcaggtggattgcctgaggtgaggagttcgagaccagtctgaccaacatggagaaaccccatctctactaaaaatacaaaattagccaggcatggtggcacatgcatgtaatcacagctacccgggaggctgaggcaggagaattgcttgaacccggaaggcagaagttgcggtgagccaagatcacgccactgcactccagctgagcaacaagagcgaaactcagtctcaaacaataataataataataataataataattgtgctacatatttctaagggttactttgaggattaaataagaaaaaggatcccacataaaaaggtctgaaatgatggctatgctgactatcctaatctaatcattatacgttacatgtatcacaacaccaatacgtaccccataaatatgtaaattattatgtatcaattttaaaagaattaaaggatgtttatagtgttttatccatatttttcttaaattcatgattttcatcatgttatcttcacatatatgttaatcctgtctcccctaccctttgaaggcaaaaccacacatggtttatcttggtatcctccaaccctccaatttagtcttcagaaatatgttgaatgtataaaagaatgatgattgctagaaagtgtgtaatttaaagactttagaaaatacagttttgtttgatccagtttcattctcaagtatatatgtttgtgttcttttaacattaaaaatgttatggcattttaactctcaacaaaaatcaatgttttagtgacgcccattatccaaatcttctaactattcaaaaaagggaatcctacaaaaataaataatgcagtattgttttattgagttatacctatatgccccacatactccaccaaagatttattattgatctatccagtctcacccatttctctatttttctatttgtctaataaagcagtcctcatttgttcctttgtctatctgccatccgtccgtccttccttccttctttccacagacttccttctacatccctgcctctgtcttccccatcatcagtacatgacatccctatctacccattgtttagacatcatccctacactcactgattctacattttaattatttctcaaattcatttacctggtgatttttctccataagcaccctaatcctgacctatgattcatctctatactgagagtctcttcatattgttttcatactatttattacaacaataattataattagtaactgtgtttaatgtctgtgtaccactaaactataccacagctccttgaggtcagaaataacctattgtattcatcactttcttcctaacacctaccagagtgcttaacacatagtaggaaattgattaatatttgttgaatgaatacatgagtgaatggactgatgaaaaaacacttgttgagtatcaactcttgtgctagaaactctgctatagagtttaacctacagcctttctcattaacactcacaaccaccaccacgaagtagatatcattatttccaacttacagatgaagaaactgaaacccagagagactaaatattttgcctaagggatttgaacccaggacttctaattccatatctgtgcttttgctcaactctgaaaaatagcagtgaaaattggggtctttataggtttggatatcgtctcacaaaaagtaacaaagtttccattttctctttttgattattggtatgatgacactaatagttcttggtgacttgctgtgaactgagcattgtgttaagcatttccataaaccttctctgggacggagacagctctttgcttcctaatactcattctccccttttcccacagtaagagagttgacagattggtacataaaaatgtgtaccccaagtctcccatcagctggatgcagccacatgatttatttctaatggataattttttaagcattaaacaaccttcttagtctcctactcttttccttggaagatggatgtcatcacccattatttttcagccttccatttgtgaaagaatcctttctacaaattcactaactgcttcagcctgtctgcttccaaagtctctctacctactcttagctgatgctggtggagttaatctcttcccaaaactgactgacagctctgatattagcaccactttttcttacgtcctgatgggcttagatgtcaactaggcggtagtttagtaggaaaggaactattagtatgactcgaaagcaagattttgattttttttttctttcagcaatggtcttcaaataaatacccatgtggacagcctcatgcaaagagaatcttttcatacagtttgtgaattttatcgtaatccttaaaggtagtatcagcaaattccagacaccaggacaagcccatgtctagtatttgaagtgcctggggcaaagcgacaaatggaaacctatgggtcatatgtctaatatttaaaattgacaaaatcaagccagcaaacatttaaataaaagacatctgtccactgggcatggtggctcatgcctgtaatcccagcactttgggaggctgaggcaggcggatcacgaggtcaggagttggagtccagactggccaacatagtgaaaccccatctctactaaaaatacaaacaattagccaggagtggtggtgggcgcctgtaattccagctgaggcaggagaggctgaggcaggagaatcgcttgaacctgggaggcagaagttgcagtgagccaagattgcgccattgtactccaacctgggcgacaagaatgaaactccatccaaaaaaaaaaaaaaaaaagaaaaagaaaaagaaaagaaaaaagaaaaaaagagtcccaaagagtctgtcttccttccttggcagatacaatttcataatgaccttaaagactcagaatgtaaacttctcagaattctttgcactctacccagcacgtggcagcacaaggattgccagctcttggttctcagacctcacccaagatcttccttaattccccacccactctcctctgcaccactgaggctcctggtgcgggtatgtggattgcccagaccacgtggccaagcttcatctactcccttcccctccccaaatggttgtcctttggccaccccttggaaaatggaccaaggaattggcctatataggctctgaagttgggttaaggtccctttgaggagggaattctagagtttgggtacccagggcatggcctaagagtgcaatttgtagggtcttggtgggaatatcccctcactcctaactcctctgcctgtcaagagaggtgtggctaataaggaccagagcaggatccaaggtaggcatctttcgtggatttaaaaatcacttgcttttaaatccaagctccaaatttaaaagaagtactgggtgggcctgggaccgggaatggtaacctatcattacaatcaccagcatactgggaaaaaaaacatggatttgcaatcacacaggcttgggcaaaatcttagctctactactcactgaccatgtgttctaagacaagacacttagccctctgggtctcagtttcctcatttgtcaagtggtgacagtaactaccagggaagggtgtggtgagaaagtcacataatcctctatgcaacaaggcagtaaagtgcaatggcttcagggcatacagcctggataggaccccaactcctccactcacttgtgcaagcttgggtaagccaacctctgaatgccttagtttccacacctaggaaatgaggctcatagtagtagccacctcacagggttgttatgaggattaaatgaaacaaggcatacaaagcactgagaatagttcctggcacacagtaagctgcaaagtatgtagtccatggcctgaaacagaatccacaagagcaaagagctatcgagtgcttaccctgtgcctagtgggtgctgtgtgctggggacccacaaataaacaaaacaatcttaccctcttgggggttccaaagcagaattatgactcaccttgctttgatctgtctcacaggtgcaaggagtgatggctggtgatggggaaaagaggtggccttggcctataaggacagccagacccttcacatccttcctcctatttgaccctcatgccaaccctgaggggtggtagggcagggattgctcccaacgtgttccagatggagaagtctctgctcaaagtcacacgagtgatctgggtacccaaactctagagggaagaatttgggtacctttcctggagaccctaagtggtctttcagactttttggatccagtccagagccctggcgtccttcatgatctggaccctgctgactgggggtctgcttcccctccagtttgctgtctatttcatggttgcatccaaattcctgtgcttctctaaatactcctgtgctgtcctgcctctgaacctctgcacaggccttcacctctgcttggcacttccttgattgtctctttctcatgtttcaagatcctatgagtgatatctactctgctgagttttccttgacagcacccccttccctagctgggctgagcgtcctcccttggttcctacagcacgctgcacttacaaccattccagcccttaccacttcacgttgtcattacacatcacttagctgccctctgcccccaaacatatagtctgtgagctcctggaaaccagaaactgagtctccatgctcactgtgtctccagtatccagcacaatgagctagggcacaggacaacaggcttaacaaatgttcgctgaccgggtaaggaaatactgtctgtaggccggcctttcctggagacacttgactgccatctactggcacaccattgtaatacagtcacaggtctacagccactgcgatgtgggggtgtgtacgaggccaaccttcgcaactggcattcctcgacttgattctaacctggaacctgaagcactttgcactacaccaataccacccaagcagctgtggtcttgatgagacctcaccttcccaggagaaacatttgttttgcccatctctggaatgtttactgcagggcctggcagacggactggggctgaagctgagggtcagggagtccatccccccgcctggctgcaagtcagaagtctgtctcctgatgggccacacagactgctgcctccttgccgggggctcattcaggcttcagccgcctctgaacggttctgtctggcagagggaagggtagggatggtctggaattctagatgcctttgggggctggggttgctgcctctgtaattgactggctgtttgacctcaggcaaaatggatggacccgctgtgcctaagggctctgtctctcatggctgcctcctcttcccaccctaatatgttcaatctcataataagctccctgaatacctcagccaatcaatcaagtccttggcctgggggagctctggattccacgaagattctctctccgtgggtggtctcatattttactgccacatctgaggccccaggaagaagaatattataaaactggtgctgcctggggtgggaaatccctagttgagggaggtgggaagtgtgtatgagagagactgatgaggaatgggtatggggctcttttgtggctgcagcaggggcagaagaaggggaattcatacaaacaggatctgtgttcaaacaggactgttttccaataaatcgatcctgtatgtagagttaacgcagccagggcttggtgatgtccttccaaggaaggagaggtcaggaatgtcctgtcccagggacagctgtctctccgcaggccacccccactgggggtggagtggaaatagagaaagagattttcatgtttctgatgcaacatgtcagttgctgatttgtggcccaggcagaagcagggaagacaaccaatgggctgtgcagaaaatgaaggcaaaacactcagagactttgccagttagcaagagagtcacgtggcaggctggatgggcagagatgtggcagaagaaagaccttggaacgcaaagggacccaagatctgattctagctccattgttttctcctgagaacagctcaccctcctggcaccttcccattgccagagggaggaaccgccccctcaaccgcaaacaatggtgcagcctctcagtcctccatgcaattagcaaggtccaatgaactaggaagggaaggaatgcactaagagtgatgagactccctatgcctgtatggggatctgcggaggcaaaaaactgagacataacagggccccgagccacaggatgtgacaaatgatccccaccttttgcctctgagaacaatagagaaggagatttttgtgggcaggatctgatcacaattcacatcacttattcactccctcattcaatcactatttattgagccttatgtggactaggcaccacaccaggcataggagtagatacagcagatacagtggcagatgtagtccttgttcttggagagcttacatgcttattgaaaagacaaaaaataaataaataaacagataaaaagaatgagtactacgaataaaatgcacgaccaatggaattgaggataagatgtggggtgcaggggagattggacttcagttggtagaaaaggcttctttgaaagacactgaggccgggaacagtggctcatgcctgtaatcccaacactttgggaggccgaggtgggcggttcacgaggtcaagagatcaagaccatcctggccaacatggtgaaacgccatctctactaaaaatacaaaaattagccaggcatggtggtgcatgcctgtaatcccagctacttgggaggctgaggcaggagaattgcttgaaaccgggtggtggaggttgcagtgagccaagatctcgccactgcactccagtctggcaacagagcaagactctgtctcaaaataataataataataataataataataataataataataaaataaatagataaaaagaaaagtactatgaataaaatgcacaaccaatgtgattgaggataagatgtggggtgcaggggaaattggacttcagttggtagaaaaggcttctttcaaagacgctgaacatacacagatagaccacctactatgtgccagagtctgcaggctttaaggaaacaagcgcaaagacaacatagctagctcttggtctcagggggcttactacctaatgggagggacagacacaaaaatagaaaatgaccacacagagcattcacacaaatatccccctcagcccacagaaaaagcagccaactcagtctgaaggtcaggggtcaccttcctgaggtcaccgtccacccatccatccaatgtttggtacctagtctttgccagggctgcaaagatgagtgcagcaggatctggatgtgtgtgtctgccaaaaggacacgggcaagggcaaaggaagtaggtacgtcctgggggcacccaggagagaaatgaatgttcctgggtgtgtcctttaatgtacaacaggcacagagcagaagacctgggtttgagttggcagctctggcacctgctgcctgattttggaccagcctctgcttcctcttccgtagatggggataagaagatctactcacatgttgtcaacaggattatatgaagacacagatttaagggcctctgtaacctgccaagaatgtgctagcaaatgagctgctccccgatgggctgcaagggtagaatttgatctccccaggtaaggaagtgcgtgagcaccactagccttggagacaagcccaggtccctttcagctatttatttccagtgctgcctcaggccagtgtcaaccttcctgaaccttggtttccttaactgtaaaaataaggacattactatatctgctgtaaggaccccatgaatgatacccctgacacatggcaggtgtttaactaatgttcatctctttccctcctgtgcatcagcatgatgggtggagggtcgaggtcagctgggtatgtccctaagaacatgacaggtcattttctctctccaagaggaggtagatggcagcatctgccttgctctaaatgaaaccttgcttggtgtcgagcatgatggagaccttccctgtctaatccctgggaactcccttcctctccagcataggcctttagggtaaataaagtcatcagggccgggcacggtggcttatgcctgtaatcccagcactttgggaggccgaggcgggtggatcacctgaggtcaggagttcaagaccagcctggccaacatggtgaaaccccgtgtctaccaaaaatacaaaaattagccgggcatggtggcatgcgcctgtaatcccagctactcgggaggctgaggcaggaaaaatgcatgaacccaggaggcggaggttgcagtgagccaagatcaagccactgcactccagcctgggtgacagagtgagactccatcttcaaaaaaaaaaaaaaaaaaaggcatcaaacacccactccctctacccctctcctctctaaagacacagcactatgtcaccctcattcctacagatgtctgcaagttcacactcttcataccacagaaagggttaacgtttggaaggctacatcatgccttcagcaaacacttattgagcatctactaagggcccaactggggaaatccccacaggaaaggtaatatactaaaaagtaattcatgccaaggtgcaagtgactaacatctgatcatcccagaaaagggtttttgatggcataaggaggataaggggatcacggggatattgtgtgtcttgtttggcaagggaaagtggagcctgtcaaggtgaaaagtgcagagcaccaaaagagaggctaagaccatttattatccattcatccacccaactacccatccatgaatccatccatgaatccatccatgaatccatccatccatccatccatccatccatccatccatccatccacccatccatccacatattcatccatccatgcatccatccacccatccatccatccatccagccatccatccatccatccatccatccatccatccatccatccatccatccgcccacctacccacccatctacccatccatccacacattcgcccatccatccacatatccatccatctaggacatactatattctcagcactgtgctacataggcccttgaaattgcactgaacaaaacagcccccttgccatcctggtttttactgtctagccaggagatagtcccagaagaggaactagaccaaatagttactctgactcctgtcttctttatcagaagctgccaactagtagacctcatagaatccacagtcttgttttgttgcacttaaattgtatacttttaaaatagaatattcgctggcaaggtgactcacgcctgtaatcccagtactttgggaggctgaggtgggcggatcactggaggtggggagttcgaaaccaacctggccaacatagcgaaaacccatctctactaaaaatgcaaaaaaaattggctgggcgcagtggctcacgcctgtaatcccagcactttgggagaccaaggtgggcagatcacaaggtcaagagatcaagtccatcctggccaacatagtgaaactttgtctctcctaaaaaaaacacaaaaaatattatctggacgtggtgcctgtagtcccagctactcaggaggctgaggcaggagaattgcttgaacccaggaggcagaggttgcagtgagccgagatagtgccactgcactccagcctgggcaacagagtgagactccgtctcaaaaaaagaaaaaaaaaaattagccgggcatggtggtgcatactaccggggaagctgaggcaggagaatagcttgaactcgggaggcggaggttgcagtgagccaagcttgcaccactgcactccagcctgggtaacagagtgagactccatctcaaataataataataataataataataataataatagtaataatagaacattcatataaaaattcagatttctgacttttcttgaaaatcaataactcgacaacaccaggcccttattcccacatggtaaaaactggctgcggggcctgcagctgctgcctcagaggaggcatcggttctcacgcccaacacagttcccagtgctccctgtcatctctctgcagccgaagccaagtggcagatatcatctgtcatagagcctatgctgctgtttttcttatagcagggaaatatttctctatgcctgtgctttttcctaccacctgccccttcactcacggactgatttgtcccctctgagcagctgcacagacaacccctaatttcgctaagcctattctgaagatggcaattagcttagtgcaaatcttcaggaaacccacactcctgtcccttctgcaaacccagggcagaaagtcaggaaaatggaaatgaagcaccatcccttctcctgccaccacagatggcctctctcctgtcgaagatgcacgtcccaggcaggcctccacaggccccaagggcttcctagacgttctgtaatgaggctggcatctgcccagagccctgcctcccccagggcaaggctgtaactcaggcagaaatctactccaccccaggagtagctattgctcaagaagacccgtgcatccgagggactctttggaaaaaaggtcacttggagggcctgggccagaaaaccaggttgtggaggagaaaacacgactcacaagtgaaacgctgaaactcctcagactttgcccaaggcaagggcatgagaagtgatagagaagacatcagagagaaaacaaaagacttcagggccgagcctcccttttaaaggcttgcagcctgaccctttcatggtctaagccccattatttttcccaaatgggtagcccagctgtgtctgaacacctgcacctgaggggagctcattccctcaccaggaagcccactcagtctctggatgactttgccaattagatgaattttctgtatactgagcttaaatatgtctccctctttgttctcccccactggttccagttctaccaggtgggagcgtcatgaaacaagtcctctagcttggggggtttctaaacttggccttacaccacttaaaaaattcatctctgccaggcgtggtggctcacgcctgtaatcccagcactttgggaggccaaggcagttggatcacctgaggtcaggagttcaagaccagcctgaccaatatagtggaaccccgtccctactaaaaatacaaaacttagctgtgcgtggtggtatgtgcctgtagtcccagctactggggaggctgagacaggagaattgttcaaacctgggaggcggacgttgcagtgaggcaacatcactctgctgcactccagcctgggtgacatagcgagactccatctcaaaataaaaataaaaataaaaataaattcatctcctgagctccagtctagatattctgattccatcattgcaggggaacatctccgtgtggcctgtcctgtatccattctgccttcttctggtaacagcagttctatttgcatttgcattgatggaagcaagccttctttttgtgcagtcctggtgggactgtcccaaagtgcccgcagagcaaggagtagaacaagccgggcttgttcttccccaggaatttgatttttgaacagagagaaacaaggatgaaagcaagcaggagctgatttatcccgagactgttcctgccacctagatctgtagaggggcccagggatccagggacccaatggccccatctttctgacactcaagctgatgtatcctgagactgttcctgccacctagatctgtggaggggcccggggatccagggacccaacagccccatctttctgacactcaggtctccctattttcctttgcttctgcaagcttccccatacattttcaataaatctcttttgtttgtttgttttgttttgttttgagatggagtcttgctctgtcgcccaggctggattgcagtggcgcgatctcggctcactgcaaactccacctcctgggttcaagtgattctcctcccgagtagctgggactacagcatgccgccaccacgccctgctaatttttgtatttttagtagagatggggtttcaccatattggccaggctggtctcgaactcctaactttgtgattcacccgccttggcctcccaaagtgttgggattacaggcgtgagccaccatgcccggcccaaagtctatttctttttcatgcaaagaactgtatccaacacagagggtgtagatggtgcctgggaatctgaatgtcattgtgatagaaagtcttttgggggccatgctcctaggccaacctcactgtttcacataggagaaacagaggccagagaaggtgatccctcagcaccagcctcaagaccccacagcatctgcagagttctttagaaaggcagccaagaagagagaaatttaggaagaaacagcacccatcagatttctccccacactctcttctgctcaaagccatttcccccagattttctagctcctgtttccgagggtgaagctctcccctaagactccactagggcgggggtaacaactcttcactgttcccccctcctccccgaaagagctgggtaggaagcagcaggggcaccgggccgctggattggacagcgtgtagacctcacggagaggggtcagcacttgaaaaattcctcaagtcaaagggctcggggcttgggtgccgcacaaggccctcactgtgtgcacattgtctccctgataaaaggggccgggcctgggaaaacggagctgtctccaggcgacggggtaggctgctgaggaatgcccaggacccctccctcccccagacaccagggccaggactgcgagggggtagggaggggcagggggtgcagcgtgggtgcccagagggagaggaatgaagtccagagcccctccaggtggtgttgggtggtgtgtttgagtgatggaatgaagcaagcagaaagtgacaaaactcccttcattaggcccttcctatctccacccccagcccctccagccatcccagaaaccccttcatttccccacacaaacaggcagggcctgcccttgttcaaggagagccttaggggtaggggaagcggtggagagaggcacaaggattttgttcctcagagccaagtgtcttcaacagagagttgtgtgtctccactctaagcctctcaaccaactctaggaggaggggactgacttggagtcggcacctcatcctcacagcggagggactgccagcccgccaggatctcgacaccctcctctagggtttctggaagacagccctccagcacatccagctgagctgagaggcaggccaaatggcttccttccccctggcttccacaacgattatactcaccagcaattagtaattgcaattaattgttaataacagttaccatttcagggcctcttaggacagcctaagccgtgtaccagctccacccatgtcattatctctaatctttccagttacccttccaggaagatattccatgaccctgccttcctgctgaggaatgtgaggttcggaggttggatttgcccaaggtcacataactgagaaggaaaacagggaccagagcccacagtacccaggccgtctggctctggactgtcccctcagctttgctccctccctccctgctggtggcggacagccctcctcacaggcaaggaaagctgctctctgagaatggggtcaatagggggatctggtttggctcttcccagccagaaaacaaggaagctctaaggccaacctctcactggccccgtggtagcagagccagcagtgtctcttgttgctgccctccataagcagagaggccagataaaatccaggacatccaaattttccatccaatccaaatttccaatgaacaatacatcattttgtagtataagtctctccaaatatggcatgggatatacttagactcattcattgtctatctaagtattaactgggtgtcttgtatttttatttgctaaatctgacaaccctaccccaagccactgctggttgtgccagctctgagttcaccccccatccttcctccacgtggcacaggtggacgcagcatgtcctgatcaccacagggctgatcaaacccaatgcagtccttacaaggacaggccaagatgccctgcagtcctcatgccttcggtcaaagcagactgaagctgcttttttttttttctgagatggagtctccctctgccaccaggctggagtgttgtggcactatctcggctcactgcaacctccgactccctggttcaagtgattctcctgcctcagcctcccaagtagctgggattacaggcatgcgccaccacgctcagttaatttttgtatttttagtagagatggggtttcaccatgttggccaggatggtctcgatctcctgaccttgtggtctgcctcccaaagtgctgagattacaggtgtgagccaccgcatccggcctttttttttccccctgaaggaaacactggcctctgagttaccagctgcaccagaaggaggaggggaagccttggaaataacatgcaagtatcaggtactctccctgaattccagggcaactgaatattttctaagactctcttccagggcatcctcaatcctgaatttacccttaataatggtaacagactttggcaagagtatccattcattccttaagtcatccatctatcccagcctcccgtccatctatcctagccaggcactgtgctgggctctgagggtcagtggttgcataggaaaggcataaactctgaccttgagtcagagttggtccaatatgggtaggaccaaacaaagtcactcacatctacattgaaaaactaagcacccacactgaaaaacagctgtggaggagaggaactcggcactctcactggacacttcataacatccctgtgaagtcagtggtatagggaaggtggtggcattgtgatcccactttacagacaaagaaactgaggtaccaaaaggtacagtatcttggccaagaccacagagacagtgagtggctgggacttcaagcccacgctaccacctgtcagcctagagttctcttgagtattatcttctttcccatttaactctcgggaatcatgtctgacatgtgttaggaaatcacatctttaatatctaaacatacgggaaagaatagaaaagatcttgcctgagatcccttggtgctttaaaaagaggaaaatattctctgcacatccaaggacaatttctgtagaaggtccaatttgcaaacctgaactcgtaagtatgtgtatggctaaaggaattcccttttccctgggcaccctttaagctctggctgcccggagggctccagcagggcggggctgcctggctcgaggtggggcgccttcttctgagggtgaggtcaccggaatcctgtgcttggctgtgcactgtaacatggagtgctgccacccgttgcctcacactgctctcagacgctgggtgtgtgccggggtgtgaggccccagggtcctgctccccgaggtcaacaccctcaggagcagtagaggaggggctgagcttcaggtgggagaggttggggagtggcataagaactgcggtgcccaggctagccctttggatgggcctgagccaggtcccagatgtcagtagcatttgctttgattttggactcagagcctcagtcttccctatgtatacaatgagaatagtactggtgccccatacagttattgggagagctaaattagagaatctatgaaagccattgaacccctggtcaggggacgtgcacagatgcttgccaaaagatgatgatgcagacacgaccccatcctcaaagagctctgtcattcatgtgcttgttcagtcatttgaccaacactcttcagcatctatctcgtgccacacactgaagcagtagcagtggtcagcaggagggtggcaccatcagaaattccttttacgacatgagtccagttcaagtcccagcccagccccacttctgtctccttgagcaggtgcatggtttctccacgctctgcccccctcacctttaaatgagctgacagtcaactcctgctcctcggcaaatgcttaacaaccagttctctggatgggggaacaaaaagccctgctttctagcatttgccagtttccacagtgtaaatgctcccacaacagccaatgtgattttcagctggattgagtcaaggtgagagggaaaaagagaattttaagaatgccaccggccgggcgcggtggctcacgtctgtaaccccagcacgttgggaggccgaggcgggcagatcacgaggtcaggagatcgagaccatcctggctaacacggtgaaacccccgtctctactaaaaaatacaaaaattagctgggcatggtggtgggcgcctgtagtcccagctactcaggaggctgaggcaggagaagggcgtgaacccgggagacggagcttgcagtgagctgagattgaaccactgcactccagcctgggtgacagagcgagactccatctcaaaaaaaaaaaaaaaaagaatgccaccaatgtcattcctcagtttgattgtcacacccccaaccttgtcattgccaataacgcaccacctcccaaattcctcattcagtcaacaggcatttcctacgtacctattatctgccctgttctaggcatgggcaaatacagacaccatgtagaagtgggtgggcagataggtgatgatcatacagcgtaataactcttggaaaatctagaaatgcacaaggtgcttaccaatgggtgtcattaatccttgtttggtaggaaggtgtagtctgatattctctccaccagatggatggtagctgaggagggtttcagagggtttcaaaccaaggacacccttttaatttcttacccaacaaataaaagaaaaaagaaaccattgggaagggtgggcaataacagcaaagatagcaatagatcattgcggaaatggaagagcagattttctgagaaaaaggctaccagcagagtaagaggacaggagagccagggctccagaggccacccagggaggaccgcagtgacctggggaggaacagcttctattcgctgctcccccaacagccctcctccccattctatccaggctccagagaccttgtaggataaactgagggcagggaggtacaccaactccacctgtcttttttattttttgggtcatgttaaaggttttgattttgaaaatcaaacctgggattctggtacattctatagaaatagtaaaaaaaaaaaaaaaaaaaaaaacaaaagtccctccatcctcctttttaaaaacaatttcaaatagcagccttacagtgactctggcatcctggtaagtaaagagccaagattttatacagaagtgaataaaaatagaaactcctccaccgtgtgttctgtgttcctgaaccctaaggtgaggtgagcttcagactccactatgcccagtacaagttatcctgcttggactaaggtagggcaatgacatatgctaactgaacagttactgtgtgttgagctccagggacattaggaagagtaagagacaggccttgttcttgcagaagagacgattataatacagatacagtgtggtatgtgcgcctgcatgatgcgccagcatgatgaagtgtgttttaagttacacaagggaggtcgatattaacactgcagggtggggtgtgtcagggaagaattctcagaagaggggacacctgagcaggatttcaaacatgaatggaaacttgccaggtgtacaagatagggaagggtattccaggtaacagggaacagaatgtactaaggcggaaaggtgtgtttgagaactacaagtggcttactcttcctgcagaataaacaggacagggccagtcacggtggctcacgcctataatcccagcactccgggaggccgaggcaggcagatcacttgaggtcaggagttcgagatcaacctggccaacaagatgaaaccgtctctactaaaaatacaaaaattagctgggcgtggtggcctgtgcctgcaatcccagacccccaggaggctggggcatgaaaatcacttaaacctcggaggtggaggttgcagtgagctgagattgcgccattccactccagcctaggcaacacaatgagactctgtctctaaaaaacaaaaacaaaacaaaacaaaaacaaacaataaaagcacaggaagcagagctggaggcagaactagagggagggcagggcaggcatgcttatgactttgagggcaacgattcccccaccacaggattatattaataaaacgagatgcatggggagggggcaggcaggagcaaagtgaaactggtcagatttgtgtttcagaaagatgacccttgggtagtcccatggaaggtaaccagaaggtgaactcaagatgggaggtttcagaccagtgaagctgctggaaaattctaggcaagataagcagtggagtggcagtggggctgaagagaactgagtttgatatcaattaattataattctcctttcccttgtggttctcaaatctacagatgaggctgggcacggtggctcacacctgtaatctcagcactttgggaagccgaagtgggaggatcgcttcagcccaggagttcaagacaagcctaggcaacacagtgaaaccccacctcatttaaaaacaaacaaactgctgattgtcccccaccatcccagaggagagcatcacctttagttcagacctatccggagccaggccttacatccttgcctagccaggctggtctcctcaggcacccccaacaggagagagtatctttaaatgcctggccatgagttctcccagcaaagacggctttgagaccctctatttctcctgaagatgaaaggtctctctccaggtcactggccaggttttggatcgtcctcaagggacccaggctgactcagagtctacaagctggacacatcaggcagggaagagtggtatcctgcaattaccccacctgtccacaacaaaacctgattctactggaaggccctggaccaggaatgggaagacagagaaacgtctgtcttcctgagaagggctgagaagggtagaaaagggggcagcatcatcgtccccgttggggttggggtgggttcactgtctgtccagactgcagctcctctccccttcattatcatctgaaaggggaaagaagggggccctgtgagctggcttcttccctttaaccacttcctcccctgggagacagctcacacagtgcaggaggggctggggagggggctggcccagaggcaccagactctgcagaaccacccaggcattgtggggctgccctgccacctgctggccgctcctggtggcaggggacaggcatttttccgggattcttcaggacaggaccgagactctaaggcagtcagcatcaatttggagaaagccgggaaagtgttgcgattcagagaggttaggaagttcgtgaagaatctaggatggagttctgtgggagaagctgtatgttggtggtaggaagtctctgtcacaaacatctaataattgcagggccaactgccagatgagttaatgagtcttagtttcttacttctcccctttttcacccactgaggggcaagaacaccataaacaaagactgttgagtcccaattaaagtgtggccataggacgaatgattgaaatatattgggaaaaactcctctggccaaagctgtgtccctacccttgcacacagcctaaaattcacacactggtccttcctgtggaatagagagactgaacatcaaattcaaaatttaaatgttatgtctgaggccactcattgcatttcaacctcattcactgttcccctaccctactgtataccacatggacactggagggacagatattaataagacccaactttatcacccaggacctacagggaagagtgaccaacggaccaatgggttaaataaatagcacaatgggataaatcctaatccagactgccctgtatatttggcatgaagaaattaaacaggcatgcctacaaggggctactgttaagatgattaatgttacacaggaaggatcacaatagtcagcaataataatatacacttatgcagtacttactgtctaccaggcacatcccatgcactgttatactaactcagatcttaaccctacttacatacattaactctatgacataggtactatcattattcccatttaggtgcagtaatttacaaaggtcattagtcacttcagggtagagatggaatttcaacccagatagcctagctctgatgtctgtattcttaacattgcaccatactgccatttattaagttcaacctccatgcaaagacgtaacttccctgacaaacagctgagccagggataacacagctagcagagaacactcaaaatcaaggtcaaatgttgggatgaagagagagagaaaacttcaagggccatgcaggcattttgactaccaggcagatgggcattgttcagggcagagggcctaaaagaaacaccccggcagacatcaaccactaagctcagagcctaatagtgatgctttacataaacacataagcagagacaaacaaagtttcatgataaatacccttaagcaagcagcaacacctaagatgattcacactggatcggaagacaggtgattcacatgaccaatctggttaagaagaggcaatttctgagcaggaagcagtaaagtcagactgatggtctgaatctgctgaacatactttaatgttgactttacatagagtatgcattaaaaactataaatagcaccaggtgcggtggctcacacctgtaatctcagcattttgggaggccgaggtgggcagatcatgaggtcaggagatcgagaccctcctggctaacatggtgaaaccctgtctacagtaaaaatacaaaaaaattacccgggcgtggtggcgcctgcctgtagtcccagctacttgggaggctgaggcaaaagaatcacttgaacctgggaggtggaggttgcagtaagctgagatcgtgccactgcactacagcctgggcaagagagcaagactccatctcaaaaaaacaaaacaaaacaaaaaaaactataaatagcaaagcatagatttaatcattcccaaactaagttaatgtctcaaggagtgaatgagtgtatatacatgcacattggactaacagagcatctggcacatttaatgaatgggatgcattcatttattcagttaatacatagttacttggtgcctactgatacggtttgactgtgtactcacccaaatcttatcttaaactgtagttcccataatctctatgtgttgtgggagggattcagtgggaagtaattgaaccatgggggcagttacccccatgctgctgctcttgtggtagcgagttctcacaagagctgatggttttataatgtgcttcccccttcacttggcactcattcattctctctcctgccaccctgtgaagaggtggcttctgccatgattgtaagtttcctgaggcctccccagccatgtggaactgtgagtcaattaaacccgttttcctttataaattacccagtctcaggtagttctttatagcagtgtgagaatggactaatatagtaaattggtaccccagagagtgggatgcttctgtaaagatacccaaaaatgtgtaagtgactttggaactggatgacaggcagaagttggaacagtttggagggctcagaagaagacaggaaaatatgggaaagtttggaacttcctagaggcttggagggctcagaagacaagaagacgtgggaaagtttgaaacttcccagagacttgttgaatggttttgaccaaaattctgatggtgatatggataatgaagtccaggttgaggtggtctcagatggagatgaaaaactttttgggaactggagtaaaggtcactcttgctatgcaaagagactggcagcattttgccccggccctagagatctgtggaactttgaacttgagagagatgatttagggtatctggcagaagaaatttctaagcagcaaagcattcaagaggaagcagagcataaaagtttgaaaaatttgcagcctgacaatgtgatagaaaagaaaaatccatttgctggggagaaattcaagcccactgcagaaatttgcataagtaacaaggagccgaatgtttattaccaagacaatggggaaaatgtctctagggcatgtcagagaccttgggggcagcccctccaatcacatgccaggaggcctaggagggaagaatggtttcataggctgggtccagggccctccctcctgtgtgcagtatcaggacttggtgcctgtgtcgcagccacttcagctgtggctaaaagagaccaaggtacagctgaggctgttgcttcagagggtgcaagccccaagccttggcaccttccacatggtgctggccctgcggatgcacagaagtattcaggtttgggaacctctgcctagatttcagaggatgtatggaaacacttgggtgtccaggcagaagtttgctgcaggggtggggccctcatggagaacctctgctagggcagtggggatgggaaatgtggggttggagcccccacacagagtccccactgtggcactgcctagtggagctgtaagaagagggctactgtcttccagaccccagaatggtagatccactgacacttcacactgtgagcctggaaaagacacaacgccagcctgtgaaatcagctgggaggggaagctgtaccctgcaaaactatagggatggagctatccaaggtcatgggagcccacctcttgcatcagcattacctggatgtgagacatggagtcaaaggagattatttcagagctttaggatttaattactacctcattggatcagagttacctggatgtgagacatggagtcaaaggagattatttcagagctttaagatttaattactgcctcactagatttcagatttgcatggggcctgtagcccctttgatttggccaatttctcctatttggaatgcgtgtatttacccaatgccaatacctccattggatctaggaagtaactaacttgcttttgattttacaggcttctaagaggaagggatttgccttgtctcaggtgagactttggacttggacttttgggttaatgctggaataagactttggggaactgttgggaaggcatgattgtgttttgaaatgtgagatttgggaggggccaggggtggaatgatatggtttggctgtgtacccacccaaatttcatcttgaattgtagttcccataatcctcatgtgtcatgggagggacccagagggaggtaatttgaatcctgggggtggttacccccacgttggtgttctcattgtagtgagtgagttctcacaagagctgatggttttataaggggcttcccccttcacctggcactcattcattctctctcctgccaccctatgaagaggtgccttccaccataattgtaagtttcctgaagcctccccagccacgtggaactgtgagttgattaaacctctctcctttataaattacccagtctcgggcagttcttcaggcagtgtgagaacagactgatacacctactatgtggccacctttggagacatgcacatgcgaccctgttctccatccccaaaagccatgtatgagtccactgtcagacttttctggttcccatccatgtattcctctgctctggatgcaatgcttccatctccatagttgggctcacttcctgaactgcaatttctatgtctccagctagactgataacatttatcacctctgagtaccaaacagctgggatagacttattctccaaatgcagctccacataagcaggagcctgttccctactatacccatgcatctcagctatgcctggcaccgaatcagtgctcagtaaactacctggtgaatgactgctacagtgatcttgacacaggtatcaggtctctgccactgtggaacttaccagctagggagcactgtctgagaagaggctggcagtggtcatttctgcccacctttggtgttcagaagacaggctctggagccagactgccagtacctgggagagctgagatgcacactcaggcactctgatcccaaggtttgggataaggactgtggacttgtattgctttcttttatcctcataacaagctcattttatggaaggagggtggctgaggctgacaggttaatctgccaagtactgccagacgtatttcagatattaaaagttttccatttttaggaaggtaatatggtgaatataccatattttatataacacttccagcaggctctgaactatactccatatcaaacacattcagatgcttgcagcaaatcatatgaacaaacacacttagtataattatagcctcactttcctgcagattaggctttgctaccaaaagaattgcaaaacattttctagtttccagagtgtgttggatttgggatttgcaggcgagggactgtggacctgtaaatataaagcccttagaagagaatgtggcactaagtaggtgctgtgggcctagcatgcagcagccacttggtacatgttagtttccttctctccagccaggctctgatagcacccaagcctctcatagctctccccttctatttccccaggagatgagataatccccactcctctcttgccccagaaggtggtagcacttgcaaattcctacttaccagtctgtatgggcatcatcgatcaccaacaggatcctgggtctttgaacaatgggcgtggagggacctggaggctccatcagtcctgaggtggcctgaggggcctgcttcatggcactggagagggagctaaaaaggctggatcctggagaggagaaggaggcagccaggggctgggggtgcctcctctccatggcgggggaagcaggtgagctggtggagctatctgggcgttgcaggtccgtcatatagccattaggcaggttggccatgaagctgctgtcagagagacgtcgccggaggaaattcatggctgtggatggatggagatgactggctcctacccagacgtgtgtaggtgaggcccagaagacaggctgctgccaggtacagggagtggtaggactttagccagaagagccagggggattttgcgcaaccagcagtcagctttagctgcctttatttacctgctggaaataagccaacaaatacataagtggaaacgacctccacccccttaagagcaaacagatacagcgctttcctgccccactgcaggtggtaatgtaaattaggacatccttctggaaaggaatttggcaacatgtattaagaggatagctttttaacctacaatttccattttctggaattatatcgcaaagaaagattctaagttacagaaaaagcttcatgcacaaatatgttaatcacaggttatttacactagcgaaatactgggaagtatctcaacattcaaccacagtttaacaaataagtcaactacagcacagttactcaatgaacctattgtggctatttttaaaggtgccctgaagaacggattttggtaacagaaacaatttcatgttctaatgacaaatttaaaagataatgattcaaaattataggaaccaaatgactacaaagatgtacaagttgaaagaacaaaactttggaaataaaagaaatcaaagtgttaacagtgattatattttggtaacgcaagtacatgcctttttttctttttctttcctcttacttatatttttctaattttctagagtgcttattactatggaccggcatgtcccccacctcaccaaatttatatgttgaagataatgctgaatatgatgcttcggaaatgagccctttgggaggtaattatggttagtggggtcatgagggtgtggcccacgcgatggaagtacagcccttataagaaaggatgccagagagcttgctttccctgcactgtgtgaaagcaaaggtaaaaggcagccatctgcaaaccaggagagagccctcaccagaaccaggcaaagctgacaccctgaccttggacttcccagcctccagaactgtgagaaataagtacctgttgtttaactcacccagcctatggtattttgttatgtcagcacaagcagataatatacacatctattgcttttctaaacagagtaacataagtttaaaaaacccacactgttcatttgagatcaaaacatcccattgagaacaatgactatttaaaccatggaattagattttatattttttgttaagattattatatacaattttttttttttttgaaacggggtctcacttcatcacccagcctggagtgcagtggcacgatcttggctcactgcaacctctacctcccagattcaagtgattctcctgtctcagcctccaaagtagctgggattacaggcacccaccaccacgcccacctaattattgtatttttagtagagatgaggtttcaccatgttggccatgctggtctcaaactcctggcctcaagtgatctgcctgctttggcctcccaaagtgctgggatcacaggcgtgagccactgtgcccagccagtatttttattgcagtaaaatttacttaagattgaaatgcacagttcttaggtatacacttctttgagttttgataaatgtatatactggtataatgtttattatatttctacacctcagaaagttcttttgtaccccttctggtccctccacatctcctaacaggcaaatactcttctgatgcatgtcaccgtttattaattttacctgttcttgaacttcatataaatgtaatcaaatatattatgcttttgttaataactgcttccctcaatggttctgagatgcaatatgttgtatagcagtcattctatttttaaaataactgaataccattctactggatggataaaccacaaattgctactccattctcctgttgataaaaatttgaggtcaggcatggtggctcacacctgtaatcccagaactttgggaagctgaggtgggcagatcacttgaagccaggagtttgagaccagcctggccaacaaggcaaaactctctctctactaaaagtaaaaataattttttttaaaaagctgggtgtggtggtgtgggcctgtacgcccagctactggggaggctgaggcacgagaatcgcttgaacccaggaggtggaggttgcagtgagccaagatcacgtcactgcactccagcctgggtgacagagtaagactttatctcaaaaaaaaaaaaaaaaaaaaaaaaaaaaaaaaaaaaaaagagagagagagaaaagaaaaagaaaaaagaaaaagaaaatcggaaatgtttgcagttttcagaaattatgcataaattgctgcaagaaatttttatttaagtctttttgtggggctagatagatagatgatgaatggatggatggataaattgagaagtagatcttttctttgggaaaatacctaggagttaatttgttgggtcatggggtaagtgtatgtctaaataagaaactgtcaaaaagtttcccatagtggttgtttgattttgcacactccatttgagagttcccgttcctccacatcctttctcacatttggttgtcgtcgttttcatcctacccattctagtgggtgtagcatagtatcttattgtgttttaaatttattttgtctgatatttaatgacattgaacaagtttcatgggtttactggccagtgacatatcttcttttgtggatatctattcaaatctttggcccatttctaaaaggtgggttgtttatctttttatttttgatttgtaggagttctttatacattctagatacaagtcctttctcagatacgtacattgtaaatattttctaccattctgtggcttgctgcttcatttccttcatgagcagaagtatggcagaataaaacaactcttaaaaaagtgaattgtttatttgagataaaagcatcccaataagaaaaaaaaattatactataggatgagaccacacttctgtattttgggtactgggaatactttacatatcctttcatatatacgtatctaaacacacacacacacacacacacacacacacacacacacacacttatatatgcatataatataaatataatatatataaagtcttatatatatctgcagatgttttgataaacagaaacttttatttttatgaaacctaatttatcaaatttttcatttatggttagtgtttctgtgtctgttcttaaaaatctctgccaggctgggcgtggtggctcacgcctgtaatcccagcactttgggaggtcaaggtgggtggatcacctgaggtctgcagttcgagaccagcctgaccaacatggagaaaccccgtctctactaaaaatacaaaattagctgggcatggtggtgtatgcctgtaatcccagctacttgggaggctgaggcaggagaatcacttgaacctgggaggcggaggttgcggtgagccaggatcgcatcattgcacttcagcctgggcaaaaggagcaaaactctgtcccaaaaaaaaaaaaaaatctgccaaccccaagatcacaatcataccatcctacagtgtcttgtagaagctttatagttctagcttttctgttgaggtcggggatccaactaaacttgatttttgagtggtatgaagtagggtatgaagttcattttcagccccgttcatttatccaggttgccagcaccatttatgaaagtatttttctcccactaaattgctttggtggccttgttggcaccaattggctgtacatgtgtgggcctacttctggactatgtttaatatgctccactgatctctctgtctattcttacatttattgattgctatggctttccagaaagttttaaaatcaggtaaagtgagtcctccaacttaaattttctgtctcaagattgtcttagatatcctaggtcctattttcatatgcattttaaaatcaacttttatgaaaaagtctgttggaatattgttcgagattgcatagactgagtagaattgtcactgaacaatattgggttctctatgaacacagtagacccctctactcagaaatttttttgtgattttcaatatagagatctcgcatacattttgctaaatttattcctatttcgtttggggttttttgcatgtttttaaaatgacactgttttctaaatttcactttccatttgtttgctgctagtataatattattttcaatatactgacatgctcaattcaagtattgttgctactagttgtttatagattccttgatactttctatttaaataatgtcatctataaatagagatctttacttctttctttctaatctgaatgccttttactaatttcccttatctgactgtcctagctaggacctccaatattgaacagaaatcatgaaaacacacaccttaccttgttccgaatcttaggggggaaacactcagtatctcaccattaatgtggtgttaactagaggtttttggtaaatccactttattagattcaggcagttctcttctattattatttggatgagagttcttatcatttgggagttgaatttgccaagtgatttactaaatctattgagaggattatatgtttttgaaaccatttatttgcttaacaatgtggtaaattatactgattgatttttaaatgttaaaccaaacttgcattcctgggataaaccccacttgatcatagtgtattaccctttttatatattggtggattcaatctgataatattttgctatttttgtgtctatgttcatgacaaaaaaacattggtctgtggttttattttttggcaatgtttttgctaggttttggtatcagggtaatattaacctcacaaaataggttgggaagcattccctccttttctattttctgaaagagtctgtgtaatattgtgttttttttcttaaattattggcagaattcaacagtgaaaccatctggggttggtttttctttgtgggaaagtttttaataatgaattcaatctcttttataaagctattcatattttgtttttctttttatctcaattttgacaatatgtgatttcgagcattttgtccatttcatcttggttgtgaaacttactggcataaagttgttcataacatatcctttctgtaggatcttatgattcctcctgatattcctgatattggtaatttgctttttctctctttttgactgatccatgttgctaagaatttataaattgtattactcttgcagggcaccaacttgcagccttttcaatttctccattgtttgttttctatttcacttatttctgttttttattacttcctttcttctccttacttttggtttaagtttaatttgctattctgttttctagagccttgagctggaaacacagatcattaattttaaactctttttttccccaatataagtatttaaagcaatgtgcttccctcccagaaattctgacatattttcattatcattcattttaaattattctgtttatcccttataattttttgacccatgtattactaaaacatgcatttaattttcaaatttcagtgctttttaattattgtcttgttaatgcttttaatataattcatttgtgattcttgaacacagtctataaggttttaaacctttgccgttcattaagattaattttatggttcaatacagtctaccttgatgaatgttccagatgcacttggaaagaatgcatattttgtggttgctgggtgtaatgctctacaaatattacttagactgctttcaagtccaattccccaggtagctgacactcccatggtgacttgcaagcaggaagtttattaggcagtgcttccatctatgctcaacaactgtgggcaggaatgaaaagcagatttgggctgagagacagacagaaccatcacaggttcaacagaggtgccagttgattttagtgggcacatggacctggggcatctctttagatgtcctcattttccagccactctgtgagcttatactctgccccctgatttgtcaaaccagcaaagctgcagctctccacttgagttccagctgctccatgccaggtggcgtgggaagagccacctaaatgtatatttcactaagtgggtgtggttttccttccttcaagggtcaaatcctgtccacctcctgtctattttttgtttttctccagcaacctcaaatcgttttaaagattttttccaaagtttatcattatcatctgtgagaggtttagttcaacttaggctatgccgtcattactggaactgagccccttccatttttcaaataccagatggaaaagttaaaatgttagggttgaagggatcttagagtttatttaacaattccttcttcaggaactctggtcaaccttccattgatatgaattccctgactttgaaaaaaaatcacctcttaccatcttttgacctactccaatgttagtcaaaggcttctcaggtaacttctgcccactacaggccccagtggaacttacaggctggcaaagggaggccaatcatgaacatgcagacaaacatttatggtttagggtaagtgcaagtaaacaatacacagagtgtggtcatcgaaattcacttggggcaggacttttgcagagaggatggttagagaaggcctctctgagaaagttacttttaaaaatttcattttcaattgacaagcaataattatatatatttctgtgatgttttgctatgtttacattgtggaatgattaagtcaagctaattaacaaatctatcatctcacacacatcattttctgtggaaaaaaaatttaaaatctactcttttagcaattttgaaatatacaatgcattatttataatgcattatagtgactgtaaagtcactattctgtgcaaaagatcacaagggcttatctctcataactgaaactttgtactctctgaccgacatgtccgctttccccattcagccccctctccagccttaggcaaccacattctactctcaaattctatgagttcaatggttttagatgccacttacaagtgagatcatgtggtatttgtctttctgtccctggcttatctcacttagcataatgttcttcaagttcatccatgttgtagcaaatagcagaattttcccctcctttttttttggtctgagatggggtctcactctgttgcccaggctggagtgcagtggtgtgatcatagctcactgcagcctcaacctcccaggcttaagtgactctcccacctcggcctccagagtagctgggactacagacgtgtactaagatgcccagctagttaaaaaaaaaaaaaaaaaaaaattagggggcggggctctcactatgttgcctaggctggtctcgagctcccggcctcaagcaattctcctgcttagaatcccaaagtgctgcgattacatgcataagccaatgggtcctagcttccccctccttttaaggctgaatggtattccatcgtgtgtatatataccacatttactttatccattcctctgatgatgggcacctaggttagttccatatcttagctactgggtataatgctgcaatgaacctgggagtgcagatagctctgataaattgatttcaatatatttggatacatacccagaagtgagcctgctggatcatatggtagttctatttttagttttctgaggaacctccatgccgttttccataatggccgtattaatttacattcccgccggacagggtggctcacgcctgtaatcccagcactttaggaggccgaggtggtcggatcacctgaggtccagagttggagaccagcctgaccaacatggagaaaccccgtctctactaaaaatataatattagccaggcgtggtggcaggtgcctgtagcaccagctactcggggggctgaggcaggagaatcgcttgaacccgggaggcgggagttgcggtgagccgaaatcgcgccattgcactcaagcctgggcaacaacagcaaaactctgtctcaaaaaagccagcttcgcagtcgaaggacaagagtcgtagaagcggtcgaggcttttacggctccggcgtgccggaaagtgcgtgagtggaaggtgcttgagtgccgccgccggggagttttgttccgtttccgggatcctggggtctggaggcaaagtatgttatgcataaaagtggataatttacatgataaatgaaaatggccaattctttaagaggataagtactaaatctttataaaaatctgctgtatcttgatgaaaccccgtctctactaaaagtacaaaaaaattagccgggcgtggtggcgggcgcctgtagtcccagttactggggaggctgaggcaggagaatggagtgaacccggggggcggaggttgcagtgagccgagatggcgccacagcactccagcctgggcgacagagtgagactccgtctcaaaaaaaaaaaaaaaaaaaaaactactgtatcttggacgagactatccaaaaggagcagactattttaaacggcgtttgaacaacattttccttaaaaacaaagacgtgaagaatccagagaagatcaaagaacttactgtacagggcgaatttgtaatgaaagagctagaagccttatatttctttaggaaatacaaagctatgaaacaacgctgttattcagatatcaacaaaaactagttgatccttactactttaatttagctgacaaccagtgccagctgtttctgtacaccagctattgtaaaataattctaacttaaaatgggaagatgtacatgttgtgtaaaaaaatccctgagctgccctactgaactaaataggtttcaacttctgttcatactgagagatttatcagcaactttatgctcagtttttatacaaagatagcaatttagctatactaccgattataaattaatgagcaccgaattttgaatgaaaatataatacacttaatcttgtaacttaataggacttagccaattatttttagcttatttttccattttactgacaagagaatgccacatactgaacatttaataggcaaattttcttttctttttttttttttttaagacagttacactcttgttgcccaggctgtagtgcaatggcaccatctcggctcactgcaaccaccacctcctacgttgaagtgattctcctgcctcagcctcccaaagtagctgggattacaggcgcccgccaccacgcccagctaattttttttgtatttttagttgagacggggtttcaccattttggccagactggtcttgaactcctgacctcaggtgatccactcgcctcggcctcccaaagtgctgggattacaggcgtgagccaccgcgcccagccacaaaataatttcttacacacttgtttctcttaacttttgaaaggaatcccttatttttttccccagtttggtacattaacagcacatattcaaggttcactacaaaacaaagcagttcctggtaatgacttaaatgtagttatagaaataataatatgtatggagtcattcctgctgaacttgaaatagccttctggtgacaggcattacatacataactattcaattatttccattattaatgttgctgctgctacctttgggcctgaaaccaagtcacctgttgtgtatcaattagcttctttgataaaaggaaataaataatgtcattctattattttatcataaagacaaaaaatttacattcccactcatggtgcacaagttttcccttttctttacactcgctccaacacttgtatctgacatctttctgataatagccattctaacaggtgtgaggtgagatctcattatggttttaatttgcatttccctgatgattagtaataatgagcatttttttcatatatctgttagccacttgtatgtcttcttttgagaaatgtctatttggtttacttgcccattttttgattggattatttattttcttgttatagagttgtttgaattccttatatattttggatattagccccttatcagatgtatggtttgcaaatattttctcccaatctctgggttgcatctttattcattgcttctttgctctgcagaagctttttagtttgatgcaattccatttgtttatttttgcttttgctgcctgtgcttttggagacacttggacaatgtccaagaaataattgcccagaccaatgtcatggaattttccccctttgttttcttttagtagttttatagtttcaggtcttatatttaagtctttaatctattttgaggtgtttttttgtatgatgtgagataagggtccaacttcactcctctgcctacggatatccaattttcccaacatcacttatgaagagactgtcttgtctccattgtgtgttcttgtcacctttgtcaaatttcaattgattgtaagtgtgtgggtttatttctgggatctctttgctgttctatcggtcattgtgtatttgtcagtaccatgttttgattactatagctttgtaatagatttcaagtgcctctagctttcttcttttgtctcaaaattgctttgactattcagattcttttgtggttctatacaaattttaggatttttttatttccatgaaaaataacattggaatgttgatagggattgcattgaatctgcagatcattttggttagtacggacatatcattcttccaatccgtgaacacgggatacctttccatttatttgtgtcacttacaatttctttcaccaatgttttatagtttccagtaagaaggtctttcacctccttggttaaatttactcctaagcatttcattttttggtgctattgtgaatgaaattgatttcttaagttccttagcagttagtttgttgttagtataaaaaaatgctactgatttttgcgtgttgatttcgtaccctgcaacttcactgaatttgtttatcggttctaacaggtttttttttttttgtagaatctttaggattttctatatttaagatcatgtcatcagcaaacagagacaatttcacttctttcaggagtgatctttaggctgaaacataaaggatggggagagagaagtgtataagcaaaggcactaaggtaggaaaaagcaaggcacatttgaagaacagagggatggccagctccatcaggaagttagaacaagattcttgtaagagaatgtttagaaaagcagagaggggtcagatcatgaagggccatgttgaaatcaattttgatttgaagccaattgtgaaagtaagccattggagggttagagacaagagggatatctggtctacctggccactgtgtagaaatagacctagaggatgtgtctatgaaaggagccagacaggttagaaggccgttgtagtcattttggtccacagatgtgaaagtggggagctggattatgtaattttcaaggtcttttcctcttgaatcattaggacaggacacaggatatcgctccaatgccaaacttaatctgatggcaagacaaggtgcggatgagagggattctggtgaaagcctaggaaaagacaggaaggcagggaagacgggctgggatagaacccagtaggccccgtgggtacccagccccatgctgccctagcactaaccactagagggcaggagtgaccagaccagacagaaaaagagactttataaggcaagtttgcaagcttacttcttggaggctgtggcatgaagaaaaacttcactgggaaaggttaaataaaggatgaaagactttccatacttgatggtgaagccagaaccagaagtaaggtgaaaatcataaggatacgttttgcatcaaagcaggaggaatgagagctgccccacagcggcaacagctactttgagaagagatgagccactgatcagcctggacaggagagtggacatgtctgcttgggtgactcattgacaccccaaacttctttccttgctcaccctcagatgagtttatgcacctgggttccccacttccggaaccctgtgacccatccactcactgagacctgaacctaagtctcacactttgctcctccttaaccctggtgagtttcagccactcaatctccaagtcctgtcaactctgtctccactaacatcttcagcatcatcccctcctctccatcattcctaccatagacttggttcacgtgctgctaaagctctctccccttgcctattacaacaggctcctaatcagctccctccctctaagctcagtcattcagtcaactttccacagagcagagagagctttccaaactacaaccctaaccagaggaagccccctcgtgactttccacatatccctaggataaaggacacactgtaacccagaaataccttaatcattgccatcttcttcaaggttttccttgctactttggccatgcaggatgaaactcttctaatgagtcatgctcttccaaaagtccatatcctttgtatatacttttccctctgcccggaatactgcatcttattccccttttccttcactgcctggatacctagagaggccatgaaacctgtaactgggagcacaggtttcaaaggcagacagactctggttccaatcccagctctgccacttactcatgtaatatctatgagagttggggtggcttattcaacctccgtgcctcagtttcctcatctgtaaaacaggaataaaaaataacggctactttacaaattgatatgaacactgaatgagataactgatgtgacacagtgcaaggcctgacatgtcaggcactacatgtactagctcctgctgttatttatttattacagttgattttcttgttgttgtttgtttttggttttgcttttgtttttgagactgggtctaggctggagtgcagtggcgcgatcttggctcactgcatcctcccgcctcagccccacaagtagctgggactacaggcacgtgccaccacccccagctaatgtttgtattttttgtagaggaggggtttcaccatgtttctcaggctggtcttcaactcctgagttcaagtgcttggattgtaggcatgagccaccacgcccagccccattgcttattcttagcaatccacatgaagctactgggaagatcaaatgaaagaatgcacagacgtgcttttgaaataatgaatgattatacaaataatagtaatgaaacatcgtttttagtagtggtatctttacaatatcatcaggatgcagaattgttattcctgacttcaaccatccctgagagtcattaatgcttagagactctgaacacagaggccccacagtcacatagaggccccaaagcatttaaccaaacaccttcagatttaattcctccagaggagaagtattcagttgaatagttaaccatggaaacgtgtttgttcacatagacccaatcctaggaaaatggagaaagtggtgaggtttatttctggatcctgtacctctttcaaaacccatcttcctcacttcttcttcttctcaatacctcacccctaagatcagatctcttggcaggaccttgtcattggagcctctaattcagagaagcctcaggacataggagatggggtatttaagaataagagagggtgtctgaagaggaggacaggccagatgcccagcccagagtaccagcacctcaatacaatcacgctattaaaatgattcttccaatggtataaggtataaggcctgaaagcaatctttttgctcagtctttaagattcactgaggtgactctattgatgatactttgggcaccatgacaagcaaaaggggagaaatttcttttgcaagattgggtcatacaaaaggccaacctataccactttgaaaacaaatcctatataaaagggactcttcaagtgcaagccccctcccaaacccaggctaaggactacaatggcctcagcactctggtgctggacacaggtagacagaggcagtaagcttgaaggttaagttcatggatcctgggaccaggttgcttgggttccaatcccaattttgctatctaccacctacaaagcctcgagaaaattacttagcctctctgtgcctcagttttcttatctgcaaaatgggtataatagtacctacctcatagagttcctgcaacttaacatatgccaagtatctaaaacagtgcttggcacatggtaaacaatctgtgtcagctgctattattattccgatttttttttagacaatgtgtttcccattgccagaaagtctgacagtgtggttagtttggaaggcaacacggcaggtgcagtatttacatgagaatgagctttggcatggatctgactttgagccccacctctgcctcttgcagctcagtgacatctaagtcacgggttcttcatctgcaaagtggggataccaataccctgcccttcctacttcacaggtctttgagcagaccaaaatcaagtgcactaaagtgcttttccaaatgtttattttttaagttaacatagaataaaatagactttgggggtgtatagttctatgagttttagcacattcagggaaccaccactaccaagatatggaagagttccatcaccccccatacaattgctttttaatcttgatgacgtagtgtttcacagcctaacacctggctctcctacaatggtacattagataagaaatattcaaggcctggcacatttcttagataacaaagaaagaagatgaattccagtgattgaacttcctgtgcattagttgcctttgcactgtctgttccttcatctggaactctctgtctacagacacatgcgtggcccacccacctctccctcaggtcctgctgaaatgtcacattctcagtgaagcctcccctctgactgccactgtctggtactttggatcctacttgttctttttttccatagcatgcaccatcttctataaactatatactgtaacttattttttttttttttttgcttattcttcattttctgttccctttcatagaatgtaagctccccagggagagagaccatcgtctgacttgtccactgatgtactctaagcacctagaaacagtgcctagcacatagtagaggttcaatatatatttgttaagtaaacctgtttaaaacaacaaggatgaagttaaactatcttcacttgttgtttgggaagattaaatctgtgattatacaaaagaaagcagctgtcacagtgcctgacacataaacctaagttgaacgaaaattggaataatgcaaaggactgactgattctccctgtcccccatgtaaacacaacacggcttataaattctccactcgatgagggctaaaacaatttttttccttccctattaggaatcagtatttaggtaattaatcctgaaatgctaaaatcccctctgcacaagcagaaaattttaaaattcatggagacaacataacctgggctttagcaatgtattaatgagcataggcagtgaagtctagggacaggctgagaactccgtagactgtgtcactccagctgcaaagctaaaagatgcttaacttcctgaagagcaggtccaacatgcacctgctgaggaagcagctccatcctgctcctttctcacacacagacctgctggcccttttgaccccaaagctcttttccagccacatcaacaggaaaacatgcactgtctttgatgagttcaaatccacccacacaggccttgatctcctgtgggtagcatcattgttctcgtgagtgggacaccgtgggtccccagacaagaagaatttgggctttggaaacaggatttgtaggtgagtgagcacaaacaactccctcctctggttggagaacaccccagggtgtcaggaaattttgtgggagagggtctcctcgaagtcaagagaggagacgagattcttccatttatttgcaaccactcccacaaactgaaatatattcaaatacagaaatgccaaaacaaggtcccaaaaaattttcatgtaaatgaacacttacctttagcaaattaaagcatttaacttcctaagattataaggtaacaataactgaattttccaaaaaatattcacaggatttatttacgaacagaatttatagagccctacaggcagcactagccaggactggggcccaagctttgaattatctaataatcatgctggattgcctctagcttatcaggaccctcatctgaaggtcatgtcaaaaatctaagtggccaggcatggtggttcatgcctgtaatcccaccattttgagaggccaaggcaggaggattgcttgagtccaggagtttgagaccagcttgggaaacgcagggagaccctgcctgatacggtttggctccgtgtcccgacccaaatcttacttgaactgtgaaaatccccatgtgtcatgggagggacccagtgggaggtaactgaatcatgggggcaggtctttcccatgctgttcttgtggtagtgaataagtctcatgagacatgatggttttataaaaggggagttcccttgcacacactttcttgcctgctgctatgaaagacatgcctttgctcttccttgaccttccaccacgattgtgaggcctccccagccatgtggaactggaagttcattaaacccctttcctttataaattacacagtttcaagtatatctttattggcagcatgagaatggactaatacacagtctccacaaaaaaatcaaaaactttgccatgggtggtgacacatgcctgtggtcgcagcaactcaggaggctgaggtgggaggattgcttgagcctgggaggttgaggctgcagtgagtcatgattgtgtctctgcacaatctgcatgattctaaacactctgggtcacagtgcgacgctgtctcaaacaaacagaatccaaatggaagcccttgataaggtgaggtctggagctcaagtgtcacctgggcccctctgtgattgttgctccagatgaacccttcaaaataaatttcaatgatttttagcaatactcacctactctaaaatcaatcatatatgtattctagtctatctcacaatattatttctggactttttggttccaaactgaagctggagaggtgtccaccttggtgatcatctagaacgctggcctctctgggctagatcctctcctgagtgtggacactcaggataccatacgttccctgagcaaggaaggcactctctcaatgacagctctttccacgggcagcaatgtctgccgggcacagcctccttctcttttgtggcatgactaggtcttgttgtttctcagaactcaactctgtatcaatcattcagaatggctttcctgaccacccaccagcaccctccagactgggtatggtggagtgcaattccagtgttcttagaggccactcttgagcttctttccatcacagacctatggcttttttaatgtaagcatcaaactctaatatgcgcccatatcatctggggaactttctcaccaatacaaattcccaggcttcctctccagaggctctgattccacaagctggaaaagtagtagcctggaatctgcatgtgatcaagctctctaaatgacccaaatgattcactgcagctggtcttgatctccaaaatgggacacttgtcccctagggatttccaagatggtacattggagtacagggaaaaatggttagcactttcattccaatctttgatctcacccttaaatttctttttggcatgtacattttatggacacaatatattagtaaagtattgtcaatcttaaaagacactagagaaaagtctctctagctatgttgggtttgtcctggaatacaataaagattataatccggaatgcatgaaatgacaagccaccagtgcactcaatgagggaaggataaaggggagcttttatagcaatgagagatttacataagctgcttagaaagacagttcattggttccagaggctgttgttagttcgttgggggagatgccgttactgggcaagtgttcttccgagaacatcttatctgaattactgcagtcctaaagaatgtcgagtgatttatcaaagcaggagatgcgtgaaggacgtgaaagtgattttagaaagtccttgaaaacagttctcatctcagacaggtaagtatgagtctcctctcctttctggccccattttgtctgagtctgacaaaaattattttggtgggcacagtggctcatgcctgtaatcccaacactttgggaggctgaggtgggtggatcactaggtcaggagttcaagaccagcctggctagcatggtgaaacctggtctctactgccaggcatggtggctcacgcctgtaatcccagcactttgggaggccgagacgggtggtcatgaggtcaggagttcgagaccagcctggccaatatggtaaaaccccgtctctactaaaaatacaaaaattagccaggcatggtggtgcatgcctgtagtcccagctacttgggaggctgaggcagaagaatcgcttgaacccaggaggtggaggttgcgccactgcactccagggtgacagtgcaagactccgtctcaaaaaaaaaaaaaaaaaaaaagaaagctggtctctactaaaaatacaaaaattagctgggcatggtggcaggtgcctgtaatcccagctactcaggaggctgaggcaggagaatcgcttgaacctgggatgccgaggctgcagtgagctgagatcgcaccactgggtgacaacctgggtgacagagcaacactccgtctggaaaaaaaaaaaaaaaagatttcatcctggtatctgcaactttctcagtattcatgatttataaataaatatgcttatgttggggagggcaatttacagtttgaattattagccacaattcttcatcagcccccaaggtctacagtttgccaagtgagttttcagttctcccagtagaagctgagtgactctcctgcccactgactttgggtagtcatgtgactgcaccaggccccatcatgtgaccagttttgattaatcaggggagccttgatagtgaccagttttgaaccatgagccaaagagacgtcccatgtttctacttgccctcttgcacctctgtcactgccatgagaaaagcatgtcctggctgtcccacgaatccaaggagcaagtgagaggagacctggactcaagctgcaccttagagccaactagatggctgcatcttagagcccagccaagaagagtgaactcctagccaacctgaaggcacatgagcaaaacaaatccctttcattcatgccattgggggtctgtgttgtttattacagtaactcttgatagtgaacattggttcagatctcaggcttgctgacggtgtatctgtatttcagctttgaacccatagccccttgtaggcccttagttaataacagaataaatggaggttttctccattttctgggaaaattctgattgatactctctgtggccctgtctgaaagggttgatgatcaactcacttttccaaaaccagccaccaggactaaggctcctggagtgctccagatcaccttttttgccagtcagactcagagcttgatgtccaatggtaccctgggctgttgcattatcttcaggtcaaaatactacaccctattacctgaaaaatacagtatctgactgaaccaagggctgaccttagcctgggttcctcattttcctttgaccagttgggctctctatgaagccagttcccagtaatccggtgagtcccagtgtctaggctctgccttgaatctcactccttgactggtcctgttgcccctgggaggaccaactccccaactcctagttcccagagctatggctgccatgcccatcgacctggttgggaacccacaccctagccatttccagaatcagagctgaaaatgctccctcaatccctgacaaagaaaacccagaaagcattggtatcctgatgttgttgagaaaacgtggcgactgtatactgcacaaactccatcttttctgtttttatcccattagaaaagggcacttcaccagaggctcgttcttgggaactccgtctttcttcccttctttattttctttccttcttccctcctgcctcccttctttattttcctccttcttggttctgtatcttccatttctccattaaatcagagctgctttttcaggaactaaatttgaatctgaaacagacttgagagttgatgtgatttcttactcaatatagaacttccctctatagtgtttccaatgtcaaattcattgctgtcatttactgaggacctataaagtgcaaaacactctgatatatatctatctacatatatatatatgacgtatatattctaattcaggtattaactagaatctgtcatgtaggtattatcatttcctttaaacaaacaaaatgaaaacttcaggccgggcacggtgactcacgcctgtaatcccagcactttgggagtcagaagcaggcagatcgcctgaggtcaagagtttgagaccagcctggccaacatggtgaaaccccatctctgctaaaaatacaaaaattagccgggcatggtggctcacgtctgtaattgcagctactccagaggctgaggcatgagaatcacttgaacccaggaggtagagtttgcagtgagccgagattacaccactgcactccagcctgggcgacagagtgagactctgaaaaaagaaagaaagagagaaagaaggaaagacagacagacagacagagagagagagagaaagaaaagaaagaaaaagaaagaaaagaaagaaagagaaagaaagaaagagagagagagaaagaaaacttcacaggggttaagttcctcatccaagatcaaatagtaggtcagtggcaaaagcagagctcacttcacacattgttgtgccgaaaattctcaactagaatcttcagaggatccagttcaacaacttcatttcatcagtgaagagacaaagagctgagcaaagagaggtgagttttattgaacgttggttcatttcatcctcataacaaccttatgagttgtacaaatacaaacgcttatcaacactctttgcatctaacagacgtgaaggctgaggcacagggagatgaagtgccttccccaaggctgtgtgtctagttcagtggtggagctgggattcaaacccaggcagtctaggtcctgggtccagttttaattacagaatgttgccttcccgggacacataccagatcagaagcagacaaggacagagcagagaggaatcccagcccgtggtttccacagcctgccctttcccctccagcacactggctccagtctcatcatcagtgaggagcacaagtggaaatccaattccacataagtggagggagcagagagtgggacagcctcaggatttccctggatttatcacagctccttcctcctcagcgcctagccccgaagccatctgtggggaatgctaatgcgcaccagcttcagagaaggccgtgctgctggcctttcatgtgacttaggggaaggctgaggatgcagctgcccgcacagccagcaaagcatttgaattgctgctgccctgcaaaaggcagatcatctttccagggcaaccacggcccagatttatagcctgtaatttccagtctccaggctggatgatccatgacgcttgctgggcagaggaagggattaagcagcaaggaggggctggcacagcccactaggaagtataataagaaccatgatggtggtggtggtggtggtggtggtggtggtggtggtggtggtggtgatggtggtggtggtggtggtggtggggttgctaccattaactgagcctcttttaagaatcaggcactgtggccagcacggtggctcacgcctgtaatcccagcactttgggaggccaaggcgggtggatcacgaggtcaggagatcgagaccatcctggctaagacagtgaaaccccgtctctactaaaaatacaaaaaactagccgggcgtggtggcgggcgcctgtagtcccagctactcgggaggctgaggcaggagaatggtgtaaacccgggaggcagagcttgcagtgagccaagatcccgccacagcactacagcctgggtgacagagcgagactctgtctcaaaaaaaaaaaagaatcaggcactgctcagacagtccctagatgatccccaactctcacgacaaccctggccaggaagtcaggaagtgctatcacctcattttactgatgaggacactgaggtccaaagatgactttttttttttttttttaagagacggggtctcactttgttgccccggctggagtgcagtggtacaatcttagctcactctaacctcaaactccttggcttaagcaatcctcctgccttagcctaccaagtagtcaagactacaagtacaggccaccacctccaacttttttaatgtttatttttatttttgtagagacaaggccttgctatgttgcccaggctggtctggaactcctggcctcaagaaatcctcccacctcaacctcccaaagcgctgggattacaggtgtgagccaccatgcccaaccctaaaaatgataaataacttacttatggtcactcaacttgtatacaataattacagctctgtcaggcactgctctgaccctgaactcatgccatcctccctccagccttaggaggtaggtgtgctggtattactctcccttacagatgtggacattgaagcccaaaatgacacaactagtaagtgtcagagctgtcattcaaacccaggctctctggctctggtggtcacagtcctaaccactaagcagcactttccctccatggtattaggattacaacccagctctgactgagtccaggccctacggattttccattacatcatcgagccttgggtccccaggggcctggaatctgtcttcttgggcttcaaacttagctcggttatacagaggcacttatagctccattccccacgccctgaccctcacacagcaggttcacgtctctgttccctctcttggcatgcccttccctacgttttcctactttcttcagttggctgtttttgactcatcctcactcagctcatcacctcctctaggaaggcttccctgacgtgaggtggtctgtgttcctgaagttccctgtgcaaacccatcactgtgggtttgggggaaaggtaccaagtctggctttggactctgagttggaggcagttggaggcagcagcaggcagggccaggcaccccgtcaatgagagatgcctgcgctgccaagatctgggaaccagacctgactccacaagccgctcctttctgctggagaagaaaacacacggtgccaaataagtgccctccttcctagagacaaaggggaccttctggatgccttgcttagggctgtgatatgcatgaagtacaaaggaaggcaccgaaatgaggggaaaacaccagtcatctgaaacacctggaggaagctattgacaggggagggagagccagatacatagagacagagaagagagagaggctgagacagacacagagagacagatatagagagactgtgacagagacacagagagataaggcagagagatacaaagagacccacagagaaacggaaaaaatatatagagactgagagatagagacagagagagagagagacagagagagatagataaaaataaacacagagagacagagaaacttatatagagactgatagagacagagagagagagagatacagagagagacagagagatcaacacaaagagacccacagagaaacagatacacagagactgagatagagacagagacagagaaacagagagagaggtagagacagatagacagaaacagacccccagagagagagaaacagatacagagagacagagagatagtgacggagatagagagacagagatacatagagacaaatagacacagagagatagagacagagagtgatagagacagacaaagatatatagagatacagagacagaaagacagatatacatagacagacacagagagatagagacaaacagagacatagagaaacagatagagacatagagagccaggcacagagaacaggccctgctgagcaccagctgtggatgtggcagcactcagtcttaccaccttcagttgcccacggccccctgcctaaggcagggcagatggccagctgggcagtgcttctggtggctgagtgctgccctactgagtaattgggtgagttccctctggaaagcagagaaagcaaagtgaataggtgtctgaaactcatcacatccaagacagaactcctggggtcctgccacctccactgcaaactgctcctctcccaccctccttatctcaggaaatgaccccactaggtgttcaaactaaaaatgtaggagtcttctaggattcctcccttcctctcacctcccagaccccgaccaccaccaacccttatctttaaaacagccccggaatccatctcctttcaactccctggttatcactgggagccaagccaccgacatctccccactggacaaaggcagctctcctttggtttcctgcctccccacgggttctccctgtttactcttcacaggcagctgcccccttctaatccttctgtgtccccctgtcctttgggtaattcaagcttccttcacagcctgagggccctcttccccttctcattttccacatccgagctgtcctttctcttctcaaataagccaaccccattcccccagcacccctgtcccccatgcccttctcaggtctgtaaaccaaaattaaaatcctaagcccccaagcaactggctgcatcctttcttggccaagaggaccccagagaaacctgaaaaactgaattcctggctgtgatgggaagggaggccagacatgtcccattccacgccctcccttttggagtttaggcacaatggaccaacattaatgttgaaaaagagatcattggccaggcatggaggatcacgcctgtcatcccggcactttaagaggctcgaggcagatggatcacctgaggtcaggagttcgagaccagcctggccaacatggtgaaaccccatctctactaaaaatacaaaaattagcagggcgtggtggcgggcgcctgtagtcccagctactcagaaggctaaggcacgagaactgcttgaacttgagaggcagtggttgcagtgacctgagtctgtgccactgtactctaacctgggtgacagagcaaggctctgtctttaaaaaaaaaaaaaaatgctgggcatggtggctcacacctgtaatcccagcacttagggaggctgaagcaggtggatcacatgaggtcaggtgttcgagaccagcctggccaacatggcgaaactctgtctctactaaaaatacaaaaattagctgggcctggtggtgggcacctgtaatagctacttgggaggctgaggcaggagaattgcttgaacctgagagacgaaggttgcaataagctgagatcgtgccactgcactccagcctgggtgacagagcaagactccatctcaaaaaaaaaaaaagttaaaaagatcattagactaacaaaattttagtctttgtgacaataaggtaccaaattataaacaagacctgaggccacacaaggcaaacattaagtcatgccctacaaaccataaaatcctgttaaatttttttttttaattcatcccatataaggtagcttactttccaacctgactctggtgtctttactgaagcattcctttaagcctttagacaaagctggactctttcaaccaactgccaactaaagaatctctaaaacccatctatgatttgtaagcaccccaacaccacccgccccagcttcaagatgtactgcttttttgtgccgaaccaatgtataccttccatgtgttgatttatgattttacttatatttcctgtttccatgaaatgtatgaaaccaaactgtaacctgatggcctcaggcacacgttctcagggcctctcgactgctctctaggcctaggtcacccatgtgtgctcagaataaactttttttttttttgagatggagtttcgctcttgttgctgaggccggagagcaatggtgtgacctcagctcactgcaacctcggcctcccaagtagctgggactacaggcacccaccaccacgcccagctaattttttgtatttttagtagagacggggtttcaccatgttggccggctttcaccatgttggccaggctgatctcgaactcctgacttcaggtgatccacccacctcagcctcccaaagtgctgggattacaggcatgagccaccaggcccagcccagaataaacttctttaaaatatgttgtagagcttggttttcttgctcacaggcctttgcaccggctgttcccctgcctggaatgttctttccttgctccctccttgtcattttggtcccaccccaatgtcacctcatcagagttctgttgtaacccccagcacctctcacccttaactacgcacttcttccattatcccacggtattttctgtttagccagagggctttatttcctgtcagactcccccatggaatggcctgggacccttctcactcagccccctagtctcactgcctcacccagggcctgcacacagaactcacaaggggccaatgtcttgggggactctgggtgtccaggaggtcatgggctctgggctggtagaaacagtttctgggagagagattcctgtggaataatagcactgcgcactgtggcactcctactccagcctctgcaactctgattagccaacggggagactaggtgcagacgagggaacagacttgtccagggtcactcagccaagcagacgcaaggccaaagccacaacacaggtctccaaggtacaatgatcacaattaaaaaccatcacaattagccaggcacggtggttcacgcctataatcccagcactttgggaggctgaggcgggtggatcacctgaggttgggagttcaacatcagcctggccaacacaatgaaacccccatctctactagaagtacaaaaattagcccggtgtgatggtgcacacctgtaatcccagctactcgggaggctgaggcaagagaatcacttgaacccaggaggcggaggttgcagtgagtcgagattgtgccactgctctccaacctaggtgacagagcaagactctgtgttaaaaaaaaacacacacacacaattaaaagacaagttctcaggatatctgtatgtactacttgctttctttctttctttcaagacagagtcttgctctgttgtctaggctggagtgcagtggcacgatcttgactcactgcaacctccgcctcctgggttcaagcaattctcctacctcagcctcccgagtaggtgggattacaggtgcccatcgccacacccccagctaatttttatattttagtagagacggggtttcacgatgttggccaggttggtcttaaactcctgaccttgtgatctgcccacctcggcctcccaaagtgctgggattacaggggtgagccaccacgctcggccagtatgtactactttctagtgactcacttcaccctctctccagacggggagcatttttctcctaaataactaaataataagaacaaccatcatgtggctgtttactcaagcactgagcgaattacaagcaccatatcatcattcctcacacaaccccgtaaagcaaaaactatttttaaccccattttacgcatgaggaaaccgaagctcagggggcttcagcaacttgcagaacatcatgcaccagggaagaggcaaatcttgcctttggatctgtctagtctatctcgagatgcagcccttcaaccactatgatatcctggtctgctgcccggcccttgtgtctcctctcctggtgccaagatcaatagggttctctttgatacctgatgccttctgggcaggactctgtggcagccactgcagtgcccttcaccttgggagcccaatctggtcactggctcagaaaattccataaacagcaggctcagtggcaagtatggggacacgttccccatttgtaggctagcaacaggcagctttactgctgaaggaaaggagtggggtgggcatattgtcactaaaggaagctgggcggtcaccagcactggctttctatgcgacagtaacaatgataatgatgacgatgatagtaataataataataatagcagctattcatttaacatttcctaagtgctaggtactattttaaactttgttcatatattaaaccaattaatcctaacagttgtaggtggaaagaaaaattaaaaatctcgggaccccccccccccccgccaccaaacttcttatgcaaaagggacagttaagcccagaagctgagtcattgcaacaccctcttccaaatgaatagctgttacattatgcatcagccaggtccccgtggaaaggtggaaggcctcaggcatctgcaaaggactgcccccaaagatcattcaaaagtgaccttggctgccctcccataaacaaggacgtgccaaatgtaactttaggtctacgatctaaatcaaggtctttatttttatttgagacacggtcttgccctgtcacccaggctggagtgcagtagcacgatcacagctgactgcagactcatactcctggagtcaagtgatcctcccacatcagcatcctgagtagctagaactataggcacgtaccacaaggcccagataatttttcattttttattgtggagacaggggtcttgatatgttgcctaagctggtctcaaactcctggcctcaagtgatcctcctgccttctgtctaccaaagtgttgggattacaggcatgagccacagcaccagcctaagtctagctctgattctacattataataagctaataacgttgactataagcttatcttcccaggtccaggacaaagtcaagactcattctccaaccacccagagacatccataactgactcttcctttactccttttttctcttcatcattcaccttatcttatgtaaaatggagatttaccgggcactaaggaaagtctcacaagagtataagcatttgccttaccgcctacctgcccctcttcctacatgccttcctcctctttaagaaaatgtataaagactaaatttcctgaaaacctcctcggaaaagcagcctcagatgtgtctgtggcttatgtttttcccagacgtgccctgaagctgccttcataaacctcgatgattgagacttatgcttcagtcactcatttcagttgtcataggggaccagaatacgctatcccaaaatataccactttggcataaggattattttgagctgaaggcagttgagaagaagcagatataagaaaagctctctgccctccctgtgtttgcctaaaagcaggacagaaatttgcaaagctgatcccctaaacctccagcagaaaggacagaaattaatcactgataactttaaaccctcatcagcccaaggcaccagaggcatctatataacgaactttactggcttctatcagcttccccatatatttactttccacaatttgctgccctggaaattcaaaatccttttctttgtcttgtcccttgtctaaaaaaatttttttaaatgctgtaaagcccaagttcttttttttttttttttttttttttttttttgagacagagttgcgctcttgttgcccaggctggagggcaatgccgcgatctcggcccaccacaacctccgcctcccaggttcaattgattctcctgcctcagcctcctgagtagctgggattacaagtatgcaccaccacaccaggctaattttgtatttttagtagagacggggtttctccatgtcggtcaggctggtcttgaactcctgacctcaggtgatccgcccacctcggcctcccaaagtgctgggattataggcgtgagccatcatgcccggccaagcccaagttccaatcacccctttgagttactgaactcccagcgcttccaagtgtatgcacagctgcacttaataaattaagtatatgcacctcataaacttctgtttgtttttctcttgttaatctttcattagtttatttacagggccgcagccaatgcacctaagacaaatagcagaaaaagtgggttttttcctcccatgtatggcaatcctttgttattatctctgcttcacatatggagaaaactaaggctcagaaaggtggcgtcacttgcccgcttgctgcccagattttttgggcccagatgttctggctccaaagtctgagctcctttctccccatacaacctaccactgggcttctttcctcatttgaaattgaggggctcagtcctgaagaactcaggtgcctatcttgattctcactttcaagagcaagaaccagacccagaaaagtattttatttctctgctttcctttatcctgatttctaatagtgtttgtcaaactatattaatcatagtctgttgcattcttgtacatgccaggcacttggctaggcagtttccctgcactctctctagtgtttccagcaatccaatgaagaagcttctgttatcctgattttacgctgaagcatccgagactcagaaaggttcggtaatttgcctaaggtaacccagtgaagaagccactggtgggactgcagagtctagaactaacaggcttttaactaccactcctgcctgcttgcctgtgtcttctccccacattcccacagtgtctgagctcctccagagggaaaggaaggtgttacctgcacctccagctctagcaagaggctgagaaaatgctagatggattaatactgaattaacaaataagtagatgaaaggcaggaaagaaaaggagaagaaagagaaaaagaaaggtaaaaattaggatggaagaaagtaaagaagaaaaatgcagtgaatgaataaaataagaatgcatgaagttaaaaaaaaaaaggaataaaaacaaaagatcgagaaaatgaaaccagaaaaaagaactagattaaaagaatacccaggcaatccggtgccctgctggctctctttctcatcaggggctgctgcctcccaggctccccaccaaaagctgcttcctgagccctgggaagtggctgggattttgccaaacagcagtaatgcccccttaggccaggcaccaggatccctaaggttgatggcacgccataggcagagggaagcagagccttcacatcctggcatcagattccaccaaaagatccctagctgctgtcacttgcaggcaaggaagggatttttcacagccaggatggggattactgctgcggcgctgcctcctccagctctgcagaaaacagtcattcctgctgcactgtctggttgagctgctgaagaaaagccgacttgccttccagcccacccacgctctcttaacctccactgtgagctccgattgagcaattctcacatcctttcccccagggtccagacctgcttagggacacaatccttctcagaatggcagaaaagcaagctctgggggccttcaagaaagcctctagggccacagaactgggcatgacatcaggacccaagactgccccatccccagtgtgctgctgcaccctactttattaaagaggcagacaggagtggaaggagaaatccaacgttcctggagcccctgccaccaaacccaaggcagccagtcatcctattttacagaagagtcaagttggaaatcttaagagtcagattagaactgagcagctctcgcacccctaaactgtgccatgattagctgaggtagtgcactacaaaaccctggccaaaggatccctgagctgcaggcggaagccccggggctgttctggggcttctgcatctctgctccaagtccctggcactctgttctgcaaaacctgcaacagcagagcggagagttctgggcaggaattcctgcttcaagtcctccagggctcatctcccagggccccttctccataaagcctttgagatgcctccatctgactcatcctcaacattctgaagatgagctattcagcaaggactctgtgcaccaggctcctggcaatcctgggagatgggtgtcaccaatcctatcgtatagataatgacatcaacacttaacagggtgagaaagcatgtctaaggtcacccgggcagtacggtgtggagccagcattcaaatttaggtctacttaaccctaaagtccatgctcaaagctactatgccatgatgcctccaggaggtgttttagcctgtatatttttatatttataacattctcttacttccttaagctctttattcaaatgtgactttttttttttttttttgagacagagtctcactctgttacccaggctggagtgcagtggcatgatcttggctcactgcaacctccgcctcctgggttcaagcgattctcctgcattcaagcgattctcctgcctcagcctcctgagtagctgtgattacaggtgcctgccaccacatccggctaattttttgtatttttagtagaaacggagtttcatcatgttggccaggctggtctcgaactcctgacctcatgtgacctcatgtgatccgcccaccttgacctcccaaaatgctgggattacgggcgtgagccaccgcgcctggcctcaaatgtcacctttttaaagatggtagccctcctctcaacacccctctctctttccctgtattttctctgtcatacccattatctaacatattatatatttacttttgtagtgtattacttctgtgccctttcaacttgtatgtgacctaaacaaagacagggatttttgcttatttttttcactgtcatacatccagcacctaccagaaagtgttagctcatagtagatggtcaaaagatatttgtgaaacaaaaaacctgagtggctccatctcttgtattatcactggtttcttagatgtctctagattatacactttttttttctttttttttttgagatggagtctcccgctctgtcgcccaggctggagtgcagtggcgcgatctcggctcactgcccgccaccacacccagctaattttttttgtatttttaatatatattttttgtatttttaatagagatttttgtattttaatagagatccatgttagccaggatggtctcaatctcctgaccccgtgatctcccgcctcagcctgattatacactttttaaggacagggatcctaccaaattcacctccattcagccccataacagagaaaatgagtttattctgagagtgtggacgaatgaaagggatgctttgaccctcccttaatctctctcaatccctagctcaaacatgcatcatgcctttcatggaccacagcaaaactatgcatccactgctctccatgcatccaattagttctccttcaaatccacttccatatcactgactgtcacatttttttcaaacgtaagtttaaccacatcattccctactgaaacactacagttgctcctcgatatatgtctgatatggttaggctttgtgtccccacccaaatctcatcttgaattgtaactcccatatcccccataatccccatgtgtcaagggagagaccaggtggacgtaattgaatcatgggggtggtttttcccatactgttctcgtgataatgagtgagtctgacaacatctcatggttttataagcgtctgtcatttcccctgcttgcacttctccttcatgctgccttgcgaagaaggtgtttgcttgcccttccaccatgattgtaaatttcctgcggcctccccagccatgctgaactgtgagtcaattaaacctctttcctttataaattgcccagtcttgggtatgtcttttttttttgagacagagtcttgctctgttgccaggctggagtgcagtggcatgatctcggctcactgcaacctccaactccctggttcaagcgattctcctgcctcagcctcccgagtagctgggattacaggcatgcgccaccatccccagctaattttcttttgtatttttagtagagatgggttttcaccatgttggccaggatggtctcgatctcctgacctcatggtctgcctgcctcggcctcccaaagggctgggattacaggcgtgagtcactgggcccagcctgggtactcctttattagcagcatgacagtgaactaatacaatgtccaaagctcccatgtagcactaggaactctttctttttttttttttttgagacggagtcttgctctgtcgccaggctggagtgcagtggcgcgatctcggctcactgcaagctccacctcccaggttcacgccattctgctgcttcagcctcccgagcagctgggactacagctgggtgcccgccaccacacccagctaatatttttttggatttttagtagagatggggtttcaccgtgttagccaggatgagtctcgatctcctcaccttgtgatccgcccgtctcggcctcccaaagtgctggaattacaggcatgagccaccatgcccggcctgcactaggaactctttctaacctgtgccagcttcatctcccactagggcatccttgcacagtagctcactgacacttatcctcttacctgccatgcatgtcatgcctctgcacatgctgtgtctgcttcctggaatgccatcctttttcattcactccaaaatccctccccaccccattggattaatgagctccaagcatctttcaaaacccagctcagatattagcttgctcaggaagcctcccaggtactccctctctccccctgccaaaggaaagctcaaacctctctcccagatcatgctgtactcctgcattacctggaggactgctgtgcagcaaactaaaccactcagctgctaaggactgaatgtgtgtgtcccccaaattcatatgttaaaaccgcaatccctaacgtgatggtatttagagatgaggcctttggaagctgattaggtcacaaggatagagccctcatgatggggttaatgcatttacaagaaaagacacagaggtcgtttcctctctcatctgcaaaccaggaaaaagggccctcaagcagaacctgaccagtctggtaccctgatctcagacttcccagcctcccgaactgtctcttgtttaagctacccagtctgtggtagtttattataacagcccaaactgactaagagccaacacagttgagaacttggaaataaaagtgtgggggtcaggggcaggaaaggcccccagacccacctgtctacagcacctctctctaaaccttacaaaaagaagcaaagccctttagtcacatgattcttccttagtaaacaatacacgtatatttcatcatttgttttcccagactttagccaaacggacgtggtaaatcagaaagaatcttgctggaagaaagtacactggctgcttgaagagaaagtggagagaaagattttgaagagctctaaaaacatagtaatccagggccctttctcgtaacagcaaacagtctcacatagaacaaccactctaaagggcagttgacactgggtcccacctgctcctgtccccagcatgctgctgcaccctactttattaaagaggcagccaggagtggaaggagaaatccgacgatcctggagccccccgccacccaatccaaggcagccagtcatcctatgtaacagaagagtcaggttaggaatcttgagtaggagtcaggttagaactgagcagctctcccacccctaaactgtgccatgattagctaaagtagtgctccatgaagccctggccaaaggatccctgagctgcaggtggaagccctggggatgttccggagcttctgcctccctgctcccatgatattctcacacttcctactgctctttcaagtctcacaggccatatacccttttgttattaaccagacaagaaggaagaaaaatagaaagtttcaacccaaggactaacatcaaaaagaaaaatctttagaacataaaagtgtattattgaaatagtccttactgggactaactctaagaataccacataagctagtgactggtctatagtaagtaccttatgtatgttgttgctgctgctactgcttctcctccttctcatactctaaagatgcccctacaaggttagtgcggcatactgtttaaaagcacaagcaagagctgggcacagtggctcacgcctataatcccagcagtttgggaggccgaggtgggcggatcacctgaggtcagtagttcaagaccagcctggccaacatggcgaaaccccgtctctactaaaaatacaaaaattagctgggtgcggtcacgggcacctgtaatcccagctactgaggaggctgaggcaggagaatggcttgaacccgggagatggaggttggagtgagctgagatcacgccattgcactccagcttgggcaacaagagtgaaactccatctcaaaaaataataataatataataaataaaagcacaagccatgaagtcaaaactacctgggttaatatcccagcaattctgtttcttagctctgttacattgggccagtcattcatccttctgtgtctttgtttgctcatcgtaaaacagagataataattctaactcgtccataagcttgtggtgagaattaagtgaattaagccacataaagtgcattgaactgggtcaggcgcagtggctcacgcctgtaatcccagcactttgggaggccgaggcaggcagatcatgaggtcaagagatcgagaccatcctggccaacatggtgaaacaccgtttctactaaaaatagaaaaattagctgggcgtggtggtatgcacctgtagtcccagctactcgggtggctgaggcaggagaatcgcttcaacctggggggcagaggttgcagtgagccgagattgtgccactgcacaccatcctgatgacagagtgagactctgtctcaaaaaaaaaaaaaagtgcattgaactatgctttgcacacagtgaggatgcaacaacctagcagttaggccacaggaagatgtggctgcagcatgctcgaaaagtgggcaggatgatgtacaaaaagaagatgtggagtctgtgagcttcaacgcaggcccaaagcggtactaggtacagtgcgttcttccaccaatcttctgccaacacaccacctccagccagctggttcactgtagcagtagctttcctcaaacatgcctagtcacgtgagactttgacagcacaacagacattctgtccacgtggctcttggactgcctggtgtatttcaccatggcaggccccctgttaataactgaggagctgatgaattgcttcaatcactttagactcacagactcattgagcacaggaggtcaagtgactcccatcccatccctaaacagacacgtgctctttgatcaatcctcatcacctcacccaacataagcttattctagcctctagccattctctaaccttattccagaccttcgcttctgcttgtgcctctgcctggttgtcatttctccaactttctccaagtcggaattcctactaaatgctgaaatcccatttcaaacatcaccttttctgtgaactctccccagctccccctagggtttctcatagtggtttcaaccaatcacctacacagaattatttctggtgcttgctaactacaggtctcctacttgagggatcagggcctagccacctgcatttttaacaaccttcccagatgattcttctttttttttttttttgagatggagtttcgctcttgttgcccaggctggagtgcaatggcatgatctcggctcaccacaacctctgcctcccgggttcaagcgactctcctgcctccgcctcccaagtagctggaattacaggcatgtgccaccacacccggctaatttttgtacttttagtagagacagggtttctccatgttggtcaggctgttctcgaactcccaacctcaggtgatctgcccgccttggcctcccaaagtgctgggattacaggcatgagccaccgcgcccagccccagatgattcttaaatacattacagtttgaaagcagctgtccagacagctagccttgcaaacctgacacttagtaatttggccctcacctctgctcccctgatactttgcacatgacctgtgacagcacacctggctgtgttccaggtgaactgcttagagtaaatctcctctctccagactgggagccacttgaggatagaaaccttgcctgatttatatttaaattctcaacatctccaggtatgttactactctcaccgtctcttttccctcatattccacatctcattcatcaaccaggtggctctactttcttttttttttttttttttttttttttgagatggagtctcgctctgtcgcccaggctggagtgcagtggcatgatctcagctcactgcaagctctgcctcccgggttcatgccgttctcctgcctcagcctctcctgggactacaggcgcccgccactacacccagctaatttgtttgtatttttagtagagacagagtttcaccgtgttagccaggatggtctcgatctcctgaccttgtgatccgcacacctcggcctcccaaagtgctgggcctactttcaaaaaagaaattcttttttaaccacttctcacttctttcaccccaaggaccttagtctagcccatcatcatctctcccccattaactaccacaatgacccactcactgatcctatagctcccacctttcccccactatggctctcttaatacacagcattcagaatgattctctaaaaacatgtcaaatatttgcaagtcacatatccaagaaagtactggtatataaagaatgctaaaagctcaacaataaaaaaagcaattaaaaaaaaaaacaaaaaacgtgtaatagacctgaacagacacttcgccaaagagaatataggaatggtaaatatacacttgaaaagatattcaacataattagcaaattagggaaatgcaaattaaaccattgagatagcactaaactataaagacggctaaaataaaaaataccaaccacgccaactactgattccaatgcagagcaactggaactttcatacgttgttgatggaaatgcaaaatgacatggccactctagaaattagtttggaagtttcttataaagttaaatgtaaacttagcacatatcctagcaatccaactcttgggtatttaccttagagaagcaaaaactcacatccacacaaaaacctaaatacaaatgtttatagcagctttagtcacaatccttaaaaactagaaacaacctggctgtgtgcagtggctcacacctgtaatcccagcactttgggaggccgaggcaggcggatcacaaggtcaggagttcgagaccagcctgtccaacatgataaaacctcgtctctacccaaaatacaaaaaattagctgggcgaggtggaatcccagcactttgggaggccgaggcaggtggatcacgaggtcaggagctcgagaccagcctggccaacatggtaaaaccctgtctttactaaaaatacaaacaaattagctgggtgtggtggcaggcatctgtaatcccagctactcgggaagctgaggcaggagactagcttgaagctgggaggcggaagttgcagtgaggtgagaccacaccactgcactccagcctgggcaacagagcaagtctctgtttaaaaaaaaaaaaaaaaaaaaaaaaaatccaaactcctttccacagcccatgagttcccaccaggcctggctttgggaacctctctgaagacatcttctccaactctcccttcccccacctcttacctgtcctgaggtccatctgctgttctctctgccaggtactcttttctacaggtatttccaaaactcactcccaaacatcacggctctactgaaatatttactccttacacaggtcttctttaactgacttttctataatagtatctataatagtatttccctcatactgtttcgtttttcttcatggcactcattactaagtggcatcatataatatatttgttttgtggttattttctacctttcctctgagaatataagatgcatgagggtaaccttatctgtactagtcaccaatacatcacccagcacttagaatctgcctatcacaggattaaaactccataatatttgttgaatgaatgaatgagcacacccaagagacgaacactcaataatgaaactcccaatgctttcaacgtggagccatactttgactcaaaaatttctttgtatcacccctcaaatcacctgcctacgtggcccctgagtaaagcagtcctagccccgaacatttaattcagctgttggtgctttcaaaaaatgtgttaagttcaacatctcccttctaagtgcagctttctggtgcttgattagaaaactggcaggaggtgccaggctataaggacagcattcttagagtaatgtcatgtggggtttcctgagggcttgcagaaagctatccagaagtgccactaatgtgaacaaagaagtttgaggtaagattgaagaaagaaaaaaaaaataataaaaacacctctctgtaacacctttccaaggagaatgaatacatgagcatttacagaacacctgctctacaggttcctggcactctgagggttctctcttaatcctcttatccttcaaggttagacctattagtcccattttcatgtgcaaaaaaaaaaaaaaaaaaaaaaggaaccaacacagagaggttaggtaacatgaccgatgtcacacagcgatgtctggcattttgaactcaggtctgtgttgccttcaactccattctttttccactttggactttagaagcaatattcaggggcatgagaatgaatactgtccggaggaggcaggcagaacatgccaacctcaagtagaaaacaccgaccaacacctggacactagtggccagtttcttctctaaaatgtttcaaagaccagcatggaccagtctgctgaagcaatatgctgattaccttccagcaaatattactgaacacctaccatacagcaacatttcctgggctggaggtttccacatatattatctcatttaattttcattattgttaaaaaaaaaactattaacgtgatataatttggatgtttgccttctccaaatagcatgagggtatggcaacactgcatcttattcattctttaggttctaaacccatagtatggtgtgaaaatcatgtgtagctaaaaataccctcaaaaatatttttgaaatgtgatccccagtattgaaggtggggcctgctgggaggtgttttggtgatgggggtggatccctcatgaatggcttggtgtcctccccttggtgatgagtgagttcttgccctattagttcacacaagagttggttgttaataggagcctggcacgtactcctctctctgttgctctctctctcaccatgtgatatgcctgttaccccttcgccttctgccatgagttaaagcttcctgaggcctcaccagaagctgagcagatgctggtgccatgcttgtacagcctgcagaaccttgagccaaataaacctcttttctttataaattacccagtctcaggtattccttaatggcaatgcaaaatggactgaaacaacatgtatgaaggtattagaggctgtttatccaaactgaatgacggaaaccttgcaagcaaatacatactcctaagaattccctctccttcaccccatgccctagagatttgacagttaccttaaaaacagagcagcatgaagatgcagacaacttcttttttgaccttctttttctacttcttttgctgtaggccagagttttgcacactggatagcacagggaattactattcagggtttcatacacaaaaaccatgtataatgcaactttctgaccattaaaatatatttagggtatttttggctacacatgattttcacaccatacaatgggtttagagcctaaaaaatgagtaagacacagtgttgctgtacccttagcttcctctaatttactcccgcttgatagataatcaagaaatgttagctctagaaaggaagttacagattgccaagttccactccttgccagggcttcaatgatgacagggccttggaaggtgggctccccctgctggacaactccactaccagcacgttcttcctctatctgctatcggcttttctccaaattccactgctgcagctagctttgccctccagccctgcagaataattataactcctctttcctatgataataatttgaatttctgaagcctgttatttgggtgagactttcttaatgctatagtgatcatgaaaagggtcaagtatctgcactgtgctttttaataaccacgggatggtttttattctgggtgctcgtccaagctattgatacccgcctccccattaggcagctccaccaattaattaaattcaatattttgggagctacgctctggaagcatgcctcttagtcgggaagacaaagaacaaaaaccacacggcatgtggcaactactcttacagtggcacagattcggtgccagccgcacgcaggaggaaagggtcagggtctcagcccatccattgggaaggactgctaacctgtgagctagaagaccccaggaaacacagcctgagcctgctcaaggaaagtgaccaggtctcatactcagcttgcctgttgccctctgtgtctcagacaccagccacaaagccaagcagaggaggttttccataagcctactccaatcttttggcactggaaaggggcctggaggtgagaataactaaatgcaactcactcaccccatgtgtctcaaatgaatgagtgttgttgttttattttttcttaaaaaaaaaagttataaaaatacaactccaaacacctaagacagggagtctttgtgtccatttcttcccatctgtcaactcatcaagtgacatgaaacaaatcccctaacttctgtggacctccattttctcagctacaaattgaggggcttggccaggcacagtggctcacacctgtaaccccagcagtttgggaggctgaggcaggtggatcacttgaggtcaggagttcaagaccagcctggccaacatattgaaaccccatctctactaaaaatacaaaaaattagccgggcgtggtggtgcacgtcagtagtcccagctactcgggaggctgagacatgagaatctctgagcctgggaggtggaggttgcagtgagctgagatcatgccaccgcactccagcctgggtgacagagcgagactgtttcaaaaaaaaaaaaaaaaaaaacaaaacaaagcaaaacaaattgaggagcttgatccaaagaactgtaagatccctttcagaaccagggtcctccaatcttctgtggtcccagacagtgagtggataagctacagtgacctggctgagctagtttatctcaaaaccagcacatgacttctagtacagaaacagcatgcaaggaaacaaaggcagacaaaagattcctgctccagccccaccattatcctgccatggatccctccctcagtacatctgcctgcacagctctaaataccagccctgccactgagcaagtggatcatcttggacaagtcactcaacctcctttagccttgatttgcacatctgcagagtggggttaattttacccactaccagcgcagctcggatgatgaaataaattaaaacccgtataaagcacccagtacctagaggacatatgccgtgtatccctttattcaaacattctttacccactgagcccacttcatcaacatattcaaattccaaaggcttatagtaatctgaagcccaggtggccagacctagaagggctgcaaaaatcagcaagtccaactcctttctacctctgcgatttacaagggagagaactgaggctcagaaacgttcggtgacttgctcaaggacctacatcagcaagcctggcctagaacacagggtggcaaacaccaaggaccacacaagacacaaagataaccctttgtaggcctcattctccaaaattgagaacccatcacttataacccaattctgaaaaattaaaaatagaaaaattttctatttctgtatatctttggaggaccgcaagagatagccaggatcgcagtgtgtctatgaaaggcaaggatttcttgaattacttatgaaatgaaggtcagtggttcttgctagcagttttcctcagctgctctgctcccctctcccttccccacatctactcatttcagtttacatcttgaggcacacatgcctacattgggaccctttctggacaaggtgagaagttttaggtagaggcaataatccatttcccattaaacacaaacaaaaaaaaaatcacagttacactatccataatacaaaaagaattcctctcctcacccctaagagccccagcctgggacacctagaaaagtgcccaaatacattaaggcacacaaacaaccaagggtcagggacccaaaggtccccccaaatgacatgatcaaaatccatgagaccattcaagagtctctggagaaacctcagcccagattctacaagggccactggactgagccggagtgctctagagggagctcagacaatataaggaggaaccagattagaagtggtttcagagatacagggataacctgacgagctcccctcctgcccagattcccaaaagaaagcgtgtatcttcagggagtatctgacagaaagctacaccaagaacacgcttccttgtagctcctggtgagcacactccctagacagtgtctgctaaaacttggattaggaaggccctaatccaagcctcacatcgtgcactttggcaaacagacccagagagggagaccatcctgcccaagctcatatcacaagtcagcggcagccactggcttgagcttgcacctgaccttcagtctagagctagtcctccccgcaccccacggctccttcccaccaggcccactccctcttccaaaaccttgggctcacctcctggttctaaggattctgccaggttgaacaatgctcagaagcaggtggcagtttagcaattcattcagagggacctggggctgtgcccgtccccggtggcaaggagagactgcagtaagagactgcagtgtggaactttgaaatctcttctctaaagaatcctcctcctcctcctcttctttctcctcctcctcctccttctcctcctccgtagtactacggacacatgtgctctgtttgggaggaggaaaggaggagagtatggatgtgtaaggagagtgtggatgtttgttggaaggagaagggcaacaatctgcagggccctgctgtatactcacacctagcagaagaggaacaaaaaaaaaaaaaagagagagagagagctctaactgcttccacaaaattattaacccttgtgctccagctctgctcctcaaatagctgaagcaagagaaacaatacacttaaccaatggagcaccagccaaagacattacatcatcggtcagcaccgtcattggctaataattcctagaaggcaaaattctgcttctaggtgcttaaccctttcatgctcatcagagcaaagaggatttggtctaaaccaatggttcctgaacttgcttttatcagaatcatccaggatgctttctaaacatacagatcatcatttttcatttcaacccatctaaatcagaacctacaaagggagcatggatagctgtattataaatagtgtacagagtgtggcaaccactgatcaactcagaaagtcttcctctccaaacaagataacatttttctgagcatttttcatgtatccaacactttgctacatcatctcatttatttcctgcactgaacaatggctccatatcccaagtataaaaagtcaggttaagagaggctgagtcggccgggcgcagtggctcacacctgtaatcccaacactttgggaggccgaggtgggtgtatcacctgagatcaggagttcgagaccagcctgaccaacatggtgaaaccccgtttccactaaaaatacaaaaattagccgggtgcggtggcgggtgcctataattccagctactccggaggctgaggcaggagaatcacttgaacccaggaggcggaggttgcagtgagccaagatcacgccattgcactccagcctgggcacaacagagcgagactccgtttcaaaaaaaaggataagtcagttgagcaagagatggagccttgctttgaaagacaggctgttgggacccgaccttgctacccttttgaagctcccgcttgaagtcaaaccaagccttttatttacttattgcctctagagttacagaaaacatagactctcttgatgagttggagaatgccaggaacctgggaggaacggggaaatgaagacaatggtggattattctctttcttgggctaattccctctgcttctgttacaaattcagcttaaacatcactatctcttggaagccttccccaaccacccgccaacccccaaaccagggatagatgcccctgctctgtgatcttaaggtctcctggagttgtgggctgcagtttcctgtttactggataaactccatgagattagagccatgtctactttctccactaacataaacctggacagtgcctgccacgtgtgaatactcaatcatgaccaaaagatttgggagagaaagtgtttgccgaagttctaaatggcatcacactgagatgggaaagacaaaggattggaagtctggagactcacaggaacgaactgattttgggcaagttcgtttggacacgggagagggggttggtgtccttatctaaaaatgaggacaatcgcatctcctatgaatagttataaagatcaaattaaagaatgatccaaagctctgattttctcctcctctctctctcacactcgaactcatccattttattggctgacatctaagtgctgacaactgccatatttatatctccagcccagactcccctcctcgactccagactcacagccaattcctgtctctatgtggatgttttacgggcatctccaagagggtatttgaattgtatcctctaagcacaacctgctcctcgcctagtctctgttatgtgaatagtgctcccatccacccaacttttgtttgtttgtttttttaattaggtgaaatttacataactaaaagctagccattttaaactaacaatgcgtggcatttactatcctcatgatgatgtacaaactgtcgcctctatctagttccaaaacattttcatcacctcaaaaggaaaccacttagccattaagcagtcaagccccagtcccacttccccctcagatcagcacaaacaccaatctgttttctgtctctatggattgacctattctggatgcttcacataaagggaatcatacactatgtaaccttttgtgtctggcttttaaaccacgttttcacatagcatttttaaggttcatccacattgcagcatgtattagtacttcactccttgttatggctgagtaacattctattgtatgttatactacattttgtttattcagtcacttactgatggagctgccagactttcagtagccaaccaatctgaaaccataaggctggccaccatccttcatccccacccttttcccatattccctgcatttaaagtatcagcaagtcctgtccattttgcttcctaaatagagctcaaacccttttacttttctccaacactattgctgtcctctagcccagacaccaatatatatctcactgagcttccaactgtgacaagatctttcttctctctattccacttctcacctggaagctgagattgactccttttaaaacataaaccagatcatccattcatttaagcactatgtactaagcacctttcttcaaggagttctcctcccagaggcataacagacaacacacaaatatacactatcacatcaggcttaaaatccttcaatgattcgtttgttgcactttagataaaaatgtaagctcagcatggcctccaagactccactgccttcaaactcatctcgggccactccacacaatttgcccactatgcgctccaaccacaatagcctccattcctccacctcgcggtctttgaataagctgttctctctgcctcttgatcttggcgttgccggatctttctcattccccagatctcagtgtaaatatcactactttgggagaccttccctgactacactgttaagcacatccacccttcattcatttcactcatttaagaaatatgtgctaaaccctgtggtaggctcttgggatgaagcaatgtatgatcccctggagtctgcagtctaaaggggaggaccaacaataggaaagtaaataaaatagataaatgactgttacgaagggagaataaaagggagggagtacagaaggcctttccaagaaggttatattgaaactgaaggcaaggagtcaattggacaaagagcctgttattctctatcacatactggctatgcaatgcaatgttccacccctcaacacttgcttttgatgaatccaagcatttaatgtctatctcctctaatagactgagctttctccccatcacctaggatagcgcctactccttaagagacactcaatacacattgattgattaattagtggatgaatgaatgattaatcaatcaatccaccaatgaaagcactttggaaagtgtaacaaatcatagagttgtgagtgattgttattattataattattattttgtggcaaaagaacatcaacttggttgggttttggaagagactgggtttactataaaatgagaataaaagtacctaagttggagtattattggacaactagaagagaatgtatatacataatagacactcaaaaaagggaagcagtagtcttcgtggctattattattaaaagctcctcacaaaagctgactcaactcgaattccaaaactcattttcaggtgcagtcatgaaacttaaaggtgagagaaatgaatacttttaagatatctactatgcaccaggcacagtacaaagcactacttcatttgtgaggtagtgtagtggataccgtggggaaatgctcaactccccctccaagaccaagacactcatgacttccccatgtccagctgccagagtgttggttaccccagctcccaggtgagtccctagtcaggaactgtcctgctgaagggacatcctagctccctccctaggaccagcctgcacccactggctgatcaacattaagcttcaaaggcctcgtctctttgtctcatgggagggattgagacctctcttgcactgcaccatagatcaacatctccctctgcccagttctgcttcccttatctgcacaaaaatctcagaagcgccaagtctttttccagggaacccaaaccatgacaggtgagtacaatgatttccttttaaatcagaaaaagaaggttcatgaaggttgctaatgtccccaaagcctatggctaaagtgactttctggtctgatttcccagcgagcccttgttctttctactacaccaatctacacacagccttgcctccaatggctgagactggatctctgtgaaacagaaaggggagcccaggcagaggggaagggcacacagagggcttgaagatgagaaaagaagagcagaggcacccttcagaggcctgatgacaagactgaggtcacaggctccagaaacaatatcaaaatgatgtgcaggctgcagaagcaagcattacacgggcagcatctctttgcctgaatccatgtccagaagccagggagcagggctcccgggcagagggggctcccttaagcagggaagagtatttgcagccaaggaccagaaaacaactacaacttaccagctttctgatgctccggcctccatccattgtccccagagctgccagagggacctgatcactgatcagaattcttccacggccctccttcattccaggataaaattctaaatattctaaggctgcactttaaggtctgtgcaggttttagcttcctgccatgtcgagagctcatttcctacctacagcaagacccggtcctactccattatctgctgtagaattatctgatgtgctaggtcaggacaccggaccttttcagtttctttacctttacacaagaaaacccacctggaattcctgctccctatcaactcacagtcccaacacacttttcagcctggcaaaacctccgacttccagtcaatgctcacctcctctctgaaaccttcctggcttcctcaccgtcctcttctccatctcgagtcttccgcactaccctgcactgcaattgctcctcctactgtccctcttagccccagaagctccccaaaggccattcttcatgctgctagggcttggcacagttcctggcactcagaaaaagccaagtaagtgctggatagatacacgaggtgctgtatccatagctattctctgcttctagcttggccaggaaaccactctgaaatttcatcctgcccccaggatgactggaaatcggaaatggcatgacaaacctgacctcccaaacccaaggcaacaggtcatgaggggtctggggacctaaggcaggtcctaggagccggcgcagagcagaggtccggccgctgcggttcctggtttcccgcaagctcttccccgggccgggcgctgggtggaggcagtcttaggatccacagtcttgcgcgcccccggctcccgggcccggcagacggcccccgcacgccgatctgtctgtcccagggaccggcccagggccccggcagcggcagcctggggagacaccgtggtgcgcggctccttgcctccctccctgcccctccgtgcgcccgcatcccgcggacacagagccggagctccaggggacgcagcccgacgcgagaacgcaccagcagcccccgctcgaggtggggtctcccggctgtcagaaaccccacaaagtctactttgcggcgccgcgccgcttaccgtgcgagccgccaggaactcggcgcccggtggtgcctcggcgcggcgcccgccagtcgatccgctccgggtcccgggagctcagcctctgcccctcaac
